United States Patent 9,328,346 (POLYCOMB-ASSOCIATED NON-CODING RNAS) - sequence listing, part 105

SEQ ID NO: 21265 - RNA, 61481 nt, Homo sapiens
gugauagaaauaaaaccacuuuacuguuuagaauaaaggacacacuauaaaaagugaacauuaugcaacauuacaagacaauauacauucacggaauauaaaauucauaaauaacauggaggaaaacuguaaacagugcuacgaaauuuagcaacaaauacauuccuucuagacaggguucgagaucucuuguugguuucucuccaucacuucuggguuucaggacagcagacuggcuaaagggaaaggcggaugcugggagaaucuaagaagccucuacccccaaagcaaaaacuauucuccaaguucuccccuuccucucgccuccaaagagccaauuuggaaguuguugucacauccaccuccccuacuuuccauuuuguuuugcuuuugccaucagauuuuuauaauguuugucucucauaaaaauacucuagugacauguuaaccuuagguagccagaagccaaacacuugggugccaucuugggguaguccagauugucaauugucacaugcaagacagaggucuggggcauggaaggguagugucuccugggggccacaguuugcccuagacagggcuauuccaaaaagucauuuguuucuuuaauuguucaagaaccauguugccaccaugaggcaggucuggaacgaggggaggguaaaagacaggagucucccaguauuaccuacccuggacagagcagagcacuggcccgagagcugagagccugagcauggagcuuccuugauugggaggcagaagagaugcccaaaggaggaagcgagaacuuggaauuguaucucccauggcccuggauucuuaggaaaaucauggcuucccaacuggaugggcagcaggacuuggggugaaguaaaugguagacuacccagggccgagugacacagaacaagaacaugaauguaguuuaaacuuuuuuccuacuccaggagccauugggauuccaauagggaggaggcuggaggagucucaguuacuaguuccuucuauuucccccaauucaccagucuagcugcuugccuagaaguauuuuccucuccauuccacugcagaauuugauucaggaaaauggcggcauguggguuucauuuuucucuuaaacacaauguacacauauuacagccuacacaugacacaagauuuagcaaaauaaaauguucaugauaugauugaaauacagaagugucucagcuacauaaaugauuuuaaauuauacaguaagugaacgggugaaauaaacaaagcuauagcuuauagaaagcucaaaaccgcccucugacaucgcuuugcgaaagacccuucuuugcccagggccuccucaccaaggccuaacagauggggaugugguucugcuaauuuaucgacuccgcagggaaacuucaggugccucacacucagccuucacccaaguuccuccuugugugagagaggcugaccacaccagggagugcgaauggccagaugccucacagagaagacacugauguccacuugugggagggaacuuguguagguuggucaggggccccaccaugcgagaccuugagguuaaaauaaggacaaucccaaaacaucaagucugggcucaucccuucaaaaccagugacaugcuggcaucagcuucugcucacacugccucacaaagaaggccaagccucccauucucccccugccaaauggcaugaccacaaugggaaagguacacgguaaugaaauugaucccaaggaaacccgaugccgguacucucuucccacucugcgguucugccaagcaccuugccugggcacuugugugugugcaagacucuacaguguguugucugcugcuuuuuuuuuuuuucuucuucuguuucaauuggcagcucuguuuccuaaaguggaaugaacugaagauacaaauacuaauagaagauaaauacccauaagcugaaaaaagagacagagagcaaucauguucaaugucaccauccugccaacccccacucuguaaaauauacauuaucaccuacucucagcaucucacuuuugacacuaaaacuuaaaauaauuuuauuuaauaggagaauuuauauuauaguuuuauuucaaaaaaaaaaaaaaaaacacaacagaaacccuacaacugguugcaaacucaggcuuuccccagugaccaacaauuuuaauuccaagaggugaggaucucaggagguggcauucacccaccagggagcuagggaaagggaaccaagcugucuccacacccaggagaggugucccuccagccaaggcaggcaggacacucugcagcucucccuccugugcccaggcccuugacuacacucucaucugccaucugagcuaagccaggaaggcaguuaaagaaaggcccccaaacaugaagcagggacaaggagacggacaggggucagaugacccaugauagggaagagagggugcugacgguguucagaauuucaaauuuuaauuaaaaugaaaaaaaaaugucaacuuggaaugucaugauuuucuucaaacaagcaacgacaacaaaauagaagagauuaaacuauuggcauauuuaacagcauugaacagaauucuguguccuguaaaaaaauuagcuuauguccccauguggguauaugcaaauguguauacaaacauaucccccuaggugagcuaaacacuauucuggaaauaguauccucuacccaaaucuacuuggcuauaucuguggauaguguaugguguguguauuuauccaauuuacauaaaagaaagcuccuggccaaaucuaccaaagcguuuuccaggaggaagucuggugggaggcagggagaggaaagacauucaucucagucuuucaccugagcuuuuguacaaggcaggcaaauugccuccugaccucaggcagauguuuaagucuucaccaacuaagaaagcucuguuauucuggccugggugcuugcuccagacucaggaacaucuggucaacacaagcaucacugggcuggggaauugugugugugcugcaucaucuccgacucucuuguaguuccuuccuucccucccucacucuuacaugcagacacagacagacacagucugguugggacaugcaguggcagcuccugguguauaacaucuuucacacaccuugagucuaucugcuugcugccuuugacugauccugaaaugguuggccuuucagcaaguuccuugucuguguccuuuauguauuggaggagaagggcaaagggaagagggucugggagauggugagguggggaagaagcaagaggggugggaauuacaauccucaaauggaguaguuuuucauuuuuguuuuccuaaaaaaauagagauuauauuaucacgaagaagaggaauacagguuccucauucuuucuggcauggcaccagaaauucccagguggaaaugaaugaugucaaaaccaaaaagaaggggcaggguggggccaggaggauaguucccaauaaaccccauaugacagcauagaccuuucuuuaaauguuccaagugcuaaauuugcaagaaaacaggcacuaauuucauugucaucaucugggaagaguuaguguccaagggaagcucagcgggaagggagggaagugagguggggcagggucuggcgcucaggggucuguggcauugaugaugcuuuuauccgggggggcccauccucgguaccagcugcaguagccgcccuucugccggaugcaggcguaguguuuggacugguagccaggguaaccgaaauuggagagcaugucgguccagagacacucguucuuggaagucacaaagcaaggcagguaguagcaggacuugaucugcaauuagauaacaggcagcaguugauggacucugccaugguaugcccaggccugaggcuaccgagccuggauucagacccuggggccacugcaugggaagccuagccacaucagucccucagugaucauaauauaaauagcacuagcuugagcaucugcugucuaacagacauucugauaagugcuuugauauuauucucuuuaauucuuaucacaguuuuaggaggcucugagagguuaaguaacuugcugcaggucacacagccaguaaguagcagaauuagacuacugagaggacuuuuucgucucaggugggagaucucaguuguuuuagggaaucgaggaauuagaaagguuagagcauaaacuuuggagucuagcugcccuagguuggaaaccagauucagugaacugugggaccuagggcuaguuacuuaaguucucugagcucucaucugcagaauggagaucauaguaauuaaaaccacacaggacuguuuugaagaugaagugagagaauggcccaacuuccucccacagcaggcaggcugcaccuuggcccuauacuugggucagggggaugggccugguaaagagagaccuucuguagcaucuggucucugcaguccugggcccauuugccuaccuggggugggguuagcgaugagucagcuaccagggugagcccacuugaaaccacuugggagaaccugccagugucaggauccuauaccuccagccuugaacugccagguggggccagggacucaagagcccucaugccccagcagcuuccaaguggucaucauggaggcagccgauuacagcagaaaggcauucuuccuucccugccuuccucacugccccaccuggggcaacaauccuuacuauaucugcucagaccugccccucugcccuggccuaacacaugcauacccuucccagccgagggccuggcacccagugcauugggagcugauguuucuagggcugcaagucagcaccuccccuccuucccccagugaccccagagcuuaccuugcaguuacaacccaggugauaccgauaguucagccccuugcgcugggagagggugagcuggucccaccucuccacgaaguugcacagccccguguacaucuugccaucauagacgcgaccuacaggaggaaagaagaaaacaaggagagguuguuuuguccagagccuagcccagagagaauucacaccuacuauguucccacuuagcccaggcacuguggcuggguacuuuucagacccaugauuuuauuucacccuacccaacaccuuuuaaaauggacuguagccccauuuuccagaugaggauaaugaggcuuggagagguaaagugauuugccaaaggucccaagcccauuaaauacuggagcuaggacuagaggccaacucuucacucccuuuauaaugauuuuuguuuuuguuuucuccuuuacuacacugacugccuaaagaugaauaacuuucaaagacgggccuaacaggucgagugugagguggagaggaacagauacucccuuuuuauuuacaguaaaguugagaagcuacaaauuaggagauuuccucccccaggugagugguggagcuaauuccaaaguccagccuaaguguaggagccucaagcuccuagcacuggguaagugggaugaauucaacauuagagacuccuuacaauuuacuggacauuuggugagucaacuacuccguauguguucuucugaagucaagaaacaguggaccuuggccaaacccuggccuagaagcuagaguuggccauuaccugucagcagguacugguacuuguugaccuccagcuuaaggccacagagacucucggaagcuuccguauggauguacugcacauggggcaucuuggugaagccucgguacaucugugggcaaaaggaacaucaugacuucuucuuucccaguuuggacacccguaugaucccuaaucccacugcuggguauguauccaaaggaaaggaaaucggaauauggaagaggggucugcacucucauguugacugcagcaauauucacaauagccaagauaugaaaucaaccuaagugcccaucaacagaugaauggauagacaaaaccugguaucuauacccaauggaauaugauucauccagaaaaaagaaugaaaucuugucauuuguggcaaugcagcuggaacuggaggucguuuugcuaagcggaauaagccaggcacagaaagacaaauacaccauguucucacucaugugggagcuaagaaaguaaaucucauaaagauggacaguggauuggugguuaccagaggcaagaaagguaauaaggauuggggcaaagagauauaauuaauggguacaaaaauacgaguacgcagaacaaguaagacccaguguucauugaaucaguagaaugacuacaguaaacaauaacuuauuguauaucucaaaguagcuaguagaggauaauucagauguucccagcaugaagaaacgauaaauguuuaagguuaugaauaucccaauuacccugauuugauuacuauacauuuuugaauauaucaaaauaccacauggacucucaaaauauguccauuuauuauguaucaauaaaauaagaggaacacaggagaggagucucaguacccagaaggcuugcugacauuggaucugagggaaucucgcuccccuauucagcuguccaguggccggucacugaucuacccaccccagggcccccuucaccccagaugaagccaccgauccucuugacuagccagguuggugccuucccagagaaaccuuccugugcagccagccauaccccccauuccaacugccccacaacacuccuucggcuacacaugucugacaucccagcaccuuuucagaaauccagagaaguagcugugacaaagguccuuuuucuuugucaaccuuaggaccugagucccgugaacucagccagcauucucaugauaucucugugacacuuuccagcccacaaaaacauucucacucacauucuccuugcaguauccuuaaaagagcccugggagggauguauuacaaaccccacuuuauagaaauucuauuuggcuggugaacguugaauucaagcuagaaauucuccauguuuuuuauucuucugagcgucuggugaaagcauuggguucguuuaucccagaugaagcacauaaauguaucuacaaaguucaaagaguuuuaacuguuaaauacuuuauaauuguuagauugaaccacgugaaauugcugauauuuggcuauuuguaucuacgacauaaucuaauacagugguucucaacuggaggcaauuuugccccccuaggaaauauuugggacauguggcaaugucuggagacaauuuugguugucacaacaguucguagaggguagggagguugcuaaacaucccauaauacucaggacagcccccagaacaaagaauuauccggccccaaaugucaaugguacugagguugagaaaucuccuuuaauauuagcccacgaaucaccaugacaacccuaugagguaggaacuauuaugcccauuuuauagaugaggagccugagucacaggcaggcuaaguagcuuguuaaggccacacaguugggaaauggcagggcuaggauuccaagcagaggacucugccuucagaguccauacucuuacccauuaucuuagacuggcucccaggaaagccucagaagucuaugaccaagguccccagaagcaggcaaaugcuauuuccauuuauggccacugugccuccuucagaggcacagugugugcccagagucacuggggugaaugaauguaacagaagcugaguccgcuuugugauuccaggucaaguccaugaguauuacacaagcccagugugccaaggcgauacugugaacugugagauuugguaacgggggcgguggggcaccaagguguugcacaauucuguuauccccucaguucucagcguacacaagcccuggacugcugguggucucugggcuugucccaaggguuuauaauaggaaaaugccucuacuuuacuuccuggcauuugguauuaauuuaccuacaguaauuaauacaaagccagacaucucuucauuggugucucuucuaaaugccucccauuuggccugugagcuggcguuuucucaucuuuuaaguggugacugguuggcggggguaggugguccacaagaccuucauagcauaacuuggucuguuggaccuacugaguuugggcgccccugccuuguuaaaagcacacauuguucugauggacucagauggucuuccuucugaaccucucuucucccccaaggcuugccaacugagcacgguaacgcagccaagugcuggaagaagugccguccacacucagcauucaauuacgcggugggggcgcgggguggguagagucacgaugaugacuucuucuaugugaauggugccucucuagccuuaacaggaaccauguuuaagcgugcugcuguaugccugccauggaguguggccuucgaagaacauccccuacccugacuucugugccgagcaacuucuuauuuuuguguggguguuccuugagguuuuggcaaauguuucaacuaagcacucgcucuaggucuuuuggacccagcccaugggaaccucauuccuucugcgucagucuuuccccuugacugcccuagugcuucgugggugagagaaugaagccccugguuacagucuggucauuugaacugcucaguaagaacucaacucaucgaaaucagcuuggcaccgcagcuacuuggaaguuugaaggaaccugcauuuuagcuccuagcacuugccuagagucgaaauucugacacauuacaaaugacuggcucugacaaacauagcgcuguguuuuagggucaauucugaaaagaacaacauggcaaagguagauucuacucaguuguguuuucuguguaauaauccuaccuugauuuaaauauugauucuaaaaguaucaugucuguaaucauagagaucuagaauugguuugacaaauuuaggagaguuauaauagguuuauaauguccugacaucagagaauccuagaaucucagaguuggaaaagauguuaaagguaaucuaauccaaaccaaugccauggagaucagugguaaauucagguuuuggaggcugacagccagaguuugaaucuucaaucuucucugccaccuguguucgccacuuggaaaguuacuuaaccucuuugggucucaguuucuucaucuguaaaaugggucaaagcacuucuuaggguguuugagagaagcaaaugacuuagaauagcagucagcccacaacauucaauaaaaguuagcuuagaacaaguuauacugaaauucguaaggagaggaggaaugaguuugguccccuuucuccuaagucccuuccucagcucuuaacaagaguaguuaaagcugguuuagaacuucagacauaaguggguuguucuuuuucagcuggguucugcaugccucugggccccucuucuucuucuugguagcaucuacacaaaguuccaagauguuagcuucccuuggagugaagggacaaauaaaguaaaaaagaaguuucugagucuggggacauuugcauauuucuuaugaaaugucuggccuucacucuacauugacagcaugaguugccucaaugauuccaacuaugucuugcaugccuaccaaagaucaacacuguucuggaugcugguguacaucacggacucauuuaaacccacaaauucuuauuuacagaccgaccgagcuaucacggccaugaucuuucucuauacagcaauuugucuagcaggacaggcagagaauguagaaauggagccagucucugcagagggcuggaugagaguccuaaggcaggaagaaccacgggcauugcaagaagaaugguucccugugggcugggggucaaagaugcuuccagcuagagcuucaaaggcgagacccugcuauugcucauuugguuagacaaaccacuaaaggaaggaagucccuggaggucugcucugccuacagucaggacaugcaaagcacaugaccagcgggucuccccaugggacccucccaggaccagcugggacauaaugucccccacguucuguccccugcagccagcuggagagcaugucuccgcuacauaaacaauaacuccuggcacaguggaucgguuucucaugguccugaugggagauaagguccccacagcuuagagcagccaguucuggaaacuuucaccuucaccccacagcccagcuaauuuccaaguuugggauugcaauaagcucucucaacauucuaacacccugcucccucacacacacacacauaucgcaggucucuguguacugaaguguuccugagagaugggucagaggcuccagaguuagcagacgggagaaggucugccugccuuccaucagugagagaagagagaggucagacagggcggcucggagucucagguucuccaaguuccuuuaguccugcucuaaggaagcccuugcucaccccuucugacucucuaggguagacugucuaaucugcuagaacaaagucucccagggaccagugccaaaacucaugcaggcuugccucucuggccucucucucuucccuccuacaaagauuuuucugauacacccuuugcaggauauuacaaguccagcccuacacugcuggaugauaaaccaacaaacccaaacugaccucuuuuuguucccugggaacuaaaaacauauggagugggcauuuauauaccccaaaguggguaggaaugaugaaucagccugcugcuccauacuguauuaucuccuuauaggcaaagacccuguaguuuugcucagguuugccacuuuguggccauauaaucuuaacaguuauaugaccucccaggucucaguugccucaccugucaaacagaggacaagguguuaucuauuuuacaguguuaguauaaguacugaucuaugcaaagaccuagcagaaugccuggcacuaagcaauugcucaguaaauguuaacugaugccaagucuuaucauaauuauaagcaguguuaucuuuguauccccaguucauaguacaguacuaagcacagagagagggugggaaggaagcacgagaggauggauggacggacuauuacuucuagccuguaucuugucugacuugcaggcugguaccuagagacaagcagauuccaguggugucucuggauagaagggcacugaccaguucuauggaucaugauacccucuauggagggucagagugaaugaaaggcaugagauggugacugaugauuaagauggcagggagauuugggagucauauaaagaacacaggauugggaagaaauuccgaugccucagcuuggggaucagaucugcccuuaguuaaaugcuugacucugaguaagucauuuccccuuugcgccucugucagaaguaagacgagggauccuacaucuaauucccagcaccaugauucaugagcucaggcgaaggauggugaaccgaaagccuaagcccaccagucugggagugggagugugucuucuaagcccaccagccugggagugggagugucugaugcugauaggcuagcaaguguuguuuggucucuaaacaaccacccguggcuggucugacaccagcaagggggaaugggacauuauguccacaggaagggccucuggucacccuggucuccaggcccugaugguaggaaggaaaccaggcaggcuuaggaacugcugccucccagcuauuucccucucagcucucugcugaccaccgagugucucguaaugaggauuguuccagaccaggcagguucguguguuuucugaaccucugcuuuggucuaauaugcuuuggcauucccgcgcugucugccagagguugcaaagugggcuuuuugcguuguuguugcucuugcugguuccccaccccugcccauuuuucucuccccagggcugucugaagacauaagcuggucucaugaccaagcuuaggcagccaagggcaacuggccagggcugacucuggacauuacauaaccagaaggcuguggauguuugcaaaauugaauccaaagcaacagguuccacaaaauuaguacauccagccucaggacacaggaauaagaaagccuggagguuggccuuggggaugguuggguaccaccgugggcugcgucacuccuccacucccuucuaccuggacauugcggcuugucuccucuggggaguuuccaggccuguggggucucacccucaugcccguauuagacagauaagcauucaccaagucacuuuugcaugccagguccuacccuaauugcuagggaugcaaauaugagcaauaaguuaaagggcuggacaguuccuguggaccucagcacaccccacauugaacuucugaugagucacacacauaccugccucuucucucccaaccugacucuaguuccuaaagauggaaacuguaucucccucacggccucccuggcuccuagcugggagcucugcauguagagaggugcuuacaaagauggggugaugaaccaguugcugaguuauucaaggugaagccccagucuucugugcuaaggcaaucaccaguacacccuuccauuguauaccacccgcuccuccuuacaaguaacauggcccgcaucccagggugcuuagaaugccugagcuagagaggauguuaggagcaccaagcccaaccccacacuguuaacagguggcaaaacugcggcccaggaaaagggacaagcccaagguaagcaggcuauuuaggaguagaggugagacuaggaggcagguucucuagauuucaaaucugguguucuuuuucuuaagggcauaccuccuuccuguacuucaugauguucauauccucaguaauauguuuaaugauaagaauaugcuuagcaaacauugcuaacuaucuaggaugcaagaagacaaucagcugggaaaauagggaaagaaggugaaguuccugccuugggaugagguuccugugaucagcacaguuuccauguaaagauuugagggcuguaaaccuaagcuguaaccucaguggcugcaugaaaccuguaagcacuguugagucccagauagucagagcucagaagaguucauagagaugaucuaguccaacccccucauuucacaauugggaagauuaaagcccagagaggggcagugacuugaccaaggucucaugguuacgagcuaacaaggcuaucugccaucuggcuccagagcucagcuuccuaacaagugccuuggagugacuccaccugcaugggcucuuggacaaggcagccccaugcccccucccuacccaucccuuuaugcagccuuagcagcucccucuccagcaggcagaagggcugggucuggcuggugcuuagacacacaccccaguuccaacccacuuugccucccuuagccaggacucuucuggcaaaaacccaaaaaccuucccggagccagggugaugacauuaccuaccuucaucugcuugaugguguagaccagcgugccgaagggccccuccuuuaccagcuucuuccccaccaccuuggcccggaucacugcagagacagaaggagacaauaagagguuaggaaggccugaaccacaucaggaacagcaucucagggcgggcacgcuagccucuguggagccuggaauugcacucuuaccuuggagccaacuggaauagaugauuguguuuacaagagugggaauucccuggggugagagggagguuggaggaaaaagaaacagccaccauucaaguuaauuaccccaaauauucacaauugccagcuccagaacuuccaaggcuauagucaacccccgccgacccugaggauuuucuugacuuugugacuuuaccauaauccaaaaccuacuucuccuguuagagccauuguccccccucccuuguccaucugacaaugccauggucucccagaucuguucucuuuccacuaggaccccuuucuaaccaccucauuuggggcucuuccuuugcaugcauuaauucaccacaucuugacaugucuacaggguuguggugcacccuagcuucccacagugcccccaguuagcauucugauugagcccuugguauccagugcuuagauagcaagggaugcaauagagucugagcucuauggggaugugguuagaagaaggagcaauugggagucggggcucaggagccagacagaacuguuccaaucucagcucugcuguuuauggcuauugcgacuguaugcaaguaaguaacuuuguuucuggccuccucuucuauaaaacaggaaucauaaugauacuaaucucuugaacugaagggauuagucaagaugacaaaugugaaacucuugauacugucuuggacauaguuugcacuagacaaauauuauuaauaucaucaucauuaucaucaccaaaaaugaaaugggcuaaccauggaagggcuguuccaaugaaaacagcucccauuuauugcacaccuacuaugugccauguacauuucacuuauuuacugcucuuaacugucuuacaagggcaguauuagcauccacaugaucuagauaagguaacagaccaagaagugaaaccacuuccucuuucugagccucaauuuucucaucuauaaagaggguauaacucucuuuacaucagggaauuggaaucaggauugaacgaaagaucuuaugaaauuucccacuacaaugucuggcagaaaggauuuacccaguagauacuaguuaacuaugaauacaaaaguaauuacacccaguggguugagggcugaaagagaggcauuuaccacaugcacugggaacagaaagaggagaggacuugacuuuuagauucuacaagguugugcuucucuuucuacguugugugaaaaagaagcacccaagagcugucuucagguauuuguaaaauuggcacauggaggagcaaauggacaggucuugaauaccaaaacuggaaauugcagagaguaacauucauuggcucaaccaaagaaaaaaaucgucuaauaauaagaaccagcaacaaaaggcaggggggcugccauuagggcagagagugccucuaucagggggugugaugagggugcuggauacuuccaugcuaagaccucaacaggaauuggaauggggcuugcuuaugcagucauacuuugaauuacaaauugaacuccuucagcccugagauccuaucaaucuuucuuaucucaaguugcacuuagcccaaaaaggaguagauacucaauaaaugcuuguuaaguaaaauacccuucacacacacaaacacaaacacacacacacacauuuugguagcuccauuauccuuccucauuguggaugcuccacuauguaucccaguuauuugacucuaaucucuguuuuuaaaaaaucuuuacuaagaacugauuccucauccauacuggauucugucuuguuucuuuccaaaugagcuuggauccuacccuugcagucagacaugaagucaggguucagaugaaucaauggccccuucagaccuucccugccggcgauggcaaaacacacagucauuggcaaagugagcaauuuagcggaggcagcucaaauuaggaggaggcgagugguuguuuccaagucugcuguaaaaacgagagguuggcaagaucccaggccaaugucugucaagauccugcauccaccucuguuucuaacauugcgguaguauucucggcgacaagccagccucccggaggccccggggacuguuuccuccauauuaacucucacaggcagguuauaacagcuucaccuccgugcagaggcaugucugccagccuuuaccacugauucuuccugaaaugauuuggacccaucuucucugccucauuaacacagaagguaaacaagggagcgagucuuggccggggggugugggaggggcaaggcaaaagggauuccuuuaaauagcaacauccugguucaaaaauggcuugacuugauuuagacagaagaugucacaagcagaccugccccauaaagcugaguacugcuggaagcuucugcacauacaaccagccaacuccuuccuuaccccaaauagccugagcuuggaaccuuuucaucugaggauaguucagugaaaagaauacguuuuuguagucaggaagcugcauugaaguuuggguuccaccauuacuguaugaucucucuggggcucuuuccuccugaaucucucuggcuuucuuagcccagugccucucauguggcuaacaagugauuugcuuauuacuauuggagcagcaacauagcauugcauuaaagagccuggucucuggagccugagagccaggguucaaaucccagcccuggugcugggugaccuucaggaaguugcuaaaccucucuaugccuugguuucccaaucuguaagaugggaaugaugaaacaaugccucauaaaguugcugugagggucguauuaauauaagcgcugagaacaguauguaguccaucccaaaccucauguguuugcuaccacuguuauuagcauuaucaccacuauggugaugucuauuuuuauuccaucuuagggcauaccaucuucagacuucuaacaugcacuguaagcuaaggccugggaguucucccuaggaugagaagaaaggcaaccucauaaaaauauucuagccuuacagaacuucagggagagguggagaagcacagaugaaguagucagaacaaguauaggagguauuuugggaucaggagugccuacucuaucacauguacccaucccaccuuaucacccauguguaacccaagaauugccuacuaagaccagccaaacaagaucacagucaugguuccaaaagucugaggcagagauggcccagugaagaggccacaucaguguuuuccuuacaaaaacaaaacuucacuaaacugaacuaaaauuaaguuacauucugcccuccaaauagauucucaaaguccuuccaaaguagaauugcuggccaaccccagauccaccuauuugguuugugcauuaaucuguccguauuugcuccaguuucuccucuguaauucaaaugugugcuauuuuguacucuccuguuuggcaaucaggguucucccgaggcauucgcuggcccaggggccacagggaacaagggaaguggggugggaggagguugugcuuuuccaacaacagaagacacuuuucaaacugguaacuggcagcaugucuagccauuccuuccaccuuguugugguggcuagaagccagcuuuacagaugggccaggcuggacacagguugucuuuauucccauucaugcuggaguauggccccuacacugucuacccagugcccccaacaaucaaaccaacauaggcaugaacuagguuggugucuggaacauuggguugggugcuggugagggugacaacaagaaauagaaguccuauuucccgcuuccacugauggcuagucuaguggggagauaagguuuaaaaguuuauggcuggccggguguggaggcucaccacuguaaucccagcacuuugggaggcugaggugggcagaucacgaggucaagagauugagaccauccuggccagcauggugaaaccccaucucuacuaaaauacaaaaauuagcugggcauggggccgccuguagucccagcuacuugggaggcugaggcaggagaaucacuugaacccaggagguggagguugcagugagccgagauugcaucaccguacuccagccuggaaacagagcgagauuccaucucaaaaaaaaaaaguuuauggcuagaggacuagucuccaagguacagaagcaccaaucagagaagggagaggugaggcucagugugaaucucagccucugagccucucuugucucucuagaauuucuuuugcucuuaggaagagaaucugggcuucuagggaucugguggucaaaagaagcaaggaagaggcugggugugguggcacaugccuauaaucucaucacuuugggaggccaaggcaggaggaucacuugagcucaggaguuccagaccagccugggcaacacagugagaccuugucucuauaaaaaauaaaaaauuauaaaaauuuaaaacaauuagccaggcauggugccguguaucuguagucucagcuacucaggaggcugaggugggaggauugcuugagcccaggaguucgaggcuacagugagcuauaucucaugccauuacacuccagccugggugacagagcaagacucugucucagcaaaaaaaaaaaaggaagaagaagaaacaaggaagagauugauuaaggaauaagcaguauuucaauguaaaaguaucuaagaagaaacuaacuaggaugugugaacuuauauaaugggcacauugaucuauaaauauauauggggcccucuugaauauaucaugcgccugagaagccaggcauagaggcauauaucucuauugaacugucuuugcuuccuuugaauauuuguuugggcaagagugcuaguaagagcuuacaaaagcaaggcaaacaaggcacaccucuuccauaaauauaccuucaugcugccucuccccaccuccagcucuagcaguauggaccacaguggcacaaguuuugaacaaagaacaauuuuccaauggcaauugggauugaguuuccagaaaagcuuacuggugugucuccagaaauugcacaugugcuguucaucagcauaaacagaguggggcaagauacccuugagcugcccucccucucucucucugcuucuaucccccauccaaccauugucaaccaaauccagacccuucuuccccgaccuaaugguuggacuuuccuacuggcagacuagaaggccgagcaacaaugcuacccauuuggcuggucuggggaucaaggacuccuuaacuaauuaauguauacuaacuuaggaguccagguuccacccaugguagcaucaacggaagagcaguacaaauccucuccaugacuuaggaguugauucaugcuaucuagcaggugagauaccaccgccaccccacacacacacacaacacccccauuccugucucuccaaagaccccauagaaugauuuugcugcuuuaaggcaugguuuuuaaaaggacagcaaggauaaguaagggacgucugguuaguggguagacugcauuucuucaaaugcagaagucacuguuagugucagucccagggaaggggcugcucuucugaugggaccccagcaggcaggcucuagguaggaagaaaagccuggaccaugggcucgcaucuucggccuagacuuggaggaaaagagggaucuggaaguguuggaaugaugcccuacccaugaaaacacaccaaaaaggaggaaagagggaucccugucacccagcuugucucacggccccuucguguguauuuuaucaucucccacaggaugacaaagggagcggccuugcugaggccggagugcucauggcaaaggcaauaggucagggacccacagggaggucggccuggagcccgccaagcaagccuuuuuccugcccaccuuggacacucuacaauguagccugcccaaggagggcagagccaggcucucucacucuuccagcugcucacccauucaagaauuacaaacugcuugcuuuucuuagcaucacauuagugaaucuagaggagaaggaagggaacuagaacauacugauaacaaccacuaccauuuaucgaaugccucuuaggugccaagcaacgugugcauguucuuuaacucuguccucauggcaagcugguaagguggcuacuguuguggcuguuaaugucccuacuuuccaacuguggacaaugaggaucagguagccuguaagcaguuuugcauccuagugggggaaaaaaaaaaaugggaggucccccaggacagcagaccaccuaaaaaccuuuacaugggauuucacacugguugcaaaauaguucauaauuuuacugcauuccccacuuucacugcagaggaucagagaagaagauugauaccuaaaaggaaggacccuugauaagcucccagugagccccacaucccuuugaucacccacccaccacccuucccaaucacuuacacagacacacaaacacauguccucugauuaguaauaaaaaucuagaagucaucgccaucagcaguauaacaguauaucguaucaucuguuuagaccuuugugcuccccggcaaggcuuucauggaauaaaaacaaauaacuuagaaaccacaaaaccacaggcucccuaaggguucucccaacacaggaaguuugaaguuaauuagauugauuaauuaaaugagacaauguauauguacaaagguacuuuguaacccugaagcuagacaaaugauacacuguuauauugcugauggugaugacuuguagauucuuaaauuuacuaaucagaggaaaacagcaagaggaacccgaaagauucuugugauucagcauuuccucauccccccaggaucuugagaaccuuccucagugacccuucccaagguccuucucagauaucugcugccucucuggggaugcuuugaugaugucuaggugagaggaaagggccuucggaacuaagggugaaaagcagaggccugaggggccugccuggacugggucccucugauucccagccuauugaucaccacaaucccaacucccaaaaaaacccuccugaaagacucagaagcugaaaggacagaucaagaaaacuggagaagugaucacggcguacuggaaugaaaaacaggcauggagcacguggggucugggugaagucgcugcccuguuucucugugaccuugggcaagucacuucccaucccagcagauaaauugugggugauaauuaccagccuccaaaggugccugcaauaaccuaggcagccuccccccuaaccucuccaaagcagugcuugucgaagucacccaugaccuucuuggugcucaguccggucaucgaggugcaggcucgugguccugcuauguucuuccagcuugugggucucagcaccaucugcacaacugacagcucccacgcuuuugccaccgccaaccuagaacucucaugaacuuuuuuuuuaaacaaauuguauuuuuauuuuaaguucugggguacaugugcaggaugugcaggcuuguuacaaagguaaacauguaccauagugauuugcugcaccuaucaacccaucacugagguauuaagccgagugugcauuagcuauuuuuccuaaugcucucccuccccuaccccacccaccaacaggccccaguguauguuguuccccucccugaugaucuuuuuacuuauauaucccagagucuacauuuagucuacauuuauaccugcaagccuaauaaaacaucucaaauucgacccauccaacacugagcuccagauaacaggccuucccugcacccggggcucucauggccuucuuaaucucaggaaauuguagcucacucuacugcacacccuagcacccaagcaugcucucagggucucugaccuugcaguucccucugcuggaacacucuuucuucacuugggcgggggaccuucccugauccugauccaugcacauuccucccccuccucgcaaucccuuggccccugacacugugcucuaucagacacuggccaccaucugacauuauacauuaacuugcuucuuuacugaucaucucuccccauuaaaauguaagccuccccgggcagcagguucuuugcuuuaccuauugcuguagccaaagcugcccgaagagugccuggcacauaacaggcaccucauauguauuugcugaauaugggaagcuacgugugauuucuuguauaaagugccacacacagagugauuuaaaaacagauaaauaauuccugugcaagcucugucaaaugaccagucuuucuaagucuuauucaaucaaaaggggguaacagcaauucucgguucacagggucagauacacaacucuucagcaaccaggaagguguuucaguauugugaagacguauacagggauagagagauacauaaggcuccuaggaacucaagggccagaggugagagagaccagcaaugacacucaaguaaggcaggcucagcaauauaagcaaggacggaaagccaggacagagccaagaagagaugaaguccaucucaggggaggggugucagggaaucgcccuggagauggcaucagaucugagccucagcccauccugcagaagagacucaguuugcugcgucugaauccagaggaggaagaagucuggaucugaucuggguggggggcggagggggcggcgguaaggagagcagcuggaagugaggcagaaucacagccgggcucugagcaaagccagagccgaucucccgccuuuccaggaagaugaugaccccccucccacugcaagagcaugggggcugggggcuggggguggggagcggcgagcagccugagugaagaggaacucucucucuucagagaagucccacaaauaggcuuuuccugcauccuacccuggucccccagggcccuucucucuuguccguuucaaaggcccuuuucguugaugucaacgccaaggccagaccguuaacaugcacuccccaucaagauaaggagucccaguucaaagccuguccugacuaacucuuuccguuaaguaaaaauauuaaucuugguuuuauuuaagcagguuuuuuuggcaagaaaugaaugccuguggcuaaaaauaaacccaaagacacacacucagaaaaucuggaaagcugcaaaucauuucaacccaaguuuccaucucagggaaagcuauuaaaccuggaggauaugaaaaccucccugcccagagauuccuguuucucaguaccugccuuguguuccgggguccccagggcaggucuguccuggggaugcccuguccuggaccucccggggaaggggaggaggggccuuugugagcuccuggcucuccucaccuugugagcaggauggguuucugcuugagcggucugggaaaaacucagggccccugcugacgucuguuguagaugaaaugaaggggccgggaaggggaggcaaggaaacacaggcuuaggaaggucaggcuuccuggaacuuugagauuacccaaaagaacacaacacaaaauuagcaucccaugcuggccuucauguguuaaggggcaaccucaguuuuacacaaugaaaugacaaaauuuaagagucgcuccuucuagguauaugccuggacuugggaugaaugcauuugauguuuaaucuaacugcuuaaagucagccacucuugauuucuuccuggggccaccagcaauuuggaagaaagguacagauaccuuggccugggacagggcaaaaguccuagggcuggcugauuccuggauucagggccgacuuaccuggggagggaggacugugaaucucagaagggugaugguguuucugugaccuggguuucuaaggguccaaugaggcgacuaccucaaaguguucaccaagcaugauuagaaucccugaggcuuuuacucugcaaauggcugucaggugggaaaugucaaagccccaaaggauagacagugggaaacacaguccuucuccccuaagucccccacauucucccaggaacaaaugggauccacaacccucauuuacauccucaccuacaccucccuuggguuugcaguaucuacaggauuauucugcauagcucgguggcauauauauggcucuucagagcugggaccauaccucaaacccuaucacucugaagcuuccagcccccaucacuauaugaaccuguccuaugaugccccuugccuaggugagaaucacuuccucccugugcaucugccugcaccuuuggcuuccugcaagacccacccagcugaaaugcuaccuccuccaggaagccuucuguccaccccaggccaagcuaguccaccucucuucugcuuggcuuuccucucuuucuuccagcacguguucuuuaaugauugguuccuuggacacucacuagcaucgcuaauuaccggauggcagggacugcaucugggacuccagcacauggcauagagccuagauuguggccaggguucccaaaaauguugaaugaaugaaugaaugaggcugugggagggaaccaaagguaauacaauaacgaagacggggaugguuuuguguuuggcuuccuggagugcugggucaggaguccuuguuccauagaguuacucagaaaaggaagggacaaguaaaaaugugaucuggagaggccgaauaccgacauuguuccaaaauauugaagacugaccuccaaaaagaggcaagucacaggacccuauuacaggagacccccaugaacuuguugaugugucuguggaaggacagcacccaaaagcuaccaacacaugaagaucccaaggcucagcacccucaaggaagucaguggugacaccaaaauuagccccagggagucuccacccaaggcacuccuugcuagaccugcugacuccucugcaggcccucuggccuccagcugccccucuuccuugugguagcacucaggaaauaugaagagcauggcaggcuguuuauccaggccccaucuccagguccugugucccucucugccauaguguuuauuguuuguuuuauuuugccacccccccuccuucuccucaaguccacuugaaauucauugauucacucaucugauauuuauucagaaguauuugaggaacuaugcaucucagauccugugccaugucuuggggauucaguaauaagcaggcagacaagguuccuaccuuuaagaagcuuauuuuacucuugugagacaagaagacagggaguuauaguccagggagccacaggagcaugcagcagacacacccagccagccuggaggcgccggagggagacauccugccugagcugggaucagagaaucacuagagacaguuaagagaaagagaaaggagaggaccuucuggucaugguugggcagaggcccggaggcuggagaguccagcccauuggagagacagaaaacagagaguccaacaaaguacaggggugccuugcagugggcgguaacucccagcuugguagguugggucuugcuccaacaugggacagugccauuucuuaggugggcuucuacucccugaggcuagugauaaagacuuaucacucugucacugcccauagacuuuaggauugcauguauccaaauggguguccaaacaguccauugacaggaggcccccgaagccccaagaaaccccuagaaacaagccugggucuuugcaucagaaccacaaaugaucucauuccagugcacaucccauuucuaaucuucaacguuaguauuucaugcaucucugucucccgccguacccugucuccccucaagcccuuucaccucuuggagugguuucgcccuggguguuuuggcugggcaucugugcugugcucugaggagacaucaaguuuaagggggcaugcugaccucucaaaagcucaagcccacucaggggucagaggcgccgacuugcuuacugccaugcaagugcacucggugaggggggcugagaccacccccuauccccugagagugcuccagccucuccacgggggcccaugggaaacuuuaucccacacaaguggccaccagaauagcagcauggucuucaaccacagccccuuugaagcagugcccagaaaaauaccaugcccucaaacgguucucagaacuuccagcuuucaggucggggcauuuuugaagcccaaacagcuggcaacaucucaggagccaucuauagcauuuuauuuuucuccuaauugggauuuuguuugcuaggagagcugagggacucugggauaggccuaggagcaaguccaccauuagccaaagaaccacccuccuuugcacgccagacccgcagaugcagccuuugcagacagcaaaucuguucccagaaugcaccaggagugggcaggagacuuucuugugguuugaacaagagccaauggcugcucugucuauggauuuuauacagcacagaugccaaggagacccugguacaucuauaacuuacccuucauguggcuuuuaaaauaguguaggcuuuccucaccuuuaaguuccacaagcuucauucuguaagguuguggacacccagggccauaguuuggaaggcccaccugcugcagcggguguuccccuacucacucagcaccucccuuccagcucacaaccacaucacucacauagugggcacucagguaggaacagguacgagaaaaacgagcccauacauaggucuucaagcccuaagaccauuaucaggaaucaauagcacugaaggugcggaggaaugauuaaagagaagauccaaauccuuuuaaggaaaccuucauuuuaaauaaaauaaauaaguaaagaaugcuaacugcugcccucuuuggucaaaguggguaauggcagaacuauaaagccaaccucugguauuucugaaccaccugcccuggccuugaagugugacagggagauggagucauugauaaagaaggagaagaccaacuacucuaugaacaucgugucugugcaaucauggugccuaaaccucuuauucauucaguaaauauucacugagcacuuacuaugugccaggcauugugucagguggcagaaacagaaaagugaacaagacagacacacuuuacaaacaguacaucuuacucuuaaaaccauuccccaaaauguguagcuuuauuuccacugaguauaggaagaaaacaagucucaggauaguuaagaaacuugucagaagucacacagcuaggaauccaaauaugcccagcagcaaagcucaucuucuuucuacuacuaaauauuuaacaaaucugaaacaccccaccaagucaaaugcauuggaaaugcggagauagggaaaauucccaagacugaauuaugagagaagggcuuguauaaguuacagauggugagaacuuugagguggaguuaacucuccauaacucuuguaaugucuaagaaucucauccaauggugaagucuggauucaaaucuccacuuacaagcugggugggccccagggcucucaaugccagauugaggguaccuuggcuugcagacaaagggcaggaagagagaaguccaguaacugaccugaagcccccugguuugaagacagggagcucagcccuuuggaccaaagaguauggcaaggggcgaacaaguauacuuuuuuagacaucugaucggcagcccuggucuaaaucucucaguugcaaagccuuggggccuuugcacauaccauucuaucugcaugagacccucuucugcuccccauuacccaucaacugccacucauacuucacauuuaaaaucaaaaaacacuuccucacauaaagccauccccaaccaccuccugcaagcauaagacuagaacagaaccccuguuuuguauucucaggggcccuaguguguauguaacuauauguucguagauucauuugaaucaugucucauccucuuucuucccugcccccauacacucacuaaauucugccggaauuacaucuugcuuugcucacaauuguaucuaaccgcaacaucucacagugucuggaacauaguaggugcucagugggugaaauaagacaucuuuuccaucuuggcccuuauugauugcuuccuaagaagaguguaucacccuaccuuucucuacugugcacucugucacccaguaugugcaauuagcugcaacauuccaaugccaauuccgcugcaugaacugacucagaagaauguauaggguuuugaucauggaaagaaaagaaggaugguccaggcaauggaaacagcacaaacaaggguacagcaaucagaccaagacugacaggucggaggucacauggcugaggacugcaaagacccuggcugaagagaaggggaggccacuaguucauucugacugaagggaauguccaguucccugggugacagauauaagcuugaauggaggauucuuuaggacuguuccacaaacuaggucuguuguggauccagucauuucugggucucaugcagaccccucuccaggugccaggaugguacccuguaccagauaggaaucauauuuucuggguuuaugggccacccggagugcaccucucccugcaaagcacagggccagcuguccucuuugaaggagggcuguaaugauaaacugcacaugccugcuucuggacacuagaguccucuagagcaauugccacaccacagaguaucugcaaaacauacacagcaccagccaccucccccugccaccuccacugcacaucugaaagcuggcaggguuuugccuaagugaccaguggcugcaugugacacuucuuacucugccugcccaugggaggcuccuaucaaaaggugggcuuggccgggugcaguggcucaugccuguaaucccagcacuuugggaggccaaggcaggcugaucaccugaggucaggaguuugagaccagccuggccaacacgguggaaccccguuucuacuaaaaauacaaaaaaaaaaauaaauuagccagaugugguggagggcaccuguaaucccaacuacuugggaggcugaggcaggagaauggcuugaaccuuggaggcggaggcugcagugagccgagaucgugccacugcacuccagccugggcaagaagaaugagacuccaucucaaaaaaaaaaaagcugggcucagguagucccugaagcacaccuccaaccccuguuccuagauguuccuggcuggaauaacagaacaaauuggaauacauuuuccauuauaugccagugcucucggaggauaagcaaugagaguaccagggaugaacacauuuggucaaacacugacacagaaagcaggaggauggucauguggguaguuccccacuuucccuaauuauaaaaauccuauugucaaugauuacaauacuaauucuaauacuauuauuaguuacaauaggugccaucagcuaucaggcacuuuccaugcaugaucagugcuaaaugcuuuccguggauuuucccauuugagccucacuagggcccuauaaaguaaguguugucauuagcccaucuuuuagaaaucgaggccuguaaagaagaagugacucuccccagaucaucuaaugcggaagugguggacauagcaugccaguccaggcagccugaauugggagccccuacuucucaucucuggguccuaccugccuuccagaaggacauguuaaacuacggcacaguggcaugggcacauuucacaggccacagacuuuagguugggugggaccuucagggucacucaguguaagcuccuuugaauuucuucuacagucccaucccaagguuaaacugcccagugugcaaccaucucugaccuaggucagccuguuccaugucaagccauuuuuuuugacuauaaaaaaauucuccuuuggacugcuucccuguggcuuucucccaccuaggugacaucuugggcuuacaaaaaaacaagauauuugaaaagaagggucauguuucccaaaucaucuccaggauaaauauuuucauagauuaggauggucucucccugcuuaugacauggucccauguccuucgaccaucucagucuugcugggggccaaugacucucuuaauggcuuuguuaggggauaaaugcaaauuucccaggagccaccgaucaguauacaagguugagaguucaccuuccccacuuggaaucuuuuuacugcugguaggacagcuugagacuucaccaucaucuauuuaaguacuucuaguguuaaaaaauguguuaagaagguagaucuugcugggcgcgguggcucacgccuguaaucccaggacuucgggaggucgaggcaggugaauuccuugagcucaggagugcgagaccagccugggcaacaagguaaaacccugucucuacgaaaaccacgaaaaaaaaauuagcugggaaugguaguacguaccuguagucccagcuacuugggaggcugagggaaacggaucacuugagccuaggaaguugaggcugcaggaagccaguaucaugccacugcacuccagcugaacgacagagugagacucugucucagaaaaagagaggggcgaguauaucucauguuaaguauuaucacaauaaaauaaaauaaaauaaaauaaaauacucgaggguuuucaaaccagacucugucucccaacuuugaugugauuuagugaauaacucuacguacucuacuaaauaacuguacucaucuggguggccaaguauaauaauuuuuuugaaaaaaaaaaaaaacccaggcuuauuacguagaaaguauugaauagcaagaagagcccugggccaggaauuggaagcuagauacucuuucuguuuuuuuccauucauuuucuaugugaguuugacaaaucauuuccuccuggagcccuuguuuuuuauuguacaaaaugaacacguuggacuggacauauucuagugucccaauuaacccuagaaucuaagagucccaucacuuuauauuucuaacucaugcauuuccccuggguuccacuuucucuucguuguagugguccaaguugucacgugcuuccuguuugcuauguucuaaaaucacauuucugaaaagucaaacuugaguuaagacauuaggaugcuucagcugccucuucuagcuuugucuucagucucuuucucagccugggaucugucugggugaucugcacuuaacaaaacuggggacagaaacaaguacggaguuggccccuaaucaccccaccugguccaucagcugcacauucaaacugagaggggcccauuugcuaacuagugggacauugcugaucuguaacaaugccgacagccugccacgccugcccugccugccccugaggagggcacauuauucagcuccuugccucaauuuuagugcccuucaacaaucuguuuucuucauuagccacugucuuuuuuugguggagguuggggggggugcagugacauccuauuuuccaggcugacaguccagccaagaguaaauuaguuacaguguaaauaaaccugggauaacuucacagcuuaaagugcauuaggggagcacuggacauuaaugccaggaagggaggggcagguggauccugguguuaaugccaaguaaggucuuuugcucuggcucuguguguucugaaaucuacauacagaagaauucuaaagaaugccgagaagauaagggcuucugccuucaaucuuccaauuauaugcuaguccuugguaauaaaaaugcuuccaggauagcaucuccauggggaccaggcuuuacugccccccaacuccgacccccacauaucaaguggagaugugcacagccaugaagaugaaaauccagccccgcugcccugaucaucuggcuuugaaguagcugaaacagcucucacagacaaguagacucuucagaggauaucagcccacucuaaugcucugaguuaacuuuaaacaauucaccucuucucugggucccuucaauucccagggacaccauccagccccguccucccucuuaaaaauggcagagcaccuuggauggcugauuucaaacauucuuugagagucucagaaaaagguguuuuuaaaacaggaaggagcucucuucugccucaggcucccacacccuccugaaggacaugcuugaggcauaagggucacgcugccaccuugaucucaacuucaaccucagcccaaccugaacuuagccagccugcaucccagccauggaagcugcuauuuuugaaauagaaggaauauucaauacuuuucacucugucaauauuuuuaccuucauguuucuccucuucccccaccccugugccccugguuggggaaaaaaaaacacacauuuuuuuaaaagcuaaacaaaaacaaaaccccauccaggcugaggccagcagaucgcgguguucuggguggauuuugcuacgugccagcgaagaccaucagcaggauuugcaggaaacaccuugcggaauccacugggagaagccaggggccacagagaagcgugaggcggauacacucacgguccaugugacuggcuggcuccccaggccuggguacaggaaacaacugugggauuccagggcccugcagggacagacacacagugguauugcgggggcggggggguggcccuguggaucccucugguguuuuccaacgagaauuccuuuaacucgcauaucuauucccagcugccugugcaugaccugugcugaggggacacaauaagaaaggucacaggcagcuucccaagagcuuccguuccaggauuuggcugaagcucuguuucugugaaagaggggcacacagggcaaagacaugagcacuugggcaccagagaaccugggguugaaucucagcuccagcuccuccuagcuauagacugucgggcaaagcauguaacuucuuuucagcuugaaaagggagaugcaaucauacaaggcucauaggauguugcaggcauuaagggagauacuccccuugagguacuuagcacagugccuggugcaaaguaaccacucagugaacagcagcggugacuacuguuuugugagaggcccccuuucccaagacagugaagaggcuagagggcagcgggaaaaaggacgaagggguuccaagaagagagaaaagaaaaugcaaaguacuagcugggacccauaugggccgugcaagcucacagcagccuggcugccaaccuuccuccuccugaaaugucggcugccccacuuacucuuguuuggagcauuucaguuucaggucagguugaagcgagggacauugacugguaucaguccaagugcagugaacaccccagagcaaugcagagagaggcccagcaagaggcaggaagaggaggcgucacuggaaaaugcucauuucucauuuaagucugucagggucgcaucuuggucccauucuacccaagggugggguguaguuugguugggccaaaagugguacgucagagugcauggugaagcccgcugacaaaccuuccuucuggaggagcugugggugugggaagccagcacugaugugcagagugagaaaugagagcuauggaguuggcaggccugccugggccagggucagugcccggggaccggcauuguccuggcuggaggagggaacagccaguggccagcagucugugaagaggcugggguagaaugaaggccagacccaggccaauuaaggucugaugaaaauccgggccguuuuucacgaaacaggaggcgggcagcccugcugcgguggggaugcuggcuagauggagcaucuggcaccgaucaauucccaggccaagaagugagccuacaugugggugcaaaugaaaugccgaaggcccggggaccccacccccucugucuuugccauaaugaagugccaacugggagccagcugggcaaaggggacauguugccuugcuccguccacuguuugguaacaauuacgagcauucuuucagcaccaacaggaacaguaagcugggggagcaauucuuugagccaccaggcgugaucacgaaaggaggguuuagaucaaagaggguaucaguaauguucaacgcaccucaugggucucuggccugggacuaaagccggcaaugggaugggggagcugcuaagaagugccgagcugaauuaagcaguuccucuuucaucucugcccgucuucuucagcgguacccucugaggguagaaauggugccaguuucagcugguuccaugugccaaguucaaguccgcuauagggaggaggcugguagucuccuccaacccucaagaccgcuccuggggcaguggggagguaaggaccaauguacccaagauccuuguuuuuugucuuuccccuccucauuguggggcccccuaaugagagaggaagagugugaauuuccuuaugugacugucucccccaagcuuggcugauauacucuucagccccuacuccccuccccaccgcuggcuccagcacugaaucugggaacgcucaguccagcgugcugaugaggcaaacacagggaaggaaagagcucagucucccagaaccggccaagaagucuauaguggguagguaagaacucccgcuggauugggaaaccuugguucuaacugccuggaccacuaacucaugagguagcaucaggcaggucacuuccugucccugggccuguuuccccaacugggaagcaaacagaccaaauaaaggcccuuaaagucuaugcauggguaugcccugccuguggccuagaaggcucaucuagaagaguggaaaagacuuauuucaauucugcuccuucuuuccugggugcacagcacccagccagggauuggaucucugaccuuuuucugaggcuggcucuaacacagcagccggcagauggcagaauuuuuuagaggccuguaucucugaaagauuugcuacuucacaucaacauaaaagaauguuguccuaagaagcugucugcuccuaaguggccccguaagaacuugcccucuugaguuucccccacuugaaggcuggagcauaagagcuaaguuugaauccagcacagacacucacuagcugggaaaccagggcaagacacuucacuugucucagccucaauuuccuagcugucaaaagggcauucuuuccugcauuuaacaaauguuagaguuucaaguaucuucuagauggugaacaagaccaacaaggucucuacucuccuggugccuaaguaacggaggaggaaucaggccaaacaauaagacaaauacccaauaugauggcaggugcuaggaggcaaaggggaauagacaaggaggcugguaggaggggaagggaggcaaggaaggccucucuacgaaggugacauuugaguugagaccuccaugaugagaaggggccagccagugaguaucugggggaugagguguuccuggaagagaggacagcaaguucaaaagagacagugacaaacuuggagccuggagcauuugaggaauagcuagaaguauguggcaacagcaaggccaagggagacagaggccagaucccguagaaacuucuagagcuucuugaggaauuaagaagccacuggagggcuuugagcagggcauuggcagagaugugacugacauuuuuuaaaguucacugucuacuuguuggagaaaggauuguaggggaguggcuuguaaaagcaagggaguucaugauagucauaaccaccucucccuugcccacccacucuggggucauuguaaagcucacaugagauucaugcugacaccuagaaaagcccagagguacgggaggagguagauaucaucacauguuuuaaaauccauuuguacaaguaggagcuugcagggacuggcaccaggguauuuggaacuguguuccuguauagauuucaaggaaacgggguaggguggcagauucugcccagccugagcuaugcagcuguccaggcccaaaugaauucacauauuuaaacugggagcuuugcuauaggccacgccuggcucuguuuuugcugcuggugccagacagggguaagcuaacacccagcaauguggagaagcugacacuccacgcaaagucacucgcugaauuccuggccaaagcucaucucuccugcccucacuuucagaacugggaaggaaacagcaggagaggcuggagauuuauucacucggggauuuuuaacuucagagugggccccugcgaggucaaugaucagcaaaacuccagcauuccagugaacaaaucucagugcucagagcagcagggauugaaagcaucuuggguuccagcuugcuuccuucagcugggguuuggagcuggaggcuuggauucaaauccugucucugccucuagguucccucaaguggaauaagaagaucaguggcagcaggcuccuaggguugucacagggaucaagugggagagcagaaugcaaaaacccugccuaaugccugccacaugcacucacucccccaugaacuccugaguggcaggcuugggacuggauaguggacgcccuggugccugguaaauguuugcagaaucugaagacacguaguacauuuuauuccagcucaaauaggcuaacuaagaugccaggaaguucagagaagagaauagucaacaagaugacacauagugaauaucuaguuuuuuucuuucuuucuuuuaaaguguuaacuucucaagauucugccugucaucuguacaaugcagauacugaaauuucccaaaauuuaacaaaauaggaccgagguuaucugguuuucuacuuucuccaugcucuuuauuuucuuacauuauuaccuuuuuaaauuuuguuuauuuauuuauuuauuuauuuuugagacggaguuugcucugucucccaagcuauagugcagugacacaaucucagcucacugcaaccuccgccucccggguucaagcgauucuccugccucagccuccugaauggcugggauuauaggugucaccaccacacccagcuaauuuuuuguauuuuuaguagagauggaguuucaccauguugaccagccuggucucaaacuccugaccucaagugaugcuccugccucggcuucccaaagugcuggaauuacaggcgugagccaccacaccaggcucauuauuuccuuuuuaacuuaaguaauacaacuucacuaaagaaagguugggaaaaaaagaagucaacaaacaaacaaaaaccuauaaaauaauuguguaaaugaccuaaacucccacuguccaguuauaacuaugcuuuauauuuauauuaccuucaagacuuuucccuaugcuacuauaaacuuguggauacguccccugcuaauagaaucauccaaaaugugcuuggugaucugguuuauuucaaucccaauauaucaguucauauagcucugccucaucccuuugaauggcuauguuguuuucaauugcauagauacagaaauguuaguuggaugcuuuuauaaacaacucuaugauaaacauccuuguguguuuauaucuguacaugcacauauguacaaauaaauauguauuauauauauaagcauacacacauacacacaucuuuuuuuuuuuuuuuuuuuuuuuuuuuuuuuuuuuuuuuugagauggaaacucgcucugucgcccaggcuggagugcaguggcaugaucucggcucacugcaaccucugccuugcggguucaagugauucucugccucagcuucccgaguagcugggauuacaggcgcccgccaccacacccagcuaauuuuuguauuuuuaguaaagacgggguuucaccauguuggccagacuggucuugagcuccugaccuggugauccaccugccucagccucacaaagugcugggauuacaggcgugagccaccgugccuggcuaacacauacacacaucuuagcauacuuaccugauuauuuccucuggaucuagaaguucucuccucuuucuaaaccugccauuuuaguaguaacugaauccaagucagcagaucuuccgccagccaucagcuggccacccugcagaccucuacaugcagcauucaguauaacuaaggaagcccuagacacaguuucucaguucccacgagcucacccaucccucccccaaguccucccacccacugccccugucccuaccccuagaggccagcuguuuaccaaacccgaaagaaauccuaucugccugaguccugucccuuuucugcgcucauuggacccagccugcgauuucaaaguuccagggucugaguagauaucccaagacaggcggggccaggaagagccuaaucguuuaugucauaaagucacugcucaaagccgccuccccaaacaaggucccuuucugccuucugugugcuccuuuucuuauaaaaguacucugguugucaugggcaaucaguauucugcaagaguagggagcaucucuuuuggucagagagugaaugcaaacugccaugucuuuacucaguaucaaagacaucugccucaaacacugguucagaagcgaaagaacaacaucgaaagcagaggaaauggauccaaauguuuccuaugaagggagucaucauaacaacccauucaacgaauacaaguaacuuccuuuuauuuguauacagagaauuuauaucauacaugcaugccucuaaccagccugaguucaaugacauauauauauuauuuaauuaugcaaaaaauauauacauauauacacuccauuuuaaaagggcaauuccucccaccccugauucuucagugagcuccagacagggaucugcuguugucucugguggugccagucccuauaugacuacgggguuuaaagacagauccugagauugucucacucccuaaaagcaucucagcugcucaaccugaggguacuugacaacaaaaaaaaaauaguaaucugucacaacacugauggaacugcuggcucagguggaguuauggagagauggcacuguauuuuuuuuuuuuuuugagauggagucuugcucugucgcccaggcuggagugcaguggcgaggugucgucucacugcaaccuccaccucccaaguuuaagugauuauccugccucagccucccaaguagcugggacuucagaugugcgccaccacaccugguuaauuuuuuguauuuuuaguagagaugggguuucaccguguuagccaggauggucucgaucuccugaccucaugauccgccacccuuggccucccaaaaugcugggauuacaggcgugagucaccgcgccuggccugcacuguauuuuacaggaauguaaggguuuuuugacuuucuaugugcugacuucauaagaugucacuccaugacccuuagacauauaggugucaaaagaccuucaccuauaaucaccuguggcagggcacuguggggauguaccaucuuauaggaguggacauggggcucuggaggcagagugacuugccugagaccacauggauggcuggggaguucauucugacugcaccccacgucuuuucacuccaagucuggagcugccuccccugcuccuacacggccuauuauuagcaccaugggagcccaccaagcuucuuccugccucagccaguuaccaugcugucuguccagagaccugcacucacggcccccuaaguugcucuuggcaaugcuucuccuucccuccaauugcuauuccugcugguggcugcucacccaaucccagaccaccacccuccaggccuggucggcucugugcuaauccacuggacccuggcugcuuuggggcugggacacagacggcccacugcauccugguuucugagaggagacucccuuuggccagccccagguucaaaucuagcucaucuauuuaagagaggcagaggacauccaccccacucacagcucccaacagaaacaucccuugcggcauucucuguggcaggucccaucuccugcagggaccuuggagagagaggauuuccagcgucagguccguaagagcaaucagguaacugaccacgggacuuacaagucccaccaggagccagaagguggcgccuaggaaagggaugggcugugcuggcuuccuacaugaugcucuagacccaaaagcaagggucacuugaguccuugcuuucccaccauuguucuuuuaucugauuaucaaaugaugugucaauguagugaaauuuuauuuuccagaaaacacuggaucaaauuaaaaucauccaaaaucccacagcgcagaguaacuaguguugauauuuaguauacagacauucagacucuucucuaagcaucuggaugcacauucaucucucucucucuguuuuuuuuuuguuguuguuguuguuguuguuuuuaacaaauuggcuucuguuacucaaaagugcaccauagggcuauucuggcaucaauagagaacuaccucaacaucuuuuaugacucuuucauucaccuuucuuuggaccauccauuauauuaauaaauccauuucuaucaacucuggcuaugagggccacacccaccuccuuugacuucugauuuuaauagcacagcacugaugacaccuuagcgguuagcagaagaggaagugcagaucuucacuguaugaacgcaccauaaucuaagcagucuauuugcaauagacauuuagauuaauuuggggauaaacaauguagcaauggacuccauugccuaguuauuucuuaggacuaaauuucuagaaguaagauugcuaguuaaaguguaugcacauguuugaggcuuucgaugcacaggaacauacuucccuccccagacgucacaccaguugccuuuccucuuaguggccugugaaggugagagaccagacuccaugaggauaggaagugcaagucccagauuccccacacugcucugccaaguccagggacaucaucuggaaauccccagaggcaucagcacauggagcacaucccacgcagggcaugcaggggaaaugugaucauacccugugaacauacccagagacagcgaggaagacuuugggcacaggagccagccucggagauggggaguuggggaaaggacagacagacagagcuccaacuucuuuuuuuuuuuuuuuuuuugagauggaguuuugcucuuguugcccaggcuggagugcaauggugcgaucucggcucauugcaaccucugccucccagguucaagcaauucuccugccucagccucccgaguagcugggauuacaggcaugcgccaccacgcccggcuaauuuuguauuuuuaguagagaugggguuucuccauguuggucaggcuggucucgaacucccgaccucaggugauccgccugccucggccucccaaagugcugagauuacaggcgugagccacugcgcucggccucaacuucuuacagaauaaucagaagcagggaguggaaggcagugagugacgggggaaccaugaggcccucuuugucuugcaggaaguaucccuccacugagugggacauauggugacaagaggagcuacgugggacagugacaaauaccugguucaggaauccacccccuggaagcugcuuucccccacuccccaccugcugugagauauugggaaagggcuucgcuucucugggccuccgcucuuccauccgauuugccuugccccucagcugagaucaucuuaauucugugauuucagaaccagccugaagaccagggcagacaggucuccacuccaucccugucuguuaaccaggucauucaccuuucuauggaccauccauuauauuaauaaauccauuucuaucaacucuggcuaugagggccacacccaccuucuuugacuucugauuuuaauagcacagcacugaugacaccuuagcgguuagcagaagagcaagugcagaucuucaauggaacguaaagaaugugcuuuucaaauucagcuucagcucagccuuuacugaaagucccugucacugcuggcaucucucacccaccugcauuauaaauggggucuuucccauuuugcaauugggaaaaccaaggcucagaguuuacauuuuagucaacuaacuccagugguaaaaggcagagacgggauuccaucucugcuuuuuuugacucuaaguucaucucuuuugacauccuccacugucucuccaaacccuucagaagagccugggagauugcaccgguggguauucuuuaugcucaaaaauauaaauucucuagugcagggaugagaucauauugaaagagcaugaagccaccuggguuucucggauuggucaugcuuggcucagagaccuugaagccaauuaacaugucucucccuacccuuuaucauccauaaaauaagcagugagagaauuaauuagcaauaucuggcaaacucugcucuuuaucauucauacaucacuucuaaucuaauaaguaagcaguuaaccuccuuuucuccuuccaagaacccacaucuguugacuuggcuuucaaauagguaugaguaagcuucugugauccuucacccuaaaacauaucccaagccccaaaccuccccuuggucccaggugcuccuuggugccuggggguaaucagguccuggugaugccacgacuuguuuucuccgggccccugcccaacccuaagcaagcauguugcagaagcaagaugugccaacuaagcaugggucaggacaaaucucagccugacccuaaagacuaccuccauccucaaaguaaaugggguuaagggggaagaagucaaccagccaggugccggggaguuacggcuuucaggugcagguuuuccaggccccuaggugaugcuaggugcugcaguggaauggguggaugagcagaggaggaugacacacacacggaguagaacacaccacacacacacacacacacacacacgcaguggaauggguggaugagcagaggaugacacacacacggaguagaacacacaccacacacaccacacacacacacacacacgcgcacgcacacacacacacacacacaggggagaaaggaggaaugcuaaggaaaugcccugugaucaugcccugagggagugaggaagggcuugggcacaggagccagccucagagacggccugaauaggaugagagggcugacucugcugagccaggaacgacaccuacacuccaccuucauaggaaucagaaaagcacccacucucaguguuagaagcuugcaccaccccccacaccaaaaaauccccucaaggcccugauucccuugggcucuaaaacaaacaaaaaagcuaauggguuucccaggaagccaugugguaggauggauaucacagaaaacuaugguugcgagaacuucccuugggcccaugcgcagaacaggaagucaggcagugagugggcucccaggaaguuaauauacacuauggacagguagcaaguuauggacagauagcaagauagccaguuaauauacucuauggaugacccagcaaguuugcuguuucagaauccuccucuucuguuuuuugaacuuucgaaaacaaaagauaugcugggagacgcggccccuagagugugcuuacuccagguccuugauuguccagacuguggagggggaagggcagaucuaugccaagaggggaacaggcuguagaggccacagcugauucauuuuugugaccuuagcacucugcccagcaccuggaauauaguaggugcuccauaaaccuguguucaaggagagaaucuguccauagcauauguauuaaugggaccuuuauagucaauggacauccuuagaaaucacauacccaucguuggcuggugguugagaaaaaaagguaaaaaaugagauacacccuucuacauguuuggccuccaauauggggccgggcugggccucgagaaggagaccgcaggaccucaccagcaaggcaucguguccucuuuguguccugagaugccuucucacuaagccucuuuccagaccuuugguccuggggaucugcagugagcagagaggcagcuccuugcgggugaaacccagcaccggccugcaaggccaagccuccccaugccaacacagcuuauuuccucuuucacuaccucacucccuaguggaaaaaacaagaaaacaaaauuccccugagcaaucugaaacccugugacccccuggccaaguggcagauccagcuccaccuugauccccuccacuuuccucuggcucaccuauacuuaagcgcagaggccagccucgagguuauuuauaacugugucagaggaggaggaggcaggaaauaggaaauuaugcaggagggggcgaggaguagcugcaggggccaagugaccccgcuggcuggcuugaaauccacuaccugccuggcccguggcuucagagccccaugacagggaauucuuacccagacuggauuccuccuggucucugagcccuaccugcgaaucucuugccagucacuuccccuucuccagauccagguggaagcaguuuuauccugagacuuucccccuaggccggccacagugacaucagcuuuucugacugcaguuaauggugcaagagcuggaggccaagcaggaggcccagcgccggaggggagacaaacacccagcccugggagcaaaugggguggcggcaaacacacggccuuuuaaguccaccagcccuauccuucuguuuccuuuccuccuuuaaauacucugaaagcgagagucugaauagugacuacuugagaacccaagacuucuccuuaacuucauccagaggacucaaagggaaggccacucaaccagaaucacacagcagaaggagcagagccaggccuggggucccauuuucuggaggcacuggccccuuuuucuacacuaccaugcugcccccagccccugggcuaacuaagacucccccauucuaaaugugagugccccugauggaccgcauaggcuggaugugcccguccuugcuuugcccagcagagccauguccauaaagauggcaucccacgucaaauccuguagacuacugcaaaauauccaucagccaauuucuucaccaaaacgcucugagcagccacugaacuggcagugccauuaauuuucagacaauuucagacuaaguuagguuaccuuuuuggggggauuuuguugcuguuuaguuucaacaccauuauugacucagugauacucuagggcaaguguucuaaugauccaagauagcuuuuaggagaauuucugaagcucuugaaauuuguaugcauagcuuuaaucagaaucccaaaggugcuccuaucgguaaaaugauuagguaggacggugauguaagagaaguauagaacagagaggggagagaucuggcccagacgaccaggggaccagggugggguugcaccgguauguccccuacuguucauuaccugcucgcagggugccugccccauggaccuucaaucagaaacaucucaccuucacacucaccacaauguccuucaaucauguccuuaacgguauaaacaagauccuaggauuuaaaaaucugaugugugcccagaacugagccaagcaagauuauaaaacaagucaugaccacaggaaggaacuuuaaaucuggcaaaugugugaccuugaaggucagccuucccuuccuccuuuuucuucuggucccuacaaagcacccacuggcaccacuacagccauuucuguuuggcaacccuaggagagcagcuucccuguguaaugcagaugauacuuccuaauuucuucuucccuacucagcaaucacaauggcaggcaagugggcaaaagggguuuucagaauccucaucugggcagugucucaccaacugcauuuguaggugcuucuugggaaaauuaguuccuuggcuagauauguucagagaacacuggauuaaacagagcuaaacaggucaccaugcagcaggacuucucagagcuuuuacuaugcuaauagccacaugucucuccaagaggggaauacaauaaacagcucucccaaauaacauuuuuuuuuuuuugagauagagucuugcucugucacccuggcuggagugcagugguacaaucauggcucacugcagccucaaccucguggacucaagcgauucucccaccuaagccucaagaguaacugggacuacaggcccaaccaccuuuucuuuuuuuuuuuuuuaaauuaguagagacagggaaucuuacuaugugacccagacuggucuucaauuccugggcucaagcgauccucucgccucagccucccaaggugggguuauaugcgugagccgcugugcccggcuccaaagaacauuucuuaagauugguggugcaaggaucacaccuugagaaacacugauuuaggccuucccacaguacaaagaaauguugccugccccauccuuacagcacaccugaugacuuacaagaggugcugcugaauuccucccagggaagcgaccuuaauucuucucagcaagacaaggaggcagccuucaggaaggacccaggagcuugguauuagaggaugauccaagucugauggcaaauuuagagugcuccagggaacacugaagucuugaugauagggcaaaagggagugauuccaucuuucuaaccuggcaggauagcagguaacaagacagaaauaaggaaaaagcaagcugaacuugucuuucccugacauuugaacugccugcuguucuccucaccaaaaauaaaaaagcuggucucaagacaacaaaaguagagaaguaaagguaacagaggucuccagccugcaggaagacucauauaaccucaguccaaaguucuuuuuauacaaagcacagauuuuuacuggcuaagugcucacccaaugacccauuuucaguauuuguuuauuccuguauuucacccauguuuaucgagcaccuacugaguguguggcccguagucaggaaugcccaucaauuaccaggcagcaaggcuauucuuaguuuucugaugucuauuuaaagaguguuaauccucuggccuccccccuacccccgccccugcaauuagacacauaccacuuuccaaccugguacacugaccucgcccaacugggaaggcggaauggacaaguguucuucccacccugcuuaacuuggccaagaaucuggcuucauggguuagggcagccugggaaccagccaagccagaggagacgagccugcuuugccugggcccuucaaucagugcuggggucaaaaaccucccuguucuguuccuuacuaguggcacaguaaggcagaaaguguugagacucaagagcagaaaaauccaggcugucuaguggggcggugaagaccacagaccacagaacagacacaccugcucaaauacuagcucugccaucaugcaguggggugaccgugggcagaauuggugagauugcucggacucuggagucaggagguccggcucaaaucuggcuucacuauguagguacauacuagguaaguuaccuagucucucucagcuucaguauuuucaucugcaaaguggaaugaggaggacaaggaugauaacacuaauaauuucugacauguauguuuauaguaaagaauagaauuuauuacauguauauauguauauaaagaucuuaaaauagcugucaacaaauaguagcugcuuucauauuuaauuccucuuaagucccaauuuuuuucaucugcaaaguagaaauaggagugccuaccucaaugagugguuaugagaguuuaaaggagauaaugcuuuaaaaggucuuggcauauaaaaacaaaucaauaaauguuaaaauauuaucaaaugguuauuauuuuuguuccaguuccaucucuaucucuuaaaccaagcugcuguaccucuuuggaccucaguuuccccaucugucaagugagagaccuggaucagauggcuucuccagugucaccgcacauggguucccugcacugggacccacaaggccuagaaguuacuugcagcaaagcugucaguagccucugagccuuggucagcccaaaaguaccucgaacagccccauaucccugugcacaguucaugaaacuagaaauggggaggggaagaugccuugccuuugcaaauguuaucuugaccugugcuguaguauuaacauggcggccacuaaccacagguagcugaaacgcaacuaguccaaacugagauaugcuaugaguguaaaauacauaauggaugucaaaaacuuaauuuuaaaaauauuaagaucuuauuaauaaguguaaaauugauuacauauugaaauggucauauuuuauacauauuggguuuaguauuaaaauuaauuucacuuuuuccucguuuuuuuaaacaugacuaugggaaaauucaaaauugcauacauggcucacguguagccacaauccuguuucuccugagcaauaucaaucuaguuuuuuucccuuucugucuccccgcuugugagccacccaguaagaaacucuucucagagggauaccagaaggaauucgaacuauuuguaauuaacuuuuugaaacaaaauaaaauccagauguuaacuauccagguggagcauucuauuuuagcagccuccaggaaucuccucuggcuuaaaggagcccugaauaaauaaaaucuauccagcugccaaagcaccccaugauguuaccauauuuaucagcaccugaaguucuaaaucuccacucuggucaagccaucucuugucuuucuccguuagaaaaagaugggcagugguuucuguuuuauuuuccaagguacuugccacuguuuaauacgguagcuuagcaguuaggaauggccuuuucucauuaagcucagcucccaauguuucaaaccaaucucuuucuuucuuucuuucuuucucucuuucuuucucuuucuuucuuucuuucuuucugucucucucucucucuccuuccuuccuucccucucucccucucucccucccucccucuuucuuucuuuccuucuuucuuucuuuuuuuuucuuucuuuccuuucuuuguuuucuuucuuucuuucuuucuuucuuuucuuucuuucucuuucucucucucucucucucucucucucacacacacacacacacacacacacacacacacacgaguauugccuggaaaggcuggaaugcugucuuucucaaauguucuuauucauucaugauacuuuuauugaaugccuacuaacaucaggcaaugagcuggugagcaagacuuggcucccaucuaaggggaggcaguaauaccauguaguaauaauaugauggcugacauuuaucagguccuuacuacaugccaggcaaugagccaggccuuuuauuuccauugugucugugaauucuuccacaaccuaugagguuaagaguacuauuauugcauacuccauuuuacagauaggaaaaaugagaccagggaauuaacuuguccagggacaggcaacuagccaugaacgaggccaagguuugagccaaguggucuaacuccagaaccugugcuccagcucagaaagugugggaaaugcaggacacauuuugccaaaaaaaaaaaaauuggguguuacucacucagagauccgagaauugaaaggagauucuagaaauaaaauggauuccagaucacaaaacuggugacccacaaggcugaaucuggcccauggacauguuuuguuugguccacguguguguguguguguguguguguguguguguguguguguguguguguguaucuuuucagaagauguuacauuaaaaauuuggauuucuugcuuguccuaagagacuggaaaucuggcaucacuagacucacauccugauaggcuggagcuggacagcagcuguccccuccagaagggaccuggacuguacgguucaccacaguuacugccacucucuauugucuccccaacuccaaagccaaagcucagaugcuguuuaucaucacacuugcccacuguuuuauugcuugucuuauaauaaagaaaucauuuuuaguaccuguuuagcucuccaaaauggaaaccaagagaauggggaaccauaaacauauuugguaggagugaguaauauuccaauaugucugauacucaaauauccagcuucugugccuggucccuguaggcacuggguuugugacauggcauggaugacaagugaggaaauccaggccaaaagagaaucagccaaagaaggaacuggaacccacacccaccuucccaccuuaaguauaagcuuuuuauccacugcacucauuuguucagaacugcacccuggagaccaaccuggauucugagauucuuggaucucucaguccuugcaguggugaaguuugaccuuccaaacuuccucaggaucuuuggagcuuucuauccugucacugggguuucucccugucaggggagcagauagugacugcccaauggggcacacguuugaucuaagucuuccaaauacccuccucauucacuuaaacaaagguuccaucagaucacacauguguucaucugagccagacuuccaugagagaaguccucucagcaacagaaaauguuugagccgagccaugaaccacauuuuccagagugaggcacugcucagguaggcuguggauaaggaaagccuuauuuugaugaguauugagucuuaaucccauuucuugucuaucagcuucuucagugguguuaaugagguucaauuuuuaccaagcccucccacaaucagugacaggcccugaagugaccuugagucuuaauucuagccaucgacuaagucugcaagguugcugucuguuuggcaaaucagcccugcuccaacagaaguuugguggucaaauaugucaucugauaaaguaucucagcucacuagagguuuuguucagagcccgcauccacuuuugcaaccacagaaauccuggcucuuaccuuaauagaccauauuucuaacaaaguuaccuacugaagggugugguugacagauuuaggugcugaguuauucagcuaaaguagagagcccuuuccaagggaacuuagagccagaaaaacuugaccauaguaggcauucagugaaauacacaccacauagagccaauauccugcuguuuuacagauaagagaccaaacccagggaggucaguaucaccaaggggacuccagagucagaugaugaacuaggacuagaccuuaggccuccuaacuccagccagugcuccuccuccaugccacacugcaccuccuagcccuggcaguggauaggggagcgguugcugacucuucagccaaguucauugucaccauuccauuucuagggcccucucuuuggcuacccuagugacuucuaccucugcuuaucaaugggagcugucuaaagagggaagggcagcaccagauccuugacaaguguugggcuugcccucagaagacauggguuccaaucccauuccauguauuggcuauauggcuaagccacagaaccccgccauucucaauacugacauccacuaacuaggaacuaugaccgaccccccaaucaccauccugcuuuccucguugcgaaguugucaucaaaugagaucaaauggacuuaagacucuaaaaugugaagaguugugaaaauagaguaggaacuuuguuguuucuuucucugcccugugggaagcacugugacaaaauggaacacauuagauuuggaggcggggggaucaaaccacgauuuugaauugaaacucagcucucucuauaugacccuggaaaacaucacaucacaccacagagcgccauuuuccucaccgaaagugaagugagaauaucagcucugcucuauaacaacacuacuacuaaaagcucaugcuuauucuuauugagcuauucugugccaagaaucagucucuuguauagacuaagggcuacaacuuuuuagacuugggaagauucuacccauuuugcgaccucuccaccugagucuuuggcuccccacuuuuggggccccccucagucugcuuaucuuugauuuucuuccucuccagacaugccuucccugcugcccccaaauuuuauuaccguauagucaguucugggauccuaacauaaccaagccuuaccuccuaacccagugcccuuucaacugucucagugguucccagccuuuucaacacuaaggaauauuuagugcuaaacauuccaugaaguauuucacuuaauugccaaugaaguuaccacgugguacauaauauauuuccccccauuuuagagaugaggaaacugaggcaaagaaccugcccaagcuugggaguagcagagcucacuagagcuaucauguuuccaaaucgaaaaggcagggagcuuauucaugaugauaaagucuaagucaaaagggagcccuuccuaaauacaugagaugcaaacaccuuagucaaacaccucaagucacgaaaccaagucuucaugaaaucugacccugguugcgaaacucaccauccccacauccuaauccaggcauugcaggagcucugaaguuucugaaugaaacagcucuucucugcaggcagccaggcggcccugugccugacacccucaugggcagaggcagaggggauaauuaccauguaguauuuaagaucucuaguuccggaauggcucuuggaggcuuggucagcucaggacuuccccucuccacuccccaguacccaccccccgcccaaucaucuagggcucuguuuuuccacuaacugaacuuuaccuugggcucucugaggccagaucguacagcuuuccuucccuuccccacccccacaaaaagccagguggcugcaggcuuggaaacacuuauaguuucuugucuccaagccgugaaugccaccauuaggugaucggauuuacaugaacauaaaucagacuugaguguuggguaguguggacugucccuucugugacagcaaagccauccuagccacacagauggccucuaaaugggucaggaaagguucucuggggccccucugaagcuacaaacacuaauuuuuuaacagcugaacaaaaagaccucuuaguuccacugcagcccacauagacaccugugggccuccugucaaacaguauuuaguaagucccuuuagcuagaaucaauacuuuguguaccccuggaugccagacaugaacauaggaaaauaucugaacccaugucaccuccucugaaaggauagggaccucaacuaggacacaucaguuaccugcugucuaucccaggcaugguggcagcacuguggguaacagggagaagugacaauggcaguaaaugcaugggaccugcccacagggagaagagaugcuaagcuggcaugaaacuaaagauucucaggaggggcaaaggacagcgauauaccaaagaagccaggagcuauuuuaggcauaucaguaagccaacccaaauccgacaaugcaaucacccaggaacccaugagaaaacuucccaggcuuaugaaaacaccaaccguccuugcuuucggcuauaauuaauuaguauauuagcugauugugucagaauaaugacuggcuaguaucagcaguucuaguuauauuuuaauuuguuuuuuaauggaaaguuaaucaacacucaacacaugaaauugugucggauaacuguuccaaacacagaacuuauuggagggaaaaauuaauuuuaaaaaauuccauaguguugaaaagucugggaaccacugagagaguugaaagggcacuggguuaggagguaaggcuugguuauguuaggaucccagaacugacuauacaguaauaaaauuugggggcagcagggaaggcaugucuggagaggaagaaaaccaaagauaagcagacugacggggaccccaacaguggggagccaaagacucauguggagaggucgcaaaauggguagaaucuucccaagucuaaaaaguuguagcccuuggucuauaugagagacugauuggaaacacagguuuuggagauaggcuaagcaaguauagguugcaaguggugugagcuugggcaagccauuuggcuucccuagccugagacagcucaucaggcagcugggaugacugauaggcaaguaaggagcuugguacagugccuggcacauaguaagggcaccaaacuuacuaugaaaauuacaguauuauguuugugaucuccugcaggguuggcauuuagaaaucuccacuuucuucucugggagggugcuaggguaucauguccaccagaagacaggacuagacuuaucaaguaaugcagagagcauagugggugcuuacccucuaaaguggguuagguuuaucccucuggguggcacgcagcccuaaguucuuucucccagcgcaggaaugauccccucugggaguuucccaugcagcuuuggagaauuuggguuuuacuagagaugguguuuuucagcaugcuuaaaauaugggcaagguuuaugacuguucgucuguaccaaugccaaggagugaucagggaaaggaaccaaaggagaccuagagaaugagaaguuaaugaggacuguucaaaaccgagggggugucaugggccaagagccagagagacagaguaugaacagcuggagcaggacagaccagugaugagacuaugaggaugagguaggcaggguccacacuggcccuuguaaaagccauuugaugauacuuuauccuaagaguccacugaagagcuuucaucagaacaggaauucuuuccuaaaccaggccuucuagcucccauaauaaugagaccccagcguccuucuuggcugggguccacccagccucccucucggcaguccauccuccuccuugugaccaucccacugcucucacccaagugccauccauaggcaacaagaagggagacagaugagugagugcccuugcugccaccaugagccuggccagcggacagcuuugagucagaaagcaaaacccuguguauguguguucaaaacacagccacauauaccuuugaaccugaguccauguaaguccucaaagucaaacaacuugguguaauaaaugguccacugcuuauucugaaagcaaaauaaauacauaaagcuaucuucaaccgaauuacuccagcaugcaacaagucaagggucacagcuuuccuggcauugcagccuuccucucccuaugaaaauacucccauuaacuugaucuucguggcccuaauuuugcucccuuucaaagagacaaaaagaaggaaaaaaaacacucaguaagucaauaaaaauuauaaauuguuuuucuauuugagagaagcaugggagucucuuaagcacagggcucuaacauuccuccauccccucauguugcauauaugaaaagaacuguguuaacacagccacuguggaggccaaauuggcaggaacuauuaaaauugaaaaugcauauuauauaauuauaauaauauaagaguauguaguaguauauauaauaugauaugguauaaugugaccuauaguauaguuguuaaauauauuuuagagccagggugaaggggcuuaaauacaggcuguauuccuugcuagcaguauaaccuuaaacgaguuaccucauuuuucuaagccucaguuuccucagcuguaaaauggagaugacaauagcacaccucccucauaaaacugagagaauuaaaugaguuaauguaaguuaaugacuuagaauaaugccuggcacauaguaaucacucuauacuuauuagcuguuuaaaauuauaaccucaugaaauacauaaaagaaauauauauauuauauauauaauauauauguaaauauaauauauauauauuauauauaauauauauuauauauaauauauauuauauauuauauauuuauauauuauauauaaauuauauauuuauauauuauauauuuauauauauauauccuccaaaccaucaauccacaguaauaaaaggacuugguuugucucacuguggccagggagaaguaaaguuaauagagacaagacauuucaagguuccaagacucuucccuuaaagguggggaugaguuagggguccccagggggagcuacccagucugccaauguggugggaggaaagccaggggggcagucaggagacugggucccagcuggagaaggugcuccucugacaguuuuauauauauauuaaguagaaagaucucuaguacgcauuguugaaugggaaacaagcagaauacuauaugugguauuaugugguauuccaugauguuuaauguucuacuauucauguuucuaagggaaaaacuacuauaaauuugcuauggauaccuauguauguaaauguauaggaagaaaaggauuuggagaagggacuagaguuagaaaaaguaaucagaaaggauuuuacucuucuccgauuuuagauagagagauagauagauagaugauaaaugauaaauagaaauggauauaucauagauauacagagagauacauacauggacauagaauguauucauauacuuguagcuuuuaaaauauagauaaaacaggccaagaugguacaaauuguuauuccccuuguauaaauaagaaaacuaaagcucaaagguagcccauaugugccuaggcacacacagccaacaagccccagaggaaggaguggagcucagaucugcccuccccauugccuuuccaccacuccacccugccucucaaggccacccaggaguagacuaugacaaaagguagaagaaggggccuccuuguccauacuggcuggaaugguaaaagccaagugcgauggagaaucguguuguuguuuuuguuuuuaauuaaugaaccuguuggaaugugccauucagcaguggagcugaaugguuccugcuguucaugcaaaacaaacaaaaaucccuccacccaagcuacuucuguggccacuuuucuagccuuaucuauccagggacugugaaagggacacagaacugucagaggggcaccuucuccagcugggacccagucuccugacucccccuggcuuuccuccuaccacacuggcagaccggguaccucccacuggggagcccuaacugaucccaccuuuaagggaagagucuugaagcccugaaaugucuugucucuauuaaccuuacuucuccuugggccacagugagacaaaccaaguccuuuuauuacuguggcuugaugguuucaagggucuuuuccagaucuaauagccaaagaacauuagaauuuuccucuaugauacacuagaauaauaauaagcucucccucccuaaagaugauguuuaauuaaaaccucuggccauuuuggcuaucuucauauuuuuaaagaaaacccagauguagaagaaaagcauucuucaaauguuaaccauccauuccaucuccuggucaccuuagaaugucaugugucaaugaaaguugaaagguuuuugaagcaugguauaacugauaauacguuuuagcuuuaucauuuagcaacuggguggccuuggacaagcacagucucuucagccucaguguuuuccaucugaaaaaugggugcaauaccuacucuuaagguugcuguggggggucgggggagggggugaaagagauggcauuugggaagugcgugcaaccaggaggggccuaagacaugucucuucccuccuccagcuggauagcagcucuccuccuuccaugguuccaagacauccacagccugggucccccagacuugcccuaccaagugcuggcgccucuccaaagucugauucuuucuauuuuccuuaaguugcaaagcccaguguugagguguaauuguguguaagagggagaggggauggaucugguuucuuugaaaauggcuucuuugcuaaaacgacaaccucagaucugauacugaaagaaucugcuggcacuggccccugucagaacaauuuggagcuauccaggggccauccucuggggcuggcagccggccccccagcugagccucaugcucaaauucccaacaggcucagaggcaggccccgaacacacuucauccuacagccccauuccucccaugcaaaggcggcaagagagaaggagagaagggcuuggcauucugaagcaaaauucucuuucucugcugcaaccccccucagcccugccagccaccuuugcagaagccacacacgcgcacacacacacacacgcacacacgcacauuuucagaaagcccuuggcacagcccaccccuuccugagcuggacagagcugccagggcagauuugcccgggccgaggccgccuucuucaucuccagcccccucccauuccucuucuagagucaagguuuugucaggaguuucaggggcaaugacuggccagggagggggaccacagacauccugccugcugccaagucccuuucuuucccccacagugugucuuauaagccggcauguaguuuauucuucuccuaaacacuuccauagggugcagggccuggaguugccauagaaacaccuuuuaacuccuccucccccagaaugccaugccaggcccuaggacuuuggggaaaaaagacaaaaagagacaccuguggaugagcagagacaggaggaaaggccaucgggcagccccccggagaggaccaggccaggccuccugugccuuuugcuaggccaacauggcaccaagccaugaagagaaaaccaccaugaugguuuuaaaacaggaaguugaugggcugaugugaacaccuuuagggggcuacaaaguugacuggugggguugugugggucccaaggaauggggagcuccuucauauuuguuugagggcgagaauagacaguuucaacccagacuggaaaccagaaaggcucugagcaaugaaacuugggagccaaguacuggacgccagcagggugcugugcaaggcgagggaggucggcaggcaagcagcucacacccacaccucccauuuuaaaagcauuagcucaucccugccacuagugcagcucaccaaacccaggcagaacaauuugggauccgugccagagcaucgaagauuuuuuguuucuuuuuuucuuuuugauuccacaaucuccuggucuuuggcuacuuccugguaacuuagauuuucucugagaaauuuaugaagaggagcgagggagcuauuucuuguuucaauccagagaaauuguaagaaacuuucugcauugcucagacccaccgcaggaaaccuaagcaguaagcagacgggaaggcccccauuggaagcaggaucuacucaugcuuguuuucacuuuuccguggucaauuuuuaggguagaaaccccaaagcaaagggcaagggggaagaauggggaccuacucccacuacauaccaaaaaaacgcaagugaagucacccagcccauuuuccagcagaaaaggacuugggcugcaccccugcacacccugauuccaccugccagccuccuggccgcacgugugugauccugcugggcaaaaccagaacucagcugcagcagcaacuccccacacuaaucaggugggaauguuaccaacugggaugaggagggaaaggguaaguggaauguggguggagguggaggagggaggaaaacccuccccagucuucaggcugcccaaaaggaucuuucuaagcaauccacaaauccugggccagcuggguucccccaggagaggggaggauguaccaugcaggccccagggagccucuuacaagggugaccucaggucacacaaacacccucagcugccaacugcacugacauucuggucaccacacccccacucugaccucuaggcucagcccagcccaccagcagugccccucccggcccucacugccuccccugccaagcuccuaccuccucccccuccucaccacaacacgcugguagagucccucacccaagacucaguggaaaauuuccuucuccuuuaugacuguacuuaaaacacacacgcuccauucuucaccucugaaucgacacaggcagagggcggcaaggcugucccaccccaccgcccagcccagcccagugcacacacacacacucucccagcagagccacuggacuugcacgcuuuaugggcuggaaaggaggagagagauguuucccagaugccacuccaccuuuagccauccaaacacaagugucccaaacacucccagacaagccucccaggaugcucucggggcccuccauacacacuaaggaguaggaggucucuuuacagggucucucuacucaagacacuaaguccagucuggaacugucaccgugaugugacccuuggcagguuuguucuuuuggugacaaaucuguuuuccacuacccauucucccccuccccacacacauucaagggggaaaaaaauagccuuccugugaauuuucacagcuauguggugagugaccccucgcaccuucugcuggcuaucaacacucucaaacacagugccuccagggcgugggucaaugccacagcuuucuccucauuuucccccuuaaauccacccaaacuuggcagucccagaagcucgguuagcgcuugccugggaagccugcagcuggguugggucucagugaaaagaaugaauuucauaggcgcaggagaugaugcagacucggaguacuccaaguuucuccugcaacuuuccgugcacauggcgggcaacuuuuuuuuuuuuuuuuaacuauucaauuucccagcacuuuaguuagcauuccaaguuuugggaacccuuuccccacccuucucuucuagcccuuccuccguuaguagugaauggggacauuuuccagaugucaaaaggaccgguaggaaccucacgaccuaaguuaggaaagcaaaggcggccaggggcucccucagccacugugaguuuccucugcagggcaucuuccccucucagcuaugccagcgcccccgcccaaggacaucgaguuucuccacuccgccccaaccccgucugccccucuccuggggcagaggaaaggaguggggcucgcccugccucccuaagcagcgcugcaguccuggcugcagcguggggcucgggcggggcaccaggagcgcuuaccgaugucggaguugcagaaggcguccuggggguggcugggcgagcaugugcacgccucggcgccccagucccccaggcuccagcugcccaggagcacgaugagcccgagccaaggggucauugccgcugcugccgccgcugccggggcugcugcucgccucuccaaaguugccgugcgcgccgccggcggggcugcugcagcccgagcucgcucgcccgccgggccgugcggggcaaccuuggccuccggcgcgcugcccuccgagugcccggcgggacgggauggggcgcagcgaggcugccucggcgcuggcgcaggacucggcgggcggccucccggcgaaggagcaggagcuggaggagcaagaggaggaggagaagccgucugagcgcccgccgccugccugcugcccgcucugcgccgcugccugggcggccgagugauauagcgcugggcccccggggaccccgccucgggcuguuggggcccgcccccucagaccaauggcagagccgcauuaccucaucggcccuccaaaaagggggcggggccgggggcaag

SEQ ID NO: 21266 - RNA, 1241431 nt, Homo sapiens
uuauuuuuuuuaaaaaaagucuucuuccuacggauuuccugaacauggccauuauauucuaauucucuugaggcuagaucacuuaucaaauuuucauuucuuuucagaaguaauuaggagugaugcuaccuugaauccaggugugaauuuuuauugauuuuugaggauuuggccacguguuccuuuauccaagccugucuucugcuccaucuuauccaaacaaacauugaaccagcaauauucccaaguauuccaacuugagaaaaaucuugugugucuugagaaaaaucauuuccaugacuuauuaaugaacuaacuagggauaauuuucauaggguucguuaacucagauuuaucauagaauacaauuuaauaagaaacaauuaaauggaguaauugaauucaaguccuuuuuugaguaaugauguuagcauucaaugacccccccugcccaugguuauugaaguuaucaauguaucaauuuuccccuugaagaaaaucagcugcaaaucucuucgucaaugcaugggccgccucucaucugcccccugcaggccuagcccuuccuuuucccgucccugcucuggucuauggggcugcuguguguauagaaaaaaaugaaaggacugaugaccauguagauaauguuuuuccaaacauaccaucgaggcugugcuacaaaagugauccaguuuggugguccuuucucuuuuagagaugccuguuuugacaauuccuccuuacagucugcuuuaauauuuaaaagaaggcagugggggcuuuagguuaaaauuaaaguuucagaggccuguguaucuuucucagacugguugaacuuggaacugugcaacuuuucucaacaauuuugccaauuaaaaaagucccuuuagcuguagaugcugagaaggcugggccuuugguucugcuccuaaaugggaguggggaaggugcucacagaacgaugccaagcaccacugcuguacaacuucuguuuuauuuuugugugcuuuuuuuauaggauauaaauaaugacaaaaauuacaaaauuuauaacuggaagcccaagcuuauuuacacauaugcuucuguuucagcaaagcuccuauuaacuuugcuccuauacaauugccuccugguaccauauuuuaguguuauuuaacucucauuuugcuacauacauaucaacagugaauaggcaaaauauauacaaggaacuguucaguucaaguaauuuaauauuguauuaaaauucuucaacacugaacuaaaaccguauacauuuguuaguuugaaauaaaauguaguuauucuucaaaacucaccaacugaugaauguaacugaucaucucaguuagguuuaaaauaaugucaguuaauaaaaaaacauuaagacaauuccacaauuuaucaauaucgcuauaaugaacuucaaaaugauucacaauaugauuguuagaacaauauacauuaaaauguuauuuuuuucuauaaugauauugguacuguuuauauaauuugauucuacauaaauauacauuaugguaucauacaaauacuccacagagacauuaaaaaauuaaaauaccuuaaagaaauguaaguaaauuuuauuuaaucaaauaguaagcaaacuuuuuuuuuguuugucucaagaaaaguuuuauuacuuuggaauuucuucuuuuuuuuuuuuguauuuauuuuuucuagaaaaagaaauuuuugcaauagaauuuuauuaacaccuuucucaaacaagguuuccaugacagaaaucuugacagcaggagcacuagauuuuuuuuuuuuuaacauguucuuuaaaacacugugaagauuaaaaaacaaucuuggcaggcugauggcugcgucagcacuuccgggccuccugcucuagggagcaucaccaguauuuugccaccacugagccaguccucuugguaguagcaguagaaauuuaauuauuugaaaugaaaccagaaacaucccucgcaacuaaccuaguuuucuuaucaaugcauuaaugaaacauucuuuuaauaaaaauauuuaauacaagacacauuuugcugugcauaauaaauuccucugcuuugaaucauucuuuccuuuugaaccaaucauuugguugaaagguuuucuuucucugacauaggugauuacauauaaaauccacaaauauagaaauggggaaacagaaucuccuggcaaucauaucacgggaguuguuuuuguccuuuugcauuaaacgauacucaaugauagaaugauuuuacagaugcuuuggaggugggagggguagugcugcucugauuucaccuuuaaaacugcugacagugaaagcauacuuuuaggcaguauuagagauccccuuuacuuuuuuuuuuuuuuuuuuuuuuuuaaagaaaagguauuauuuuccccaaaugaagcaaagcaaguacuggggcggagucaucagaaauaccuugggaggugguggggaggggagucgggagcaucagggaaaacccaucucaacucacgccucucagggguugcgacuggaaagucuugcguuuuccaucacuggugcagaaagaacuuccccaggaauggccaguggccuuucgcccguaacaaggccgcacgcucagagcagucuuccuccugggcuggguggacgcggaggcgcgaaggaaagccugcuccgggaccgcuuggcgagcaaggcaccgcgaggacaggaggacggcgaguaucagaaaaucgugguuucauacuugguauuaaugccccucuuggcuucuuggcccggcuccacaauccacgguagauuggccagagucuuuugcucagaugggucgaucugcuuuaaaacagaaaggcugaugccuguuauacggucgccgcgcgggugcgcgcaugcacgcggacgccgcuggcgaacccacgcgaggccccucgccccaggcgcggggcggcgaugcuggucuaggcggcucgcgggcucgcucuuuggacacacauuuaccgcauaccgacucucugcagggcacccugagggugacggugaauaaggcacagcccuugcccuugugagcacacagacggggagcagacagaggcggauuucagugcugagaggugagauacgaggggaagagagggcaccaugugggcacacacaccuugggagccaggggggcuuccuggaggaggugaaucaggcaugccacuccccggcucucacucuccagugguuuccaucacagucagucagaacaaaacccgaacuccucaccgugaccuccaguaccccugcccaccugauuuuucugcugcagccacacagcuuccuugcucuuccugcccgccaagcccacgcccagggccucugcgcucaucaucugcucugcccgaguucccuucuccagacaccugcaugccucaugcucuaaugccauucaggucucugcucaaaugccacuuccacuggcaccuguauuccuagaagccuuuccuguuuacuccuacaaaaagcaccccaacuuuucugcucuccucuucugccuuauuccugacaauacuuauugccgcuaugcgucaucacauauuuauuuguucauccuccacugccacguaugcucauggaggcaggauuuugucuguuuucaucacugccauuuucuccaaaacgcagaaaagcuccuggcaaccccguaaauaauaggcacacaauaaauacuuguugaauaaaugguaucaaaagaaugagguaauauuuaaauggacagccgaaggaccagcaaguauuugccugaagacaggaggagggggcauuugaaguagaugaaacagcacaugcagcagucccagaauaaucuauacaacagaaugaaacacagccucaucuuccacuauauacagaaaucaacucaaaauggauuaaagacuuagagggaagaccugagacgaugaaagaacuggaagaaaacauuggggaaacacuacaggacauuggucuggauaaagauuuuuuggguaaaaucucaaaagcacaggcaacgaaagcagaaagagacaaauggaauuacaucaagugaaaaagcuucugcacagcgaaggaaacaaucaacaaagcgaaaagacaaccuacagaaugggagaaaauauuugcaaaguauccaucugacaagggauuaacaaccagaauaaauaagggacucaaauaacucaauagcaaaaaacaaaaauaaaaaacaaaaacaaaaacaaaaccaacucaaucugauuaaguaacaggcaauagaacugaacaggcauuucuaaaaagacgacauacaaacggccaacagguauagguaaaaaugcucaacaucacuaaucaucagggacaugcaaaugacaaucacaaugugauacgaucucacccccgcuacuauugaauggcuaguaucaaaaagacaaaaacuaauggaugcugaugaggcuacagagaaagggaaacacuucuacacuguugguaggaaucuaaauuaggaaaggcacuauggagaauagcauggaggguccucaaaaaacuaaaaauugagcuaccauauguuccagcaaccccacuacugcguauauauacaaaagaaaagaaaucaguauaucaaagagauaucugcacucccauguuuauugcagaauuauucacagcagccaagacauggaaucaaacuaaguguccaucaauggacgaauggguaaagaaaaugugguauauauacacaacggaauacuauucagccauaaaaagaaugagauccugucauuugcagcaacaugaaugaacugaaggucauuauguugagugaaauaagccagacacagaaagacaaauauuguauguucucauauguggaggcuauaaaaaguggaucucauggagauugaguagaauggugguuaccagaggcuggaaagugaagaagggagaguagggaugaagagagauugguuaauagguacaaaaauaugguuaaauagaaggaguaaguucuaguauuugauagcacaguagggugacuguaguuaacaacaauuuauuguauauuucaaaauaacuagaagaauuguaauuucucaauacaaaagaaaaauauuugaggagauggauaucucaauuacugauaugaucauuacauauuguauacaugugucaaaauaucacauagcaauaaaaaacagucccagagguaagggaaaauggucguugagggguuggggucaguuugcaggguggggagcgggaaggcagacagcuaagggugaggaggugagcagggacccagucaggcuaagccuugagacaaauccuaaaaugguuucgucccugugcguacaaauacaacgggacacuccuggggcggggccgggcuguccgcucucaggaacggcccucagguggaucuacaccauggcugccucuuccuuugguguuuccaggucugccugcccuguccuagcugccugcucuucucagagccugagguugugggaaggccucucccauuucucuggcaccaugagcuuugcagcugccuucuaccgugccuugacuguaucuccauaaagcuguggggaggaccucacguguucuuagggaucacugaauauuucuuaccaagaaaugccuggggcugaaggaacuagaauacuaaugccugucgagggggacugaucuugaagcacauaaauaacaucaguauuauucacuguauauuuuccuauuucccuugaaggcaucuggaugaauauucuaugagcucuuaugccacccaacccuuugugcucuucuggaagaagccuguggggaccaggguaaggucagauagaggcaccugcugugaacagauuuauucagcccacaugagaaugaauacaauagucuaagagauaaucucuaaaacauucugcaaauuccuggacacuuagcagccuaaucaaucucaaagauaugcuugugaaauccauccacaggcccucauuuugucauccacagauauucacugaacaccugcuaugggccugguuccgguggugacaacacagguggggucccugugugcaugaaacuuacauuuuuuuuuuugagacggaguccugcucugucgcccaggcuggagugcaguggcucaaucucugcucgcugcaagcuccgccucccgggugcaagccauucuccugccucagccucccuaguagcugggacuacaggcacccaccaccacgcccagcuaacuuuuuuuuuuuuuuguauuuuuaguagagacgggguuucaccguguuagccaggagaaucucgaucuccugaccucgugaucugcccgcuucggacucccaaagugcugggauuacaggcgugagccaccgugcccggcccaaaacuuagauuuuuguggaggaagauagacaauaagccaucaguaaaaaacccucaauuaauaaaugcuacacagaauuaaaagcagaugacaugcuugaaggugacuggguaucuaugucagauugggugguuaggacauccgccucuucaaguagccgagaccugaaugacaagaugaagucagccaugcagaaaccgggggaggauauuccagguguggggagcagguggcauaaaggccucagguaggagugagcauuacauagucaaggaaugggaagagcugagcaucacagaggacuguggugggaaacugcauucuggguacuuggggcagagggugccaugacugaucucugcuguguggggaggggagucucaaggagcuauacugcauaggccuggggcgagguggcaguggccccgacuggaagagagauggaggaaguggggaagaguggacaggauugagauauauuuuagggguaggguggaugggauuugcucaugggcuggauacagagguaaggggaagacagggauccaggcugacuuguagacuuugggcuugaguugcauggugaguggcugugggguggggaaguuggugagagaagagcuuugaggggaaaaucaggaauuguguccuggacaugcuaaguuucagaugucugugaagcaucaagguggaaaugugaaagaagcuggccacgugagucuggaauuggggggugcccagggcuggagauacagaacugggagccaguguguuggguugggucagugcugaaugggaggaccaggggcucagagcguggcaucggaagaaagacuucagaggagauacagcuccuggggauggcugguaaugagugauggacacaggagcgaauggccggggcuggagggaaagaucccgaaaguaaacugucagggaacugugagaccagaugcuggaggggucaauccuguggauguugauggugccaagaagggugacagggguaggcccccaaaagaagacugaaaacaagaacugcauguucacaaagggaggugccucccugcaaauguuaaaaaugccugcugcuguuccccaugacaguggaggugggggcuggugagaaggaggagagacaguuccagauggaaggauucgggggcgugagagcaaugcauucugggggagucccaggguuucuaggaugcaauacggcagccggggcagaaaccagaugggaggcugguugggaaucuuccagcuuuugaauauugcuacuaccagaggaggccgcuuugaagucaugcaagccuguugggacaggaugucugcagagccugugggagggaaggggaagaaauuccuggaggaaggcagaugcugagaaggaggggcugcaccuucugaacaggcaccaugccgcaggaagccucagcugcgggagacaaagcacgcaggccauggcgcaggccuugcauauagcagggcagccugugcauccagcuuccucuagcuggggaccgaggacaucaucacuguguaccucugcaaaccucucuggaggccaggggcuuguaggaggcuuugcccucugaugggauggcagcugaagccccagggaacacugcucccaagcuuuccugaaucuuuagguaagauucaccaagaacagcaguaccugcugcugagacccuucauaggguugcugcaggugacugagaaaguggauuucucuggaggcuccagguugagggagauggugcccaagacuuggugggaaccaggcagaggugaugauggacacaugccaggaggaggccaagggaaaggaugaagaagaggcccuggguucuaauggcacccacaccacacaagggccugguuagcagccccuuuuccuccuguucaagguuuuuuagaacaucuguaucguuucuacuuaccacggacuugcgaaugcuaacgcggggcuuggggauggguuuggaggguuuguuuucaaagcuuucuggaaguguggaggagugucccccuuuucuugcuuguagugcuagcugguaagcgacuucgaaugccugucccaggguuaggaugauuucauaggcuaaauucugcaagaaaaaugagaaagcauuugcuacuggcacacugcaaauuagaaugggucgaauggcugaggaacacugagggaggugaacuagggaggaacuugaacuacuucaccagaggcagcagcgauucgguggaaaucuacaaagaacaggacacuccggguccaacuuaggguuuacaccaggcuuuagucauuugugaaaagaaaaaucuugggaccucaaaucacuaagacaaacgaaaaagucagcugggaacuguguugggcaaaccugccuugcauucuauuccuaaauaagauagcuacaaagauaaaaaagcuacauaccucccucacaauuugcccaaaaggaaauuuccuguggacaaaagacagagcucaaagucaugccucugcucaugugagauaaaugcauaucagauugcuuccccuguccuguuguuucccuaagccagacuaaggcauaagugacuauuccuguaaauuguguauucagugaaaggcugaucuucagaaacucaaaauaauucaacuguuugucucuuaucuaccuauggccuggaagcccccuucccauuucuaguuguccugccuuuccagaccaaaccaacguacuucuuacacauacugauugaugucucaugccucccuaaaauguauaaagccaagcugugcccugaccaccuugggcacauggucucaggaccucccaaggcugugucacgggugcauuuuuuuucuuuuuuuuuuuuagauggagucucacucuugucacccaggcuggagugcaguggcacaaucuuggcucacugcaaccuccaccucccggguucaagcgauucucuugccucagccucccgaguagcugggacuacaggcacgugccaccacgcccagcugauuuuuguauuuuuaguagagacgggguuucacuauguuggccaggcuggucucauauuccugaccucaugauccacccgccucagccucccaaagugcugggauugcaggagugagccaccacgccugguccacgggugcaucuuuaagcuuggcaaaauaaauugacugagacuugucucagauauuuuugguuuacacacugauagggcacucuugcuuacagauccccaguuagccccaggaggagcaggccccacagcccaguggccccaggagcccacaccauucaaagcucucccugugggcaguugguuuguccccaaggccuuggaagguaagggguuacuacugguauuucugcugaguccugggagcacuucaaccuugccugugaggaugaucccacacacuccacaggagguguuccugagaaguuugggucuuuuuaccucaaacaucugugauucagugaacaucuacgaaacacaaucaaaaucuaauuuaggccuagaggagaggcauuagucaugcugguguggcggcucacagucgcagcagugagcacgcaaacagugcuccaacagagccaauuccccagcuauuucuugaggcuuuugcucucccuguggguccacucuauauuuuaucaugaaaucagcaagagacaggugauucugucaggcuagaugccacgccaagcagcgccugggagaaaaguucuuuucuuccgaccuucaaucaguccuuuucucaagaugauuucuagcuuucuucucuucuccaaauguguaucuuugauuucugccuuuucuuccaagcacagcuuccccuugucuucucucacugagaaaccaucacauugucugacccaaaagaggcaggguggccaccacacccugaggucacagagcaucagagaagcagaugcauacuggucacagagaguguucugaaggucacuguagcagcugagagcaggcauggucugccccaagcuuucuuuuuucuuuuuuuuuugagacagaguuuugcucuuuuugcccaggcuggagugcaauggcacaaucucggcucacugccaccuccaccucuuggguucaaguaauucuccugccucagccucccaaguagcugagauuacaggcaugcaccaccaugcccagcuaauuuuguauuuuuaguagagaugggguuucuccauguuggucaggcugagcuugaacuccccacaucaggggauccacccaccucggccuccaaagugcugggauuauagguguaagccaccgugccugaccauccaaguuuucauucugaugaaugucccuagaauguccacucacgguuucucaaaaaucacagaaaugucauucugcugaugcugauauugcaacuaagcuggcccucucuguuccugcccaucuccacccucaucaagcgcucugggagcccgauucccacacugcugcuggggagauguguuugcgauuguucgcauuugaagaugauggagaggaagaugcaggauggugccuucugaggccaugggaaagaggcccaaggguucuagaccaaccagauuccagauccaugccagaucaauugugauggucucagaaccaaguggggaaaaugccucugagcuugagagucgguuugagagaggaugugucugucuccuuuaagugaguugcuaggaaauacugacccuacaagacagacaucugccugcuggagauacugcaccuugcacagcaagcugagcacuuccuugcaacgaacacugagcccauguuugccuccagagaugagucagccuaguaaauuaguaacgcaccagcaaaugauaguggaggaggucugggagacagcucugaccaucacugcacaaagagggcugagcucuuuccacugccuacacuuggcacucacgucacugucagcuuugccucuuaguguuugcguggguccccucugaaaggcaggcagggcuuccgacuucuguagucucacaaugaagacacaggcucuuggucuuguucaugcuacuguggaagauggcugauucccaucuguuggggacauguaccagauauuccuguucugggugggaaacuagacuaagaugaaggugugagauucagugauucuguaacauguggucuuuaucugcuguaacaguggaacuuaaugagugugaauuccuuuaccauuaaccuaaaaacaaguuacugaaagcgagaucuacuuaaagcuccaggaucuucaaaggaaaguaaaaagaccuucauuugagcaagugagguuuuucacaugauuaugggaagccuaaagguuuugggagagaauguguuagaaguccugcccuuucauuuuuaauuaguuccugguauuaggaaacugcucaaauaagacacacagaccagacuguuggauuaaguuuuccugccuaauggcuucuucugguuccgcuuacauuuuccuugacuucuugcuuugguuuuauuuuagaaugcuuugucaaguuucuuuugugauuauguauaguacaggauuggacacuguuaccuuuccucucuugucugcagcccuccuguuugugguacugaugcuggaugccaggagggcccaugggcaccgagacacaccuuccaagugcuguguugcccaucccgacacaccagggcccuuucggggaaacagaugcucaucccaugggaccucaggacacaugugugaauggggaaagaacccccauuuuuuuguagguucaauucuccugccucuccuauuaacaucccuaccaucugaaacgggaggagaguugcuaucauguacgaggagacucuaccgggaugagguugaaaauuauauuguaacaucagaaggcuuaggugagaagcccaucuugcaaaccucaaugaugcuggcuggcucugaagagcccauggugacacccagaaaaucugaaagcccaacugucucugccuucaacauauuaucccugcaacuguggggaggccaacgccugguacugggucuggcacauuccaggugcagaagaaaugcuugcuugcuugcugaaugaaugaaugaauauccacaggacuaacuggaguaaucguaacauuucuaguuaauacucagucuagcuaccauuaagggagaacuuaauaggugugagagaugugccaagcauuaucuuuguuucauuuaagucuuaccaaaucacaugcaguagcauauuauccucauuuuauagaugaggcaguggaggcucagaggggugaaauaacuuuccagacaucacagagacagaaaguuacagaacuugacaugacccaauaucugugcucaaaaucccccacucuuggcccaacccaugugucuacccagcuugucucuaagaugacugccaucaacucuccccucccgugcacaccaugguguuccccuguugagaagucgaaucugcucuuugaaucuggacugguuuuacugacuugcuugacccauaggauauagcagaagcaacaugcugaauuugugagguugaaucaugaggagucuugcaguuuccuccugggccucuaggaacauuacucugggggaauuagucauguaaaaagucucaccauccuggcuggaugcggugacucacgccuguaauuccagcacuuugggaggcugauauuguuuagcuguguccccacccaaaucucaucuugaauucuagcucccauaauucccacguguugugagagggaccuggugggagguaauugaaucaugggggugggucuuucccaugcuguucuugugauagugaauaagucucacaagaucugauaguuuuauaaaugggaguuccccuguacaugcucucuugccuacugccacauaagaugugccuuugcuucuucuuugucuucugccauaggccuccccagccauguggaacugugaguccauuaaaccucuuuccuuuauaaauuacccagucucggguaugucuuuauuagcaguauuagaacagacuaauauagaggcugagguggguggaucacuugaggucaggaguucaagaccagucuggccauuagugaaaccccaucccuacuaaaaauacaaaaaaaaaaaaaaaaaaaauuagccaggcuuuguggcaggcaccuguaaucccagcuacuugggaggcugaggcaggagaauugcuugaaccugggaggcagagguugcagugaaccgagguugugugacugcacuccagccugggugacagagcgagacuccaucuaucuuuuuuuuuuuuuuuuugagauggagucuugcccuuguugcccaggcuggaguacaauggcgcgaucuuggcucacugcaaccugugccuccuggcuucaagggauucuccugccucagccucccgaguggcugggauuacaggcgcccaccaccacgccuggcuacuuuuuuguauuuuuaguaaagacaagauuucaccauguuggccaggcuggucuugaacuccuguccucaggugauccauccgccucggccucccaaagugcugggauuacaggcaugagccaccgcacccagcugagacucaaucuuaaaaaaaaaaggaaaaaaaaaaaaguucuugcuauccugagaucaucaugcuaugagaaugccugagcuagccacaaggagaggcugccuggacaggaacaacgguuucagccaggccagcccaggcucaagauuugggagugaaggggucucaaagacauuggagcuccagcagacaucgcuuggagaagacucaagacccagacagauggcuccagucgggcugccccagcaucuccagccauugcaggcacucuggcugaggccccagauguuguugagcaggacugccacgcccagcccagaucccugacuuacagaauugugaacauaauaaauggauguuguuuuauauuuuggggugguuuauuacgcagcaagagauaacuggaacaccaugcgaugcugcagaaggcugguuggacccucauucagacaacaggaagaugacccaugagcccaggagcugugaugaaugcugcuuagccaggaggccaauccuggagccacccgguccccuggcugcccuggcuguggggaagcucacugaucacagugagcacuaaggugucccaucccaucugcuggcucaaaccacugugcugcagugaagucagcaaaaucaugcucucaucuccaguuacuaccucccuugggcauaaauucaaacucauuuaguuuuacuuuuauuaccucacgucucucgaaugcuguaaccuggccugucuccgaccuuggcucuuccugucucauauaagcucauuggaagauacuugcuuuggucuuucuagcauaagucuuuugagacacauuuauuacggcgauuggucuggaguauugucuaccuuacagagaccaccagugaaagagagcugcaugugugugcaugugugcacgugugugugugugugugugugcacacggggugcaggugugaggguugauuacugaaaacagcauacucugagccuugguuuucucaucuuaaaauggggauaauaccauacgcaguacccccuaacuggauuguucugauaauggcuaauaauauuauuuaaccaaauggcaauaccggcuagcauuuauuauuuacuauguggccaugcaccaugcuaagugcuucaacaugggcucuuuaauucaauccuaaccguaucuguaugccguaggucuauuacuuccauuuugcacaugagauaauuacgcucagaaagguuaaauaacuugcucaugaagucagcacccagacaaacugggauuugaauccaguuguucuuucugagaggcuauacucuucuugaccauuacaccuuaaaacuauacauaagauaaaauaaaaaaaauucuguaaucuguuuuaaaaaguuuaaaaaacaugugagccaauugagcuuccaagugacugacccaucuuggcuguggugaggucaccuacuggcccauugccugggucucaugcccagucuggcugagaggcagccuccaggccggggguguacuucgugacuccacagagaccaucaacacaggaauucuucaucuuuggcuuccccaagggugagguaaaagauacgaggcaacucccauccucaguaguggcuauuuaggaagaaggguagggagucccaguccaauggggaaaaaccuccuggaaagcacaggaauuccccucuucccuucccuucucuucucuucuuccccagggauuuuucuuuuuucuuuucuuuucuuuuccuuccuuuuuuuuuuuuuuuuuugagauagggucucacucucuuaccuaggcuggagugcaguggugugaucucagcuuacugccaucuccaccucccggguucaagugauucuccugccucagccuccugaguggcugggauuauaggcgugcacgccuggcuaauuuuuuuuuuuuuuuuuauggcagagaugggguuucacuguguuggccaggcuggucucgagcuccuggccucaagugauccuccugccugggccucccaaagugcuagaauuauaggcaugaaccacugugcccggccugggauuuugaucugcgaauuaagaacugcuacauuagaggagcuuaaggaaccacuguaucauaaagauaaauccuaaggcaaucaagggaugcaaacucacuuuucuugugcaagcugaagauaugcaggucagcuuauauuuacugugguuucuucaaggcaaucauggauauugaacaucaccacagauauuuaccaagcuccuuccaaguguuaagggcugugucccuggugccagucccaugccuagccuauagacaauguccaggaagugaucacugaaugacaugggggaguaaaaguguccaucaagacucucauuacauccagaggaggcucauggagagacaaagagaucuuccucgcuguccucccgcauccuuguccccgaggcuauacgcagcauauucaucggucuaguaugagaaaaauugcaucauagauggugggcaaucuguccccuagaaaaagcucuagccaccaagguaauuaauuuauuuuaacugguacaucacuaagauuuuuguuucuuaguuugaaaaucucuuaggcacaaggguucacugauacaugugcaaaaauauucauuaaaguguuuaaauuuuucauuauuagaggacugauuaaguagaauacuagguagccauuuaacaugaaaacuggaggcggguggauugccugagcucaggaguucaagaccaccccgggcaacauggugaaacgcugucucuacuaaaauacaaaaaauuagcugggcgugguggugcacaucuguaaucccagcuacucggggggcugaggcaggagacucgcuugagcccaggaggugaagauugcaaugagccgaggucgcaccacugcauuccagccugggugacagagugagacuccgucuaaaaauaaauaaauaaaauaaauaaaucaauaauggguuaaaagacuacguaaaaauauauguauacauauacacauagauaggaucuguauauaugcauagaaaauagcaauauggaucaaaugugaauaguaguuaucacugcguauugagacuggaugauuucuauuuuuguauuuuggaacuuuauuuaaaugaggauuaaugauguuuacagucauaaaauaaucuuuccauuuugauaauuaaaaacaagagaaagucuuuugcguuuaaaauagucuuauucuugcuuuuuuuuuuugagacagggucuugcucuguuguccaggcuggagugcaguggcacagucauggcucacagaaagcuugaccucccaggcucacaugauccucucaccucagccucuggaguagcugggaccacagguaaugugucaucacaccuggcugauuuuuguauguuuuuuagagacaggguuucaacauguugcccaggauggaucuuauucuuucugcaucaccuugggguucugagggucucuucauucucuggcugagagggcugggaacuacuuuccagcaaaaucuggaaccucucugcaggugcugucauggcucaccucuaugugccaggaagcugcccauucauuuggcaaagaaucuuguuuaggcucuucaguuuucauacuggaugccaauucuaacaucuucucagugagacuuugaaguaucaagcucuuccuuuaagcugcaacccuaauacuucuacuccaagugcggaauugacccuuuaaugguccaacuucugccaagcccaagugaaaaauguuguuacguggauauuaacuuauagacaugcagucaauccgcucuuguagcugugcaaaguuugaucucugcacgaagucaaacugccuaugaacuugaacuguauuuuauuuccuuucauaaugaugauaaagcaguggcagcagcaacuacacaugauauugccuacuacauccuagggacgaggcuaagugccuucuguggauugucuaccccuuacaacaccuuacagaggaggaaugaccauccucauuuuacgugugagaaacuaaggaucagcgaaauugacaacuuggccaaguucauacagcagagccaggauucaagugcagaucugacuucagauuagccaguguuucaugccacugggcuauccuaccuucauugcucucaugaaugugcuggucuucugugccuauuucauugaggcacccucuagaacaccaucuuguguuuuggagauucacuguacaaauguuggugaagacauuauuacacaguauccccucaugggggccuaggacagaaaguuccuucauacuuaagucuuauuaaaauacuauuuucggaagggaagggguauacuuuucuuucaaagaaauaugcagcauaaaauuacugcauuucccuuuuugccuugaccuccaggaagcucagagcuaaaagcucagagcuagagagagcccagcucccauaccuuuccacaacuccauggucuguauauugaugcuacaacuuuucccuugauauggagcuuccuuuuagccuauauuuucccuaauucagauuuguguguauguauauauauauuuucagacuacuauaccuauucauguaggcugucuucaauccguuauggaaugaggcaugguagaaacacuguccauuuguucacuuagauauuuauuccaggacuuacuuuguugaaugcauugcugcccaaauggcugacaagguaugucaggcauaaagcuucaucucaucuggcgaauaugacgaaggaguaaggaaucugaggaggaggccauccagggaggaaaggcccuccugacccaggcugggaggcugcucuuucugaguggaccauuuugaccugccuugcagugcuuugcauuaccauuagaaacacaauggccacauuuucaugacuggaauggaaugaacaaauguauucauuccauagcaucagagagcugcaggcccagacaggggucagcagaagcucacccacaccaugaagagggcacagaugcagacacguucaagggaagggcugugucuguaugugggaguccagggcagaaaagcuugggugucauaaaguaccuugagaugucugauugaaaagugucuaucagugaauagaggccauaaacagagucccuggaucaccugcauaggccagcuccaccaugggcuaccuaccuacagcaccuauugccacugagaagugggugugguccaggugaccuauuggucccuuuccacccugggaguuucaggauucucugauuagaaggggcuaucuuuuacccagucaacuacagauucaguuuagagaugcacgcacaguugaugcugugcuaaacaguggcauguuacccagaggccagacugcagggcuccauaacccaccagcuagagcucagagaggcagucaccaccaacgggcugcccuucaucucagaaaacaccuucauuccagcaaucaccccuaaaugcuauuccaaauggccaagcauuucaucuauuacaaaauggauuuguucuuggcaauacaugcguuugccaucucccaccuuugccuggugaguuacugcuuauccuugaagacucaccucgggcaucauaucuccagaagccuucuuugaaucuccuuuccuguccucccaacccuggcuaaguuaggugccccuccucugcggugccacaauaccuugggcacagcccuacuuaccacgugguauuuauuaugauuuucuccuuauagggcugauucccccaguugacugagcuccuugagggcucuggucucacugggcuuugcaucucuagggcuuagaauaggucaggugcucaagaaauguuuguuggcuaaacacaaaaaggaaguugccugguaggucccuaagauaagggaacuugcaccuuaagguuaagaaaagggggaauauggauggccagagccaauuccuuccuucugucuucucucccacaggcagaccugaagaacaaaagcuagacaagugcagauaaugccacagggggccugaagacacaagaagguuuuuuucaaucuggguucucaguggggucuccagaaagaagcgacauuucuuuuuaggcuauauuuugcuuguacuuguuuuuuuaagaccugggguaagccuggucuacaacuugcuucacccacguccggaggcaaaaauaacuucgagaauauucugggcauauucacagacuucauugacaucucuuuagcucuaccuauaguuaguucucucaaguaccagccagaaauuagucuucauagauuguacagaaauaaauagugcccaaucauagccuucagcauuuagaaacaaauauuagcaauucugcuaagaugucuaucuggggcaagaugacaaaucaacuggccaaaaugcagguagcuucuuuagggcuaauuuuggcuaacuaaaagagccacgagauuccuuuaucucccuaauuauaacaggggcagauguagaaaauuuugaaaauacuaagaauaaaggaaaaaauaaaauucagcugugaaauuccacuguugggauauggcuacugcuaacaucuuggugcauuuucuuuuuauauuuguauauacacccaaauacuuucauuuccuauaugaauauuuaaauaugaauuuaaaaacuagaauacuuuaugagucuaaaaucauaacauauuuuaugugcagucucauaaguuccuuuuuugcgcaacauuaucucauaguuggucuucgcaugccauuacacguucuucaaaaaccagauuuuuaaagggggugagcguuccacuguaucugcugagguuuaacuuuaugccucaccccaaguauaggagguugggccuuacuuuguuaaaccacaacuugcuuucuuauauuaauagcauuccagguucccuguggaugucaugcacugcagcccaacacacuggucaccugucuucauggaaccacagccuaagguggcuggccagcagcccugucacacccauccagagggacuggccugccugggaggaagaaacaugcaaucuuuauccuguaacuuggccaggguuugugcaaaggugguacaggaggaagaaaugccagauuucaaccucuccccugcuccucaaaagaaaaagcuccaguggaagcuguagggaacucuucacuaacuuuuuguuuuuuucaagacagggucucacuguguuacccaggcuggagugcaguggcacgaucucagcucacugcaaccuucgccuccuggguucaagcaauucuccagccucagucuccugaguagcugggauuacaggugccugccaccgugccuggcuaauuuuuugcauuuuuaguagagauaggguuucaccauguuggccaggcuggucacaaacucccaaccucaagugauccgcccgccucagccuccuaaagugcugggauuacaggcgugagccaccgcgccuggcuucuucacuaacuugugaggcauuggacaugggucacucaccagauucaaaccuuuuaaauuugaacccuuguuguuuaaaucuuucucaaauggauaugccuguuuccuugguuuagucagcacagcaaauauaaauggcuuuuccuuuacuuauugcagaugccuaccugauacccugaguucacuauucuaaauugaauuaaugaguugccgugccuccaaaccgaccacguguucacucacacagacuaaguguucagcuuccaaccugcgcgucccuccucuuggagagcccacccugcuggcugcuggugcagugcccggguggcauggaucugauucuguuguaacuauuugcuugugucccuucaucuccugcuggaccaugagcuccuggagagcagggaugugugucuaaugcauggcaggcacucuaucaauacaggaaugcauuuuauguggaaucugacuuuuuuccucagauguggaagcacgcagcaacaaacauaugucgugaaucaaaaaccgggacauaaagccucacacagggucugacaagaauauaagcaucacuauuaacugcuucugcuauucucuguguccucggcagcuaagaguuauugaauaccaugugcuggaaaugcguaugugucaccuuguuuaauccuugcaaucaccauaggagguguccuauuauaaucucuauuuuacagauuaggaaacugaagacuagaggcauucuuuuuuauuuuuugagucagagucuugcucagucacccaggcuggagugcaguggcaccaucuuggcucacugcaaccucugccuccugguucaagugauucucaugccucagccucccaaguagcugggauuacagguguguaccaccacgccuggcuaauuuuuguauuuuuaguagagaugggguuucaccaugcuggucuggccagucuugaacuccugagcucaggagauccaccugccucagcaucccaaagugcugagauuacagguguaagccacugcaccuggccuuuauuuuucugagacagagucucauccugucacccaggcuagagugcaguggugcgaucucugcucacuguacucacuguaaccuccgccucccagguucgagugauucuccugucucagccuuagguucaagcaguucuccugccucagccucccaaguagcugggauuacaggugugcaccaccaugccaggcuaauuuuuguaucuuuaguagagacaggguuuuaccauguuggccaggcuagucugggacucuugaccuuaggugauccgccugccuugguuucccaaaugcugggauuacaggcaugagccaucgugccuggcccauggcauucucgcccaaacuaugaagcuaagagugcagaucugggauucaaaaccagacugauucuaaaggccacccccugaucaugacacuugacugccaguuauuuagaaguggggggugcaacaaauacaugcauaaaugcugcaaagcaaucugugaaaacaauuucagaaugucugguuucuaacuucacaaaaaaugggauuaauuuaaggcacugaaaacuuugucuccccacccccaaaauagggaugagaagaucucugaauauccaaccaccuuugucuuuguggccugguuaguucucagugauuuaugccaauggagaggagaucuggauaaaugaaacccagcacuguuaauuuaucuauucuuuuuugggagguggugguguuaguguagaaggaccauuggaaugcgaugcugucuuuuuuauuccaucagggccauuugcuccucuuaggagcugcguccuuccugcagcugacuugcuggugaguuucagcuggcuggacagggccagggaacggcuucucuuuuaccuguagguugccacuuuguaugcagaagaguaaccagggaaaguguucgaguucaauuuuuaagggcucuaugcauugugacauuuucuuauauugccauuucuuuucacaguaucacagucaaauagguugaagucuauuuucagguggagaaaaugagaaacagaaugagagagaucacccgccuccaugauauuaauucaauugucagaggugaacuaacaucaauaauagcaagaguucuuuugcaucuuuaaguucucacuuugugggacaaucucugcaacauaagccauaaauauuuuucuucagggaccucaaacuacuccauggaaguaaucucggcauuuaaaaaagcacucaagaauuuaaauuuuucuuuccuuuuuuuuugagacagagucuuguucuguugccuaggcuggagugcaguggugcaaucacagcucagugucuccuaggcccaagagauccucccaccucagccucccgaguagcuggcacuacaugugugugccaccaugccuggcuauuauuuauuaauuuuuuuuuuuuuuuuugcagacaugggguugcccuauguugcccaggcuggucuugaacuccuggagucaagugauccuccugccucagccucccaaagugcuggggauuacaggcaugagcuacugugcccagccaggaauuuaaauuuuauuaaacugaugagaaaaccaacaagcaaacucauagcagagccaaaguuggaagugguguagguaucacugaucacgaccacgugguugaugcuaguguuuuucuugccccacacuuuggcuggcuuugugcauauggaugggagaguacuacagaaggugaucacacagucggaugaccauguuuuccugcguuuugucacuucuguuucuccagcuuagauccucacauggcccacauucagccaagaaagcacagggaagagggagcuccgucucccacacgucccacccacccugcaccacgucuucaacauucucuacgcacuccugagaccgucucagccucgccaugugcugcacaccgaggagcacaggauuugggaguugcaagugaaaaaugagcaugguuaaaaauaucaaagacugcaaacauauucuuuucagaggagugagaauuagcaagggucuggcagcaaagccauggcuuuuaaugcuauuaaaaaggaagaacaccuuuuaacauuuaaaacuauugaaugaggcucuucucagauauuugauacaaaucugauacucccauggagaaugcaucaaaaucuuucuauguugacuuacaucaacucucuauuacugagaaaucuagaguaacuaagcaaauaaaauacagaagacaacaguuuugaaauuaccuugguugucucucucucucaccuauaguggccuuuugaggacgaucacuucagccucgggaucugguggccacugaaauacccauucccucucuggcagucccauuuguguagaauucucuccacucauuuaagagcagaggagagaaaagcugaguccauuuuuaacucucacaacuccuagucucauaacacauccuucuuuucugcucacccuacaguucccucuuccccaaguucucacugcccagaagguggaguuuggggaagcuuuuguucuacagugggugagauguguuucaggccuagcaaguuagggauaugauuagaaaucagcuaugacaacaacgagagcauagacuccagaauacagagcaggcuuggugcuugcuuguguguauauauuggcuuuuuucuugacaacccuaauucuguuuugcucuagucuuuuuauuuucaucuccccaucauuuaaaacugaaaauaucacaagcugaauuuaugguagauuccaagcaacaaaagcaggcuuagagaucaucaaauguaacauuuuccaaaauguguucugcagaaggccaccccuguggggugcucucuaaaaaaaaaaaaaaaaaaaaaaaaaaggccgggcacgguggcucaugccuguaaucccagcacuuugggaggccgaggcgggcggaucacaaggucgggagaucgggaccaucuuggcuaacauggugaaacccggucucuacuaaaaauacaaaaaauuagccgggcgugcuggcgggugccuguagucccagcugcucaggaggcugaggcaggagaauggcgugaacccgggaggcggagcuugcagugagcagagaucgugccacugcacuccagcuugggcgacagagcgagacuccaucucaaaaaaaaaaaaaaaaaaauggcuaccauggccaaauaagcuuaagaagccccgcacacuccacccccgccucacaucugagcacauucagggcccugcagagucccauaguacguaaacuauguuaagcucacauccuagcuucuguagggggggcuccaggccuccuuucucggacuacaauuucuaugagaaaaugcucugaacuucaaaucuaacuguccauaaacuggaaacuuccuagacaucacugaauuuucuugaugauaucagauaaaaacaugggauaugugauaacaguacauaaaaacaugugacccauaaaaggucuuuaagguccaaaaagcaguaacuucacaauuaaaaauguauacauacuuauuuagcuaaaagguuaaauguguauuugagguauuauagggucuucuuuacuuuuuuuuuuuuuuuuuuuuuuuuuuuuugccauuuggggcagcccaggggacugauucauaucaaaagaauuuuaagccuucaagacuggacugguauugaacugcccuacauaaggauacaaaauccaugcucaaagaagcuuuuuuuagugcaagugaagcuuguugcaucucagaauugcucaaagucccaggucaagggugguggccuuuguuacuaauuuugagguuugacaaacuguucaccuggagaagauuaaaauggaggaucuguguaagaugaaaguccuuuggagcugguaugagaauccuaagcuaguaauguuuacauuaaaucaaacaucuggaugaaaagauaaauguuaaggcaauucucuacauguuuuucuaaguguaucagggauauaacguucaucauaaaacuaaacaguugacuauuucuucccccaacauuucaccucaguauucuggugauauauauauaucacacacacguauagcuaauaaacucaagggggcagauaguccacagaaaccaguuuuaguuucauguggaaaaauacuuuagauacucugaugaaggcaaauuauauauuaccuuaaaaaccaauuuuauugaaagaaaugcugcaauacuuaggaaaaagguggcguucauccugaaaaguaucagaauauucauguugauguucaaugcaaacacggucuagaggcagcaagcucuguggagucaauguuuucuuucugcuauuucuauuuuaauguuuauuuauugcuuucacuuuuucaauccuuucguaauggcaguaggaaaacuuuggaagauaaauacacaucugacaaaccuaucuuaugucuuuuagcagaaaaagggucaggcuguuaacugacgucagcaggcagggagagggaggaggugaaggaacaaaugcugaacaccuguuauuuaugaagcacucuacauauguucuuucauuucacuccuggugaaaaccugcaagguagaaacucuugucucuguucucuagcuaugaaaauuaggacugggaaaaguccagcaacuucucuaagaccagagaguagagagauagcugauuugggaugugaacuuugguauuccguucuuucuaugacaucaauccaaccccuauagagaaagguauuucacauaaaccaaaauagaugugaacaggaugaaauuugacuguauaaagaaacaaucaaauuuuacaagaauugcaaguuauguuuaaggcaccagaaaccuaacacugcacauccuuguaaacccugaaugaaauggcuuuaaucaacacuuuaaucccgugcaaacaaacgcuuccugagauauuuagagcagucucgcagggcuuugcuuugcagucuuuacuguuaccacagacuacuuuuauaucacucuccucaagccuccccaaauggaaggguuuguuuuuuuuuuuaaaggcccaugaucauucuuucccauuuucaaucuuucuuuaaaaaccaaaaggggugaggaacauguagcaugauacaaaugcucugagcaugaacugccugacucacggaccuuaagcugguauagauuuuggauuacaguuggccuuggccuauagguguucaucagaacuggaaaacauugcuucaggcagucuucuacccaugacauugaacugggggcuggccucucacgaauauaugaauacgugauuccugauucuuuaaauauguauauuucaaacccagugagcagagcagaaucaucaaacuuaaguggcauuuucaaauucuucugauuauaaauuauuaauauacuauaucagagauauccucaagcaauuuguaccaccuugagggcauaucaaucuuaaagaaacauuuguuauuuccuuuaauuguuuccauuuuccaaguuuguaauauaugagcuagucuuuuagguuuaaugacaaguauggcuauaaauggaagugguguaaucccauaaggaugucauuacaagaccaacuuuuuuuuugagugacgguuucacucuguaguccaggcuggaaugcaguggcacgaucauagcucagugaagccucaguguccugggcucaagggauucucucaucagccuccugagcaacugggacuacagguguacaccaccaugucuggcuaauuuuuuuuuuuuuuuuuaauagggacaaagucucacuauguugcacaggcuggucuugaacuccugaacucaagugguccucucaacuuggcaucccaaaguacugggauuauagguaugagcugugccuggccaagaguaacuuuuuuuaaaaauugagacagggucucacucugucaccugggcuagauggcaguggugugaucacagcuuacugcagccucgaccucccaggcucagguaauccucccaccucacccucucagguagcugggacuacaggcaugugcuaucacacccagcuaauuuuuguuuguuuguuuuuguagagaugggguuucaucauguuucucaggcucaucuucaacuccugagcucaagugaucugcccaccucggccuccaaaagugcugggauuucaggugugagccacugagcccagccaagacuaauuucugaaugagcauaugggccaaaucuuggaguucccaauuaccaccuguagguaucugaucugacuccuauucaauauagaagacugcagauuuguaugaggcaaacacaccuauuaugcccuaguacuuagaaauggcuacuagagaaacugacagacauagugagggacaaggaggcuguaagaccuuuacuauguuuuggugccagagaaacaaagggauuucucaagucugaaagugaaauuaguaaaugaguaauggcaguugagauacuagguagggcuggcauucuaaguugaauggaagaaugaaaauaucgaaaaaucuccaaacagccuagucugccaaaauguacuugguguuaugaguggaacugugacccacccaaaauucauauguugaaggcuuaacaugcaguaccuuaaaauguggcuguauuugaagauagugcccugaaaguggugauucaguuaaaaugaggucauuggggugggcccugaugcaaucugacugguguccuuacaagaagaggaaauuuggacccagacaucuaagcacagaggaaaggcgaugugaggacacagcaaguacgcagcuguauuagucaguucucacgcugcuaauaaagacguacccaagacuagguaauuuauaaaggaaagggguuuaauuggcucacaguuccacauggcuggggaggccucacaaucauagcaaaaggugaaugaagagcaaagccaugucuuacauggcggcaggcaagagagagcuugugcaggggaacucccauuuauaaaaccaucagaucuugcgacacuuacucacuaucaugagaauagcacaggaaagacccacccccacgauucaauuaccucccacuggguuccucccaugacacaugggaauuaugggagcuacaauucaaggugagauuuggguagggacacagccaaaccauaucagccgccaucuacaaggcagggagagaggccucagaagaaaccaaaccugccgacacauuggucuuacacuucuggcccccagaagcugugagaaaaugaauuucugccauuuaagccucucggucugugguacuuuguuauggcagcccuagcaaacaaauacacuugguauguaucuuaauaccggguaaacaagccaagcuaguguguuaauuauaaguugggcuuucaauacaguccaggcccauucugcaaagucuuuaaucuguugaaaggggguggguacucaccacaucaaaggcaguaaacacaugacaguaguggugauuagacuucaaaucuuuugugauauaggcaaauguugagaggucuucuggguccugggcagcacaggagauauuacgaauuucaugcucagcaauuauguucuggaagaaaugacauaaaugaucauuguuuuccucugcgaaccagcauauaugacaaccaagacaaguaacccaggaagcaguugcuuuccuucuuucuggaguguucuagacuagcaacacucaaagugguccacuauauuauuuguggguaaaugaauaccagauauggaagaaauauuuucauuuaauuaaaaacaaccuaacacagucauauccuggagcugcaguucucaccaguugcugugcauagaagcagucuggguggcggccacuuuuuuuuuguuuguuugagacaagagucucacucuguugcucaggcugaagugcaguggugcaaucucggcucacugcagccucccgcucccagguucaagcaauucuccugccucagccucccgaauagcugggacuacaggugcaugccaccaggccuggcuaauuuuuguauuuuuaguagagacgggguuuacaccauguuggccaggcuggucuugaacuccugaccucaggugaucugcccaccucggccucccaaagugcugggauuacaggcgugagucaccgcguccggccuccacuuuaaaaaauaauaguaauuacuaagcauuugacuguuuccauuccccauguccaccuguagcugugcagcacugcuuucugcuaauucuguauggaggggagcaucugucgcuuucucuguaugagaagagaucugacccaaugaggcucuucaaaucccucgccaucaugcuugcacguuguucuuguguccugcuccuccucccucagagcaagggcagguacugaaggaagcaggcagguggaagccucaaggugcuuucuccguggaaacuaaggugcaggggccugauaagagaaacaccauacugcaagauucaggccuuggaugccuugcuugaucugggcccuguggcuauauuaacaacacuuuccuaacuacauccacuguguauaauuaggagguggugcuguugcuaccauuauuuacaggugaagcaacugguacucaaagaauuuaagugccuuaugcagagcaggugcugggguggaacugaaauuugggguugucugacuguggagcucaggcucuuugaaaugcauugcaaugcccuucaacgucuccaccucccucuuacuggcuuaacaagaauugaguuauuucuucucuagcaucucuuugugccuucuucccuggugggagaaagguuuaaguaccauuguccugaagcacaaaauaaccacgaagcagcuuggcugcaaacccugcuagaaacuucuuuugauacauagauguguuuaaaaagaaaaaaagaaaaaaauucacauaaucuugcaaucauuuucuuaucuuauaauaucccauuuauguuuuuuugcaguugucacagaucuaaaacccucgaugcuuuaguuacucuaauuacuuuuuaauugcgcugucuuaaauaaccuguuggcaauacaguguuccguguacagccaucaaugccuaaaaaugcuuacaaaauguccuucccugccagcacccccagcaaguacuucaugucccucacuuuaccaagcugagugguucggaggcaauuacagaauuaacucacaaaagaaaauuaaauuaagacauuuuucaccguggccuuuuguguugacauuaaugcagugcucugucaaaaaauaacucaaauugcaauuggaaucccauaaacaaguaacauucuauugcaagauaaguuucagacuagaaggugaugauccucuucuggcauccagauagcauuccuucaaguagaaaaccaaauuagggaugggugagucuuaaaauaauguuaaaaugagaaaaaggugcaaugugagauggugugggaaccucugccauuaucuugauugggggcagccaaugcccugggaagccuggguggauuuggucucacuuguccaggaggcacugucacaggaaauaggugcuucaacuuuuacuaaguuggcauuuuguguucuugagaucuuuugcaagaucucaagguagaugcacuucuugggaaaugaaaagugcucugugauuuuuauugcacugaacucucugaaucuugccaacucaugggaugccacucuugacaauuuccaauggugcacggcagcacuguggccugggggaaaguugcaaaggaggaaaaguauaucuuugguacucucuccuccugugucuuugcugaccccugaauuuucuggagcccucuucuucucuuucucucucucucucuuuuuuuugagauagggucuugcucuguugcccaggcuggagugcaguggcaccaucucagcucacugcaacuucucaggcucaagcaauccucccaccucagccuccugaguagcugggacuacaggcaugcaccaccagccuggcuuauuuucuguauuuuuuuuuuuugguagagaaggggcuuugccauguuucccagguuggucuccaacucuugggcucaagcaauccacuugcuucagccucccagagugcugggauuacaggugugagccacugugccuggcccagcccuccuguucucuauuccccaggagcccaggacugucuuuuagcugcccagggaggccugaccucugugauacuccauguuccaaaaucagccuucuccccgacuguggaaacuucuacuacucuguucccauugucuaagcuauaaggaaagcucaugcuaguuaaaauauucuauauucagguaggaauaacucaucauuguggucauccuaacuggcgcuuaaaagaugcucuugaauuuguauugauagccugcggaggcagguauuuuugaacagaccuuugugauauauugccaaugcuagaaugggguaagguccugggaugucacuacugaaauacugccaucacucugcauugucuaccugugcagaauggugaagccaguucucuaugugcaggacgaaucaaaggucaaggauacuacaguuguagacuguauggagacuagaugguagacuuccuccuuggagaagaagccaaagaggaacacauucuuuccaccuugugucaugcauuuaugaguggcuuuuccacaaauuaaaaagugaugucaugaagagguacaggugaugcaccucaguugaaaacuggacuccucacauguugaucagucuccauuucuaagcacauuuuaagaaggccagagcuuuaaaaggcucaagagaagaacuggggaggggcuccuccugccucuucuuggggauagaaauucuggcagcauagcacccuucaauagggagagaugguuuugccugucuguuguuugccaucauggugagaaacagcugaagaggugucuugcugguagggguaggacaggauucucggguccagcuaacucauauggugguucugagaagggcgcguggugaugaagugaugcagcuuagaaaucugccucucgccacugcauucaaucugagccccgacaggugggaccuuucucuugcaucuccucaucagccgggcuuuuccugagugaggagacugcaguguucccuccagggcggggccaacaguauagaccuagagcuaacuggugaugcccuguggggcacgugaugcugagaacagcacaugugcuuaacauggccuuaauuugucuccaagcuucuuaggaguauuugcuauaaaaaaaaacaaugggaggcccacugcagugacucaugucuguaauuccagugcuuugggaagcugaggcagaaauauugcuugaagcaaggaguuuaagaccagccuaggcaauauagcgagaucccaucacuccaaaaaaacuuaaauaauuagccaggcuugguggugcauaccuguagucucagcugcucuggaggcugagguugggggaucacuugagcccaggaguuugagguuacagugagccgugguggcgccacuacacuccagccugggcaacagagugagacccugucucuuaaaaacaaaacaaaacaaaaaaacccccaaacaacaggcacuuguuuaggcaaauguuccaaaguauuuugugccccuaaaauagcauaggccuuguuuaaaauuggcauuccaaaaaaauuuuuaaaaacucaaaaaacaaaacaacaaugaaagcaaaaaacaaacccuggcacugcaucauuuuuaauuuagccagaugggaaggcugaggagggagucagcacaggaaggcaaaaugcaaccugcuccucagcugagcacugaauguagaaaccgugucuccucucggaagaccucccuccccgacucccccaaccugaagaaggguccguuacuaaacaguugcagucccccaggccgaauucccugcuagagcaaccuuugggcuauugaucaacagaaggcugaggugauuuaucuaaaacacuuuagugcuaaaucuauugcaaguuccacuuuuaauucaagaucgcuuucugcuuccuccuucuuaaaucaggauuagugauucaauucauuuccuaaguugcuaggcaauacauuuaugaguuuauaacuaggccucuaacccuuucccaugaauucagccaaacccauuuauuuauuauaaucaaaggaaagaaaugcuucacggaggguuaaucuuucacaaagucuaaugggggcuaauaggaagggaagaguaauuaacacacaaugaauuaucacacaaugaauuaguuugcacuucaaacuaauuuguggaagguagcuguggaguaacagaaaaagcauuagguuagggagguugaaaaucaaguuuuagucguucuucacgaccaacaggcugugugacugcagggcagcacugagccaagggacugaggccuucaggucuccagcugcccagggcagauuaaacaaucaccucucugaccaaggcagggguacgagaugcaagguuaggagaguacuguugaagaauaaaguacgaugaaaacauaaaauaugaacaguaggcugggcgugguggcucaugccuguaaucccagcacuuugggaggcugaggcggaugauuaccugaggucaggaguucgagaccagccuggccaacauggcgaaaucccaucucuacuaaaaauacaaaaauuagccgggcaugguggcacacaccuguaaucccagcuacucgggaggcugaggcaugagaaucgcuugaauuccaggccuaguggccucuaguaccugaaauggugagaucuuuaaauaugcuugcauauuaaaaguucuuugcuucaaaucaaaguggcccacugacacagcacugcccagugggggaaaucccuggugaaaacagaaagcaggacucuggaguuuaucaaucugcuccuuuucugcugugcucuuugcucuagaacaaaguagcauacacagguguccucgcacacacugcuagaaucuagguaucugggcaugguuccuuucacaccacaacuugaggaugauccuucaacuguggauccuccgucccuucugaagccaguccucccacccuggcugaugguaguauuucucagucuuacccagucaaacuccaccaauacggccuuccacuauuuucuuucuucuaaccugcuaaacacaaucucucuacuugggcucccuacacagcaacuacuagacuauugcccugagucacccacacucucccuacccacugucauacugggggagaucagcuaccuugcaggucacugggauguggacccuguauagccaguugaaauuaacauccuucaguuccuuaaaaagccaggcacauguugucauacauucacagacuggcuccacuugccaccaacauaggcacuuugccuuugcucuagauucugaaaauauguugaggaccacacugcaaagacuugaaaaaauaugcugaccuucuuuauuuagcaucuuuauuuacauagaauuaucuuuugcauaucuuucugugcuuuugcuuccaagaguagucaucagugagcagagguuuaugguuaacucaucuaauuauuggcaauugaaguagaaguaucuccuugaggcacaggagcaucaacuucugugucucuugccgugucaguaagcaacauacaauggaaccggcagagcucucuuucauuccucugauuguggagaguggguuagagaaaaugcuauuaauacagcugcauccagccauacccccaaaaucaugaaaugauugccuuaggacuguaggaacuucucagggcaaauaccacuuguuuagaaauugucagaauccaagucugcuaaaguuguucaucuaagagagugucaaauucauccacugaaaauauacugcuauucaagcuuuccaagcauaaaugggauagagggaguuguuucaauuuagggaaaaaaaaauccaggugccaaagucuuucuuaagauuuagauacagcaauagcaaugguaucuuugccauucuauaauguguuccauaaaguguuagaacuuuuaaaaccaacugacuauaauuuaaggauaaaguaauuuuauauaccaggaacuaaagaugcuuccaagaaauaaaaaagcaaaucaaucagcauuguucuuauuugagucuccacaauuauuaucugucaacaaccaucaacaauauuuugcacaguuggaaucaccauuaugcugauauuauuggucagcaugaugcuggguuauaugcuuuuugccuggguuucagaacuuuuucuauaaccgggagguuguuuucccaagcagauuuggggaacuuggguuuaccuaacuacugaaacaacaaucucuuucgucacagaaaaccaauuggaaaaacuuccgauucagaugcugggguuuaauagagacaccaaagagucacugcccgugagacuuuucccuggaaccuaaauccaguugccuuggcccuaaguugcuguuucuuaaguucaccuguuucaugacuucuguucccuuucuccaaaacggaggggguccaggugggaggucugggugagagguccagagaaagaccagcauucaccaauggugaucaccucuuuuacccuccuucuguacuugauuaguugaaaggaugcaggaauaaaacacaugaacguuugggguuuugugaggaggagucagucagcuuugaguuuauggagagggacaauggucacacccaagcuuucuacuucagcaccacgaugcuguugucuuugucaagaaaggaaugcuuuuucaguaaaaugcaaccccacugaccacgcuugacaucacagcccacaaacuauucccacugugaggaagaagucacagcggagccacagcauggccugggcucuuuucugauugugucucuuaagaaaacaguacagcugaaacucucucccaucucagaggcugggaauuaaauguaguuauaaaauuaaaaagucagaaaauuaucaacagaaaagacacauauauaucucuagauaaacagaaagacaaauguucuagcccuuuaucuaguaacaucuccucugauggaggagugaugacauuguugacuuuucaaucuacaagugauuuuuguuuucuguuucaauguucuccagauccaaagggacaugcuggauaauaaguggccacagucuauuagagaaagcaucaugacaaagugaaagcacaauauuuauagaaaccccagaucaagcccuucccccaaaugguuccuuucuguauguaugaagguguguauguguguguguacaugagcguguaucuauagguauauguaggaagcaugaagguugggggaaagggaugauuacaguggggagugcuggguauuauaggaagcaaaggauuuuagaucauacacucaggacugcaucuggugucuaaaccagagagaggagugguacuuaccuuauuuguugcaucaauaaauuugacuccuuuauaugagacagaaagaauaauaguagggaccuucuucauuugcucuguagacuucugaaauuaaaauuagaaagcuguuagagcaguuuguguugcguggcaacugaagcacacaauuuuuccuccugaaagauaaagaugagcucaaauuaaaaacaacaacaacacacacacacacacacacacacacacaucagauacacaccacgcacacucuaauuuuaaugucugccucuccucucuugggcuuagcuauacuucgggcuuauaaaguuauccgucuugcccuugaggaucuaaaaagaguuuguuccgcuacuuuguguggaugaaggaguacuucuuuucccugacacuaaagggugaaugaagaggucugucuccuacugcaauuucaagugacuguuccuuucacaagaguuaaaccacaucggacuuaacuccaagggugcauuugacauuaacaaaauauaugcacccccccuuuuccuaguuaccuucauucuuccaggcacagauaaugcuuggauguauacuuaaaauagggauguaaaagauaucacuauguauuguucuugaacuggaccaaauccauaaaugcugauauuauauuuacagcagaaucacuugugaccacaagggauguaaugaugcucuagaacaaugaagcccuccaggagcagucuggguuuugagccacagcaaaaugcuggacagcccagguaaccuacuuuaucauuuagagcugcuacauucccuuaggccaaguucuugugauagauguucacacuggcugaaugugcuuagaguuugcagcuuguacaguuuuaugcaucugcaaaaaguuucucuauaauuuaguaugugccuuuccuguuuagcuuuaucauucaucaccagucaccagcagucaguuuacuucauugcccucuauauauacuaguaauaaucacacuaaacaucaagaagaaccuaccugacaguuagccugguggauuuuccaguuaagacagaugggaacauaauaggagagaaaacauauaaaaggugagagagaggaaaccauuucaauaauucaccaacaguguaaauucauuaaaaaacaaaagaugccacaaaagaacaggcuucagagucaucaaagaugcagugccacuguuauuuuagaaaugcugcaggcuuucaccggccccuuucuuucucuguuucucaucauucuguuuacugcaccgcacagucuuaggacugacacacaagaaccuuccacuuugagcuuucaacaacuaguugucuuaugucuauuaagggaaucaggaaaaaauagaaacuuucuugauuuauucauuuauauuucccaauuuucuaguuuuaaauucuggaaugcagccagaauucaggaaggcuuuuaauuggauagugugagugaaacucauugaacucaaugaugagacuucaauugcaucuuuuaguugagcugugaaaagggguguuucacauuuuccugauuguuuuggcacaacaucuuuuugagaguuacuacgccuguuucaaaaacaauggcuuacuaaaaguauuguuauuuaauaucuguuguuguauacaggaugugaaaaagcagcucucuugcuuuuuaaccaguuuugaaauucccuggaugcaucaguguuccuuugugauugccaaaaagagagauuaugaaaauaaaauauaagguuagaaacucguuuuaaugcuucuuccaaccacuucuuaaaaaugugcaagacacaucaaaggcaggcuagaagaaaucaugugcaauguguugauuuuaaggcaacgcgguggcugaacucuguaaagagggagggcuggggcagcccaggcgauaguuggaauaacugaaugcauaugugaaaaauuuucugcaaagcgucacaguggauuucgguaaaucaccucacuuaucuuuugccaugaauccauucuccuggacagaucuaucuguaaugcaaagcaauauacagcuaauauucagaugaaaaucuauucguuauuuguucagcaaucgaguuguuacuuuaggcaacccacugugcuugucacuggaaaagcucgagucuaguucagggauggcagacagaccucaaacugugugcaaacaccagucugcugaaagcacuguguugagaaagauucugagcugugucugagcucaguagaaaagagggcuggaaaugaugucugccaugggagaagaagaggacgaggcggcccaggggcuacacaugaacaugccugcuaggucugauaggaagaacagcuacaauuacaauguugacaaaugugacaggagcaauaugaacaacaugccuccaggauagugaauaaaaacagccuuauuuugcuugacagaguggggccagucuucauucauucauucaaaagacaaugacggccuauuaggggugauugagcugacucuugaugaauaagcauuuuccaaguagcaaagaggccaaaagaggcuguuuuagcaacagaacuaauacaugcacagaggccuagaaaugagaaugugguggguuuggguaacugguggagaugagagugguagaguagguuuggaagguugugacuuacucugccaaguuaggguccguuggaagcuuuucacuagagagugacacaaucagaccuguguugcagaaagauucuucuggugguuguuuaugaaggagggacuggaagagcuagaggcuggaugcagggagucaggaaguuauugugcaaauccaaaggagagagagacccuaagcaccugaguugaaguagaggcauuggagaacaggaggaggcaccacaaugucgaugaggaagaacugagagguucuguugauugaucugcuauggaagaugaaugggugggaggauuccacagaugaagaagccacugagauaaggaauacuggaggggaaaguguuuuugcguaagcauaauggaaaugcuuuugcacaugcucaguuugauaagcagguggagauauccaguaggaaaugagaaucagaucuggaaauccaccuacauacauggauggccaaggaggugggaguggacaaggugguuuaaggagugaacaagaaaagagggaaggacacacuucaggggaagaugaaaucccaagggguggggcagaaacaagagcuaaugaaggaacuggaauugaaguuggaagaugccuacaacacaguaucacagaagccaaagaggagagggcuuagaagguaggagcaaugccccaugccaugaggacuaacaaggccuaaaauggugugccuaccacaguggcuggcucacacaggagcugcuacuuucauugggcuuacuggguggaauuccuggcuuuugcaacaagaaaaaauuguugcugauuucauuaagaguagcuucaagaaaaugguggcagcagcuggagaggagaacacagugagcugugcaauggaugccaguuaaaggaagcagaaagcuggaacaacaggcaggucaggacacagcucuugagcugacaugaaggcaucagcggugguuccugugaugguacaaagaucccacaucagaugcucggccaaguugaacaaaaaaaagaaaagaugaaggauagucauuucuuuuucuuccaugggucccaggaaucucugcucuccuaacuggaggcagcacuauggugucagugaugcaggcugugcacaggccucuaugaauggcaguguuggggguggccaugcuuuccaaucuggagcccaaacuguacugcucucuccacugagucauuugacaagaagcugauggauccugaccagccagagaguucaaagggagggugggaaaucuucuggguagagccccuccuugaaggcauuuauacacccuacaaaagauaaggauccaucgucuuuuaaagggguuuucugaugguguacuuugacaagaguuuccaaagaggucuuuucauacauaaucuuagcaaaagaugaaaaugcauagaaagaaggcaaagaggcuaggcaugguggcucaugccuguauucccagcacuuugggaggcugaggugagcagaucaccagaggucaggaguuugagacaagccuggccaacauggcaaaaccccgucucuacuaaaaauaaauaaauuaaccaggcauggugguggguggcuguaaucccagcuauucaggaggccgaggcaguagaaucacuugaacccaggaggcagagauucuagugagccaagaucgcgccacugcacuccagccugggcaacagagugagacuccgucucaaaaaaaagaaaaagaaaaaggaaaaaaaaggcaaagaucaaaguuauugagucuucagggagucuaaucugggaggcaagaaaucuaguaagugcccacuucauuucaugaaggcuuuacaggcaucaaaaugugagcacggggcuucaguccaaucacaggcagucaaagucccuccuuccccauuuucucuucgguguuaugaucaucauucuuuucuccuucccagggacgaaggcgccuacucugaacaucaaguuacugagcacgugcucucaggcaacacugguuucuaugaccuaucuaucugcaugcucugcugggugucuguauaauuaauacucccauauguuucuguuaaaaauucaagcuuuauugauuuguauaaacagaacucuguacuucaggcccauuuccccagugaaagaugcucaaggcgaaccuucuguuaucguuuucuuucguuucuaguugcuuuucccuaugccaugcucuuuguggcauuuuucagguuucccaauguucucaaauuuaccccccuucagagccagcuuuacagaagagacuaauuuguaauggagaccucugaguacauaagcagauaaauacuccuggguaaggcuccaaauuauuuuaauuuuuacagcaucuuggucaccugcaaaaagcauuauagugauauucaaauguauuuuguucacaauuucccaaauuaagaggaucauacuuuuauuuuuccaagagaaaugauauuuaguuauauagagauguuacguuucugaaaucuaaaauacaaugcaacauuugaauccuaaauucaaaggcagucuucucuuuaagcacuugaguuuauauugucuauaaccauuaaacagaaacaggaaucagaauuucauaucuggagguggccaccugaaauauuguucuuaguaagucacugaaugcuuuuagagcauuuuuaaaaagaagagauuuugaaaucaccaagagaaagaaauaaccaucuuucuucuucuccuuuuuaauuuuaaauuaugaacggcuugguaucaggucagaaauuaucauuggugcuuuuauuacugccuuaaagcauguucugaaaauaaguagguuuucuauuuugaaugcagaaucaguaguauggagauacccuuuccagagugcacgaacucuaaucucagagcaagacuuuuccgagcacgaaugaaagcagagggguuuaugauggggagcacuucaguugugagcuguaaugcucuuugagucuggagugguguuaauguuccgaguaagaaucauuagugccccaucaucagcacagacagggaaaacagugaggcuaauguggggaggacgccaccaacccuucauucuuacaaugccccgauugcucccaguguaucugaagcacaggcuggggaagggauuuccgguuggucuguugccauccaacuuacaguauauuuuuaaccuacacauggcuauccugagaaugcuuucuaguuagauauucaguccugagucguaacuauuaauuuuggcauauaauaucuuccuuaguuagauucaaagcuuaauuauuauauuccauuucagcaaguaaauuaaaauaggaucaagcaauuauguuugguagcccuaagugacuuucaaaugauuaaaaaacauacacaaaauaagcauuauuguggugauuuuguaggcagugaaacuagcuagguugugggauuacaagagauaaaaagcagaacaccaaucagcaauuugaaaugaacucucaccauuugaaacugagcuuaaaggccacuuucuggggaaaggcuuccgcggucucccaggcugacaggauggcuuuucucuuguuccccucucugccacuuuucccgugcacugcccugggucucagcguggucugcuugcuucccuauagggagcuccuugaggacugcccacaccuuucuugauuugucuucacuguaaugacuagcacauggucuuacauugagcccuaugaaguagccauuuuucaagucaagaauggcuaaguaccagcaguuucauaggauucgaucuaaugguugcugaacuccaugacuguuaaaggaacaggccagugaauuaauguaucguaacaagcacguagccagcguuauaaggaaccacaggcugggcguggugguucucgccuguaaucccagcacguagggaggcugaggugggcggauugccugagcucaggaguucgagaccagccugggcaacacagugaaaccccaucuauacuaaaauacaaauaauuagccgggcaugguggugggaaccuguagucccagcuacucaggaggcugaggcaggagaauugcuugaacccaggagguagagguugcagugagcugagucggcaccacuacacuccagccugggugacagagcgagacucugggugacggagcaagacuccaucuccaaaaaaaaaaaaaaggaagcacagugccagccucucaacacgcugagagcucagcaaacuuucagagagcucugguacccagagccagcaaagaggccuugcaaagcuugcaggaggaccacaaaugugauuagaggguuaccaagacauuccuaugggguggagaaaacuucaaagauuuuggcugggugugguggcucacgccuguaaucccagcacuuuggaaggccgagguggguggaucaccugaggucaggaguucaagaccagccggaccaacauggugaaaccccccaucucuagaaaagagaagaaaacagacaaaaaaaaaaaaaaagaucaugagaguuuucagucucaaggaggcaaggcuuaggucuucguuucugcaaagcaaacuggcucaaauugcaagcauuaagaagaaaagccuucuugacaggguagaaggauuccuaagggcagcugggaaguuucccccucuagacaucuuuaaaaauaguuuggguucucaucugucauuaaugaggcuaaaugaccuugcaaggacuuuucuggucauaggaggucuggcacaaaggcugagggaauacagaaccuaagaccaggugacaagaacagacagugggcaagcagccauugaaaccacaccuccugcauaugacauggccauuguacugccuguguaacucacaugcucuggagcacaagucuggcacagcacaaagcggugcccuccguuucuauaugcugcugaugcugcacgucugagaccauacuuugagaacuacugcucuaaaaaugcggucgaucaguuugauugaaaguuacugucagaacuguucucugcugcugugcauguaaacucgcuguacugcauccuacauuaauucagaaagaaucuaguuuaucaaaacacacuguucuccacuugacaagugauuuccaaaaauccuuaguuagcauuuagcuacagcucuuggucuugagagcaauuaacaagaauuauuuaauucuucaugguuucucagggacugugaauggauaaaacauucuucacauaaaacaaagaguucaguucauaaugacagauucaagaguuguacccagaauagauguuggccggguguaguggcucaugccuauaaucucagcacucugagaggccgagacgggcagaucacugaagaucaggaguucaagauuagccuggccaacauggugaaaccccgucucuacuaaaaauuuaaaaauuagcuggacguggugacgggcgccuguaaucccagcuacucgggaggcugaggcaggagaauugcuugaaccuggaaggcagugauuguagugagccaagauugcaccaccacacuccagccugggcgacagagagacucaaaacaaaaacaaaaacaaaaaaccugaaaaaacaacgauagaguuaauaagaucaggggucuugcugaagaugaagauguauaguuuuuuuuuuuuuauuaaaguuccccuauucucccucaaauuaagcacaugcucuugagagaugugacaggcaaacaugaacaugggcuuguguacugccccugggaguguaaucuggaagaaguuuucuagaaggcaauuugggaauaguuauccaaaguuucacaguguguauacccuuugauccagccauucuauaucuaguggcucauucuaaggaaauaaucaaaccaacugcaaaagauuuagguaaaggguguuacccauaguacuggcuaucauuugaaaagaauuggaaaugacagaaugaccaacaaggagaacugguuaaauaaauuugguucaacuauggauuggaauauuguaaccaaccaccacaaaugauauuggggaugaauauguauaggaauaaaaauauuucaaaauauauuauuguguuuaaaauacacgguaaaacaguggauaugcaauauuuccacuucuuacuagaaaaauaguaccuacaaaugcauaaauaauuggucuggaggauuacacaagcauaagauguuaacagggaggaauuuaccacuucuaggugguaaaaucacaguuguuuuuauuucuccuuccuguuuuucuauuuuagaagugaacaguaaugaacguguauugcuuuuguaauaaaauuuuaaaaauguaugauuuuaauuaaaaaugccaauugcaaaugugugaaaaaacacacuguuugaaucuaucacuuauaagugcaacuucuguguuuuuuggggguguguguagccaucuugagcuuaugaagggacccacugaggagcuccuuccucugagaagaaagggguaguugucagcaaaugagaguacaggguauguuuggauuccuggcuuaguuccauuccuuccuugcggcgugguuagguacucaaccucccugugucuuaguuacuucaucuguaaacggguauguuaauauagcaucuacauuuuagaguugugaggauuguacaggauaauucagugccuagcauguagugaacaucaacagauuuuagcuauuacugcuuaaaaacaguauuuuuuuugguagagaugggggucuuauuguguugaacaagcuggucucaaacuccuggccccaagagauccucuugccucagucuccuaaagugcugggauuacaggugugagccaccuugcucggccagcuguuauuguuauucugaggauagaugcuuucacuuagaaagucccucuccaaagcaaagcacuggcaaaagagagcagaaacaaaauugaaaucugugugcauaacugaacacucuccaggcuacuugcuaugauggcagggaaauggugguugcaacaaugaacuuucaguggaucaauauaccugggccaaugagaagagacucaaucaaucaacauguuuagaaagagcuugagacaagugggaauuaaagacagaagcagcccaggaaaucuuucagugaugugaaguaguaaggguguuauaugggagaaaagcuagcaacaagggcuauaaaaaauaacaaagagaacugggguuugaagacaauauggaauaagaugguuggugcucuuuagccuucuagaguaggcccguaagaaaacauucacaaugagaggcugggcgugguggcucacgccuguaaucccagcacuuugggaggccgaggugggcagaucacaaggucaggaguucgagaccagccuggucaauauggugaaacccugucucuacuaaaaauacaaaaauuagccggacgugguggcggaugccuguagucccagcuacucaggaggcugaggcaggagaauugcuugaacccaggaggcagagguugcagugagccaagauugggccacugcacuccagccugggagacagucaaaaaaaaaaaaaaagaaaacauucacaaugggaaaggcacaugugagcaaggaucagcaauaaggaguuaccuauguggcuguuucuuugugggcauugcgauucaauagacacacaacacacauuuaugggcuuagaagcuguauucacuaugacucacgcaguauuugggagagagugaaagaaaauaauugaugcuuccaugaaauugggcaacagagaauuuuuuuuuaaagaugggaucuggcuauguugccccggcuagaaugcaguggcuguucacaggugugaucacaguacacuacagucucaaauuccuggguugaagugauccuccugacucagcuucccaaguagcugggaguacaagugcauguuacugugcccagcucaacagagacuuuuaaaaaaauaguuguuuaaaaguuuuuuuucccagucugauuccuaagaaguaauucuugaaguuauaucugaaaaugacaacuugucacagaaggaauuuguaugaggacagaggaacaaaacaugauuuuaguuugagucucuucuaagaggaaagaggcuuuuacauuuaguauuuccaucuaauuuuaagaucuaacuuuuucaaaguuuuccaacccauucccucuauuguuuccuaaaacacauaaaaaagagaaaagucuuaauacuucaacuagggcauggauuauuauuuggaaauuuguauauuugaaaauucacgcuuuagaagugcuucuggauugaaaguuuaaaaaucauacaaauuaagaggaacagauucaaugagaacuauggggaaacuauccaaauccuuugggaaauaaaaguuccaagaccuaaauacacuagauuugcuuauuucugacuuaaaaauaaucuuaaaauauuuccuuucuuauaucaggaaggcagauuucuaccucaucuuaguugaaaacagauauuucuuuuuuggggaggauuauuuuuuaaaaauaucaauugacacauaauaacuguacauauucauggggcacaaugugauguuucaauauauguauacauuguguaaugacaaauagggguaauuaucauaccuggaaccuuaaacaguuaugauuucuuuguuuucagaaauucaaaauccucuucuagcuauuuucaaguauacaguacagcauuguuagcuacagucacccuacugugcaauugggcaccagaacuuauuuuuccuaccuaauuguaaguuuguuaccauugagcaacgucucccuauuccccuccuccucaucuacccuuuccuggcuuugauaaccacuguucuauucucuacuuguaugagaucaacuuuuuagauuccauguaugagugaaaucaugugguauuugucuuucugugucuggccuauuucacuuaacauaaugucuuccaggcucaucuauguugucacaaauaacagaauuucauucuuuuucuuucccugaauaguauuuuauuguguacauauaccacauuuucuuuacgcauucaucuguugauggacacaauuuuaaauaaacacuuagcuuggauccacaucuuggccauugugaauagugcuagaguaaacauggaggugcagauaucaacauacugauuucauuuccuuuggauauauacccaauagugggauugcuggauaauauaguaauucucuuucuaauuuuuugagaagccgccauacuguuuccaucauugcucuacuaauuuauauucccaccaacaauguacaaggguucucuuuucuccacauucucaccaacauuuguuaucuuuugucuuuuugauaauagccauucuaaauggaguaagaugugguuuuugcuuugcauuucccuagugauucacuuuggguuugcuuugcauuucccuacugauuaaugauauugagcauuuuuucauauacuuuuuggccauuuguaagucuucuuuugauaaaugucuauucuggucauuugcccauuuuaaaguugauuauuugucaacucaaaauggauuaaagacuuaaauauaagaccugaaaccacuagaagaaaacgcuggagaaacacgucaugacauuggacugggaaagaauuuuuuggauaugacuccaaaagcacaggcaacaaaagcaaaaauagacacaugggauuacaucaaacuaaaagccuucugcacagcaaaggaaacaacagcaaaggagacaucuuagagaaugggagaaaauauuugcaagcuauacaucugacaaggauuaauauccagaauuuauaagggacccaaacauugcaauagcaaaacaacaaauaauccuauuuuuauuacuuuuuaagagaaauuuccuugagaacaaacaccugugaaugauacuaaccaucaacuaugggauuagagaacguaagacugcagagaguauuaaauugaauauaauggcuuaccucuuacaguaacagaugcuuccuaauuguauauuuaauuagggaagugaugcauuacuguauauuagugaaaauuaagccccagggcaaaauucaggguucgggaugggguauggguaagccuagggaggcaaaauugaagagcagaaccucaucuggccagagcaaauccuucacuucaccaaaaacuguaugucuuggaaucuuugaagugggaguuauucauaccaacauaacaacaacaacaaacccacugaaaagucaaagcaauauacuuauggcuuuguaaaauccaguccuguggacacauuauuuaaaagugguaauucuuggccaggcgcgguggcucacgccuguaaucccagcacuuugggaggccaaggcggguggauuacuugaggccaggaguucgagaccagccuggccaacauggugaaaccccgucucuacuaaaaauacaaaaguuagccaggcaugguggcaggcgccuguaaccccagcuacuggggaggcugaggcaggagaaucacuugaacccaggagguggagguugcagugagccaagauugcaccauugcacuccagccugggugacaagagcgaaacucugucucaaaaaaaaaaaaaaaaaaaaaaaaaaaaaaagacuuccucucaagcuuggcaagcuuggcguuuggucgauggggacccauggggguucaacauguguaucaagaaguguuauuucugucuggggcccauccacccuggccauggcaagauguucauccgcaaugauugcaagguguucagauuuuguaaaucuaaaugucauuaaaaacuuuaaaaagaagugcgauccucacaaaguuagguggaccaaagcauucuggaaagcagcugguaaagagcuuacaguggauaauucauuugaauuugaaaaccguagaaaugaaccuaucaaauaccagugagagcuauggaauaaaacuacugaugcaaugaagagaauugaagagaucaaacagaaacacgaagcuuaaugaacagauugaagaaaaauaaagagcuacagaaaguucaggauaucaaagaagucaagcaaaacauccaucuuauccgagccccucuugcaggcaaagggaagcaguuggaagagaaaauggcacagcagcuacaagaggauguggacauggaagaugcuucuuaaaaaucucuguaaccauuucuuuuaugaacauuugaaaaugcccuuuggagacuugaaacugcuaaauuauuagcuuauuuuuuacauaaggccacuuaaaugaaaaaugauuaaaauauauuuuuccuaccuugccaucuaauggcacuaggcagcauuuguauaauaacuaauggcaaaaauucauggcuagugauguauaaaauaaaauauucuuugcaguaaaauauucccuuuauuaauguuauagaagggaggauacaacaaggaacuaacaauuuguaugacagugucaaauauuauuuagauuuuagaauuuccuguuuugcuucauuugcaucuuagaagagcauaaugacauuguuugaugaagccuaauuaugcuggacuguuuugagcugguuuaacccuucugauagguaguuguggaugucgaggaugagaacugaauaaucuuugccugaaaucacacuacacucuagaauuuccacucuggagaauacucaguucuaacuugugauuccugguagaacaaacuuuauuuuucuagccuagcaaugaucuagaagcagaggaaucccagugccuuuuaaaaguuauuaugugguuuucuuuuaaaaagcuccuguuuuuggaaaguagaauuucuggguacaacaucuguuuauuauuugcacauaaaauaagccauuuaaaaagugaaaaaaacaaaacaaaacaaaacaaaaaacaaaacccagggcaaugaauguuccuggcacauuggagaggcaguccagucucuggauucacaguguggguaguggaguggacugccugguuucaaauccuggcucugccaccugcugucugugugaccuugggcaagugacuuaacuucucuuggacuuuguuuucccauauguaaagugggagcaauggcaauaccuacuguguggacugagugaacuaaugcacauaauucaguugugcagggcaggguguacagcucucaacugcuaccuguuauuagcccuaauaaacugauuuuaggagggcaugaguauaugucauuuuuaagaucgucuauuaugaucccuuaggcugauggcaacuugaaagugccucuaugguaauacuucuaccacuuugggguaauuaaauguucacauguugguuuccuccacuggauugugaacucgguggauuuuagucaucuuuguuaacaaaguacauuuaaggaaacauugaucagaauugggaaccacagugauuuacuuauuacugggagagacauuuucauuuuggcuaaaaugcauacuuugaacagaaaacaucuuuuuuucaauuaaaagaauaaacagguaacucuuaaucuacaauacuuuggccuaauaauauuaccaugaaucaacuuuuuagaccgucuguguccuaaaguauuuuucauggggaguuuugauugaacugggacuuuuggcugaaaugccaccaugcugagaacagagaaaacagcaacuugggguucaaacugaaaauuagcugcaaguugagaucuacaucauuuauaguuggugaaaguucuaauucacaauagaauaguuccagauagcagaucaacccuaugcuucugguuuugaaagacucuggugaaauguagugaaugcaaccuuagcuacuuuaucaagaacugagacuuacuuaaucaagauuggaaauaaggguuuaugauaguccgagaaguaaugaaguuucuauuuucauguaaacuacauaagcaccaagagcagcaaaccagaaaaaugccccccaaaacagaagaauggcuucuaaauauauguuuuuuucuaaguuucauuuuaagcaacagacaaggauuuaacuaaauuauucucuacuuaggcuacuaaaauggcuuuucuauugcuaucaggauguaauuucagauccacucaauuucaugaaauugacugagauucaaaucauacaucugguauauuuuaaaugaugcugcaugcacuaggcaauacugaugcugauuaucacaccggaguagcuggucucagguaauuuaguuaagaguauuaaaucagagaugcccaauuaauuuauuagacauguucaugaauauuucuaaaauuauuaugaggcuugaugaaugaaaacuuucccuuuuucuuauuguucauuggugacacaaauuaggccagauaaauauuuagaauacaagauuuccagaauuauaaaaccagggagaacucuaaaguguaucuagucuaauguucucauuuuauauguaagaaaacagaggaucggggaaacaggagaauguagugguuaaaagccugggcucuggagucagacagacccgaauuccagucucagauuggcaaguuauucccugugugaccuugagcaaguuauucaaccucuguaagccuccauuucuucgucuguaaaauggggacaauaauuguacuaggggacacuguaaagacucaguaaauguuagcagcuaucauauuauuuuuaugaauaacaggugacuccuaaggcaaauaaccagccacggaacuaaaacuuagaguuucugauauauacagaagcuuguuuuuuuaucuaaacucaguaccuaaguuaaauauucacugguacugacaauuuaaguacugucuaacucugcauuaaauagaaggauaacuauuucagucuuuuuugcuguugaauugaucaaaauauuagugauuacauauugaagucucaauuucaugaagauucacacauauuuagcuuuccauaaacaauggauauuucauguuuaccuucauagcuguuucaguguaauuauaugcucuuaaauuauuuuccaccaaaagcugcucauauaaaauaaacaacaagguauauuggccauaaauaaaaguuaggauugcacuuacuaaugaccuuaaauuugacuuuaguuagaugcuauauugaacaagucugauauucucaauuugugcaguuacucagauaccagcauagccucuauacaccuguuauggaggaagcaagaacaagggacacguacaaaaggaaaaggugggucugcaauacgaguuagaguugcuuuggcuaaaauagacuccuaggaaucaagcagccacuaaucacagauauuuggaauugccauuuuuuuuuuuuuuuugagacagaguuccacuugugucacccaggcuggaguacaauggugagaucucagcucacugcaagcucugccuucagguucaagcgauucuccugccucagccucccaaguagcugggauuacaggugcaugccaccaugccuggcuaauuuuuguauuuuuaguaagagggguuuugccauguuggccaggcuggucuugaacuccuugaccucaggugauccacccaccuugaccucccaaagugcugggauuacagacgugagccacugugcccggccuggaauugccauuuuuaguuaacauuugcccuuaaauaguucauuccacucaaaguugaauuuaaaaaaauaaaaaaaaaaaacugaguaagaaauugcauaaagaauauuagcuuuauauaauaugcucuuaauacuucugcuuuugauaauuuuagucaauuggugauguuuucaguaaauauucucagacuauucagugcgugcuuaaaaccuuuuguuguaauaaagaucauuuuucuaaucucgaaaaugauacaauuaauuuuaaaucuuuaaaaauaauuaagaacaaauauaguacaaauauagcaaauagacauuaacucaaacuauagugagauaaguucaagcauaaacaugcagaaagcaagagcaccuuuuuauguaauaccaaugugauucagcagaccaacagauggagaaaauaguaauuugaaagguggcaauuuguauccauacccaguauuuaguauuucagcuacuagaaauaaaguaguuuggcagacuuacccgcauuuuugcacaagcaucuuggguugauucugucccccuaagcucuuuuaucagcauagaaccuaaauacuaaaauacaaaaaaaauucaaugauuuaugaaauggaauauacauaugaguaauguuuuaaaaacaaauuguggaaguauuacuggcuagguuuccuggcuguaaguuguugcauaacuuuaaaaaacugacaguaacuaauccuaacaaauaaaugcauucauagagaaaaugcagcagaauuaaccauaaguucugggggcuguaauugcucuuuauaaugaaacugcaacaucuucuaaagaugccaucuuucaaaucauauuuaacugcaaaaugggggcaucuaaaaauguuuuccccuuuuuugaggcagcaaugucugcaaaaauaaaucacacuacuaucucuguaauuacaggguugcaugagacagcugagaagcuaagcaacaugucccccauuuaggcuuauucugcugcauagguaauuaauguuaggcuuuuaggcagagaugcaguuuuggaccuuuuucauucacagcugugugcccuaugguugauccaccugagaacgggaugggaggguggggggagggagagaggcauucucaguuguuucccaggggaagagagcuggguuccuggugcgaagugccaccuggagggcugaauggagcuagaaggaugacagucucccaagaauugccaacuacuuuguuguuagaagaccagaccccauacuguaucauccugguacaaaaugccccucgugcuccagcuucuggcuggggccaaaugguuuuaaacaaaaugucugauuugccuuucuaucaauugacuccccuucaaccuuuugaagcuuuaguaggguuuuugccuuuugucauuccccugccccuugcccuccccccaccagcccccaaagagcucuauauauguuuuuuaaaaaagugaauuacaauaauuauuuuagaagauaucugauggacacuuccugacaagacuggagacuuguacucugcagagacggggaugggaaccacucuuguggacuagggaagugccugacuugaagaagacgugagagggcacaacagcagaaggcguggucagggccuuggagaaaggcauguucagaaaggcuuggggacuugggguuuggagggaggagccauuucaauccuaugguuuugggcaguaccacugaaauaaauccaaagcugcaauauaaguaagcuuuaguaaaagaggggcagaaagcagaaaaugaaaaaaaaaaaaaaaaaaagcucaacugguaugagauaaccacaauguccaucuaaaucaaaugaaggugaaauuuauuaucuuuugguaaaauccuuaucuuuuaaguuaucagggaaguuugccugauugaaauguuucuuuuuaagagaggcaguuucaaugcacugcugaagguucagccacuuuuucugcugucgucaagacaaccaccaccugacccaaaaccuacaguaucuuuugaacauuuaccaguuccuauuacauuucucagcuaauuauaauuaauuccccucuucuaaaaaacuaaacaacuaaccuaaacuaaaccaaacuaaacuaaacaacuaaaacagaaaaauaguauaauccuauugaugacagugaaaagaaucugguauuuacauaaaguggcagacccaguguuuugagacccaguguuuggugagugagcagagauauauauauauauaugccauauuuacacucauuuccauuuuaagauuguacguuauaacauuuauuuaaaaauauacaacuauauaagaggucacaacagaccuuaaacuuacaagauuaaaacgguuuuaaagcucuaguuauuuggacuuucucuuuggauagaaggcuacuuuaagaaaaagugaagagaaaaacauuuuaaaaauuucagugauggauauggauauuuugguauauuuucaauguaaaugcaaacaagcugaaaacauacccccuaucuccacuuaggcccaaauacugaauugaggguaacuuacaaaagcuuuguaaucacacgacuggaagauaagcuuuucugggugaugcugccaguacuguaccgggguagaggcuguggcuucauucggaggucgcaagguaauggaagguucuccccagucuccugucugaaaaugacauuuauucuagaggcaauaugagcagucagcaaaguucauucccuguagcuacccugagcucaccuuacacacaggugcugugaauguaccaaaaugcauuugggugucuuaugugaauauaaauacuugguuauuacauuuuuauauguauuagcauaucucucaaggcugaguuaauuuuugagguguggaguugaauuauucuauuuuuagaaugacauccuaagcuaagucacuuuaaaauaaaacaugaagauauucauaaaugauuuacuaaucacaauuuuccaucacaacagcaaaggacacacaaucuuuaaaagaauuuuguuuuuaaacuugacugaaauuuuuaguuugaauugcuuucacauucagaacacacaguucuauaaauuucaguucccaaauaugacauguacuagccacuuugaauaauuuuagaucucuggagaaaugguaguguaagcaugaugcuaaacaaaauuuaaaagaaaaauuuacuaaugggugacacuaauuucucucaucugaauucaauugcacugauuuaaugaugcugucucagauggauucagcuacuuuucucagaaaaccuaacguaccaaugaagacuaaacagugaaaugccaaguuuggucacauguacauaggcauguacuuugaggauucugauucacaaauacaagcacauucccaaaugaugguauaucauaugauacagaccuaaaacaggaggaccucccaucauuucauuuaucauuuuccaugagguuagccucaaccuguuucaucaguauaauagcuuaaugugagcaucuauaaagucaaaggccaguguuggcagguauuuucugggcucuacucugauuuacauacuacgcaugagauauuucuuacucuuucuccugggaaagauuuggauuuuuccaaaacucaguucuuuguucucaaguggacauaacuaaaacuaaauaggcagauuucuagagugacucuccucuaaccuagauuuggcuauauauagaacuaugagaaauuacuuuucucaggaguuggaagaguguaaaaaggucucauaaacuccaaaaucaaauaaaaccuugguuagagaacaaguuccacagaagugcuagaaaguguguugacacacugugggauuucuuaaggagaauuuuuaaggagucuaggacaagaaugcaaaauuuuggaugcaguuguauguuuugggagagaaaggaaguucucugcuuuauuaaauucuuugaaagaaucuagaaacuccaaaagauuaagaaccacaguucucuaggaauggcguacauagggugcauauuuuggggaggagaacuagcucuccaauuuucuuugcgcacuuuggacuuacauuaggugacauaugaaguagcugccaaugauaaaaagcccuuucuagaggacuucaguaaugcacaggcuuuuuuuuuuuuuuuuuuuuuuuuuuuuuuuuuuuuuagcaguggagugccugaagcuuuucuccuugagaugggucacuucgacucgcagaagagcaaaguuagcaucacgcuauuuccuuggcuucucacuguaguuagugugugacuaguuggaacuccuucggcuuuucucuccugcucuguucucagccacucuccacauuaguuuuguuuucguugcugauuuacuuuuacauugcuuaauccuccuauucccugucuguugguauuuuuuauuuuuguacacauuuaugggguauaugugaaauuuuguuacauguauauugucuguugguauuguuaagacuuuacuugcaauauuaacuuuagcauuuuugucuguuuuauuauccaucccugacucauucuugaguuuuucuuuuauauuuauaugaauuuuuaguuuguaaaagugauaacugacugcaauucuaaaauuagauuaaguuuuucuuuggcuucuuauuuugauuuuuuuucuuuuccuucuuucucaaauggcuggcucuuuauucucucucuggucuuuauuucaucuggcuguaacuuacuuuugaaaaacuaguauaaaauucaaaauauaggauacguggauuucaauaucauuuugaagcugaguguaauaaccuuuaagugauaauagcuuaaaauucuggaaacaugcagcuauggguucuuaaacaaaagcuuuacccaaaucuaucaaaucauccucuaaucucccccauuaaacuucucccuccuucucccgcucccuggauaaagcaacaacaacacggcaaacagguauuguacauuuaagucacagguaacacuguuaacaaaacaacagaaguuugcaugcaacuccguggaaugauacaaaaggaggaucuggauggcuuccaaagauccuuugauccagugucugcugaugugacaacucaaaccaagcaucagaucuucaugugaacccuauuacaguucagcagagguagaccuuggccaagcucaacagguaguuuucaaaaaagucugaacacggcaugagcugguggugccaugaguugcagggccagggcugggaacagggcugggggugggaaugaguugggggaagcuaggguuaugaaaacauuucacguguuaguacauuaagcaugcaaaucauaugcaaauucauucucuaauuguuccauuaacucacacacuuuuauaauuaaacuuuaaugugaguuccauacauuuaaagccagagccacagccaaaugcugauccaaauauuuacgucauccacauaaguuguagcagccauugugggaauaacaagccccagcacauacauuccaaucucggucuggaaaucacugaaaucccuuauuugauaaccacuggaagaaauuaguggaacauccacuuaaaucuguuuagacagcgccaucaucugcucucccaugacuccacuuuguccaaaaucacaaaccacuugcuuugaauucagagugaucugauaggauuuucccuaggugcuaaggugggagauaauuacaaggaaaagaaauauaauacuuauuucauuuucuuuguggccuucaaauauugcuucaguccaaauauugucaaauucccuacagggacugaaucuaccuuucuggaaagagacacugaauuuuaucagauuuagugcuauuuccagaaauucauuuuuaaacagagggaaagguguucuuaagauugaauuuauuagaaaauaaauuucuuuucugccuggaaauucaucaacuucucuccccaccccugccuauuuuuuuuuuuuuuaaacuuagaucuaaaaguauuuagaagacucaauuuguagauguuaauucuucuuuuuggaauuaauuuaaugggaauggauggacuccaacaacuggacuuaacauuacacugucguaaaggacagguaugaccuuggcccuuggcugggauucagcuguaccugguugacucccaguaagaacaaaagaguucagagaacaagggugccuuaggucucaacccuccuggaggcugaauuacagcaggaaugagcuauggaggaauuacguagaguaguuacuauauggaauggaagaagaggucaaaaaagaaagauuuuugccucauacauaaaaucauuuugaacuuugaagccuaguguuaggucuuguugacuaguacauucaugucuacauaauacuugcaucuccucaggcaaauauuuuuaaauuuaguaauuuuccacuuaaaaauccuuauuaaauauuaaauaacagaccuaagaagucuuuugccacaauaaugguuuauaaucaaagcuuauuuuuaaugaaaagcagaccuaaacacagcuaacaacgcaauauuucauuagaauagcaaaaugaaguaggaaaaguuuaggguagaauucugucauauuuuaaauuauuauugacacaguggucuuugaaaggauuccuuaaguaaucacaaaugagaaaucaaaaugauucaagguacuccuaauaaaugucuucaggcuaucucuuuggcacuuaaaauauuuacagaaaaucuuuccuuuagguucauguauuugaaagaucuucauauuccaagaauuuugucauggcuuaaaacuucauuuauuugguauuuauuauuauuuuuuauauguaugcuuaaggccuuuuuuuuuauuaagcacacuaaagaacaucaauuaaacagaggaaaauguacaucauuagcucucuucuucaaacucaaauaaaaacuaaacuucuaacauaaaggaaaaauacuuugacauuagaauuuuaaauggagaauugauucuguguaacacauguuugcaacugccaacuauaaaucuguagucugggugagucugaaggacuauaauugggccacaucuaauauaauguaauuaaauuaaacauucucuuauaccaacaacugaaaaauacaaaagcaucaaugggauuuaguuaaaaaacaaaaagcuucacaaaauacagagauuuuuacuggauggcagauuccaaauugcagcuuuuaaacuuugcauuauuucaacaggugguaaauagcugcaaauuuuuaguucacaugcacuggacaccuacagcaaauucuaaaacaaauuguaucagguagcugucucccuccaaaagggaaacugaauauuacauauucuauaugcucugagaauagaaaggaaaaacccuucucuauguuauuuuccgucuuuauuauuauuuauuuuuccaagauggagucucccucugucacccaggcuggagugcgauggcacaaucucgguucauugcaaccuccgcuuccuaggguccagugauccuccugccucagucucccaaguggcugggacuacaggcaugugccaccacaucuggcuaacuuuuguauauuuaguagaaacaggguuucaccauguuggccaggcuggucucgaacuccuggccucaagugauccacccgccuuggccucccaaagugcugggaauuacaggcaugagacacucuaccaggccuuuauguuauuuucuucuuaaggaaaaaguuuccuaaggaugucaguagauaauuaaaagccaugcuuacaacuuacuuuucuaacauuaauagaaaaguauggcauuuuccaagccuuguauuauucuuuaaaauuuuuaaaaauuaggauuuaauugauuuuuaaaaauagaaccuuuaaaaucuuuucuaugaggacugcucccaccuacuugcuuauaaauuuagaucugaauauuaacaaacauuagucucaauuucuucagaacacuuaaugaaaaacuaaaaugauuuuaaaggacaauuauuguuuuaagguuuuacuuucaauaauuaugacaaauuucagagaugggcuacccaaacauacauaagauauaugugauuacauuuacuuucuguaaucucuaaggcuuugaagaaugcuauacacagcucuaugcuuauaaauaugcauacguauauuugaaagugaauguaaggaaaaggcuucccauaaacauucacacauaaugaaagcaggauguuguaguuguucuuucaaaaaaucuucaagaaugaagaauucuaguuugaucaaaugcaguugguuauacugaauuuguuccuuuagaugaaaaagagcagagauggcuacuuacgaacacauaaaagcucugguuaacauuuaugaguccaagaggaacugcugggucacgugaacaccaguaccaggcaauguauagacaccaugguccucaagagccagaagucccaugcacaggaguacauaugugccugaugcagcaucccaaaaggcacuucacaaaaauacccguggcaucccuucacaugccgccccaagaaucugcucagugauucucaaccaagugucucaaccucucagacagcaggcuauccaaugggagaaauucaaaagggugugaaaauagaauaguauuuuaaaauauggaacauaaaaccccaaacauuuaaauguuuauuuuccaaauagaaauaaacuuuuucuaaaguaugcaaaggugaaauaugaacauuugaaaaucaugcagcucagaguaaaaugggucacaauuucauacaauuugcaaagaucaauucaguacugucaaauggaaaaaggcugagaaccacuuuguagcuguaaccgugccucucccagcucaccuccccccacauuugcauaaaauguauacagaauaacaugcaaaucauacucagaaauuucucacaagugaagcacaugaaucuuugagaaucauuagacacaaaggguugaagaguccaugaauauggggagguacaaaauggggaggaauaaugcugauauauacauguguguauauauauauauaucaauuuacccuuuucuuuuuccuguaaaagcaaguuuaacacagacgccuggaaugaaagccaaaacucacaugggacauauuuuaaccauacacuuuaaaaccaaguauguuucuuguuuuaggacaauguuugcacaucaacuaaucacaaggcacaguaaaugaaguauaauagacaaagagucucggagucaccagacauuacaaauuuucugcauugccaggacacaguaccuauagcuguugacaacacugugcaacacaguacauagcgcaaguucaggagaagaaaagaaccauuuguaaccuuacauuaugaaccugauggaucgcugagaaaggaaauccugcguucugauucguccauauuucacagacagacgacugcugauauaaacagaaaacuaucuuaucuugucaauauuuaaaacauggcagcuaccaagguagcauccaggaaggaaaagaggaaaauaauaaaaugcaaagaaucacauuuaaaaaaaacucaaaaaauguuuuagggugcucaagguuuaauaauugacuuccaagucauucuuuuugcuuuaaaacauuuugaguugacuaaaaaaaucauuuaugcauuuaugcaaggaaaauuaccaauaaauucaugccuuggaaaaaagcaaacuguauuuuauauuugccggaaaaccagaaauaccuucccccuucacgucacuacuuucagaggauaaauauuuucaucaacuucaggaaaaacaggaaaaaaccuuuaacacagguccgauauuuuuauuuucuuaucuucaaugaccaagagcaaacagugcaauaaaaugacuuuuccugauuuagucauugcucuauuugacaaaccuagaagauauuuaugccuccagaguucuuacgggcaaaacucgguaguuaacaaaggaagacgugucagcuugcuacccagcacugggaggagugaaggagguggcaggaaggaggcuggggcagggaagaacugaagucagggaaauucaguucuguuccucaagcagaaacccuugggaacagcauuugggagucuaaugauucagcuccauaauucuggcucucccccacaccauuaauaagauaaacuuaucaguaauguuugcucagaaccaaacacuaaacuaaccagcaucccuucccaggaguuacaguagaaaccuucaaagagaccgacugagcucuuggcuugacccaucccaaguucuguucccgaauuucaucauucuaaaagacacugugaaauuaaaucacagaaaauggcagagcauguaaacuuauucagcaagcucugugagcaucuuuagcauucacaagcaguccguacaaagaucacugcaggaagaaggcaagcacauaaccauaauaugguuaagaggcccggcaaagaacuguaucaucagcaaacaaaugauagaaaagaaggcuuaucccuagcuaaaaguuuccucaccccagaaacgcucaccagcaauuuaacaccucucucucuaguuacaacugcaucuccacacaccccuacaccuuugcuuuccaugucuucuguuaaccagaggcuugcuggggaugguuaaggaaguuagauccccagggucugaccaaaggcacuuccaaacaccuuucacuuaaaccagcucugcuauccucaguucccucucuaaacuucaugcuauuuuauacauccauagaggguucuuccucuucuuaccuuucuagcaaguucagucuuagacccauucacucuguuggccuugucuccaauagcucuccucugauuugaauguacuaacuccaugcguuagcuggauuaccaucuuaaguggcauccucacccaguccugagcuaauucuuuacacaaaucacaucuucugcaacuuucacacacuucuaguguuaaucuagugcuagaagugcuucuagcacuucuagugcuaaauaauccagagaccaccugucaucugauagaugaagacacagacauuuaaagaggugaaguggcuugcucaggucacacaggugaguggcacaaugugucagccugcugggauggcuaagaaggagugugagccugguacugaugucaccagaaggcagagggccacuccagcuauauacagcuugguucuacugacccugaaaugaacagaaacuaaaaauaaaaucguaagcccccucaccgacugaacggacccccuuguggccaaggggaccccagaaaaaccuuaaaauugaguuucugaccaugaugggaugggaggugagacaagccucauuauaccuccucuuuuucaugguuuagacacaacaacugaucggaauuaauguuaaaauagacaucauaagagugacagaacagucucuuuguggcuauaagauaccaaauuaucaacaggacccgaggccaugcuaggcaaagguuaagucacgcaccccuauaccuaaagaauaaacuauguuccaacugccacaagguuuuucuuuuucucuagcagcuaaacagguacuggccuuaagagaagcaauauuuaaacaauuugcaccuccaccagaugcugauugacccuuagccccugcuccaccagccauaacuacagcuggacaagagauugauucaguaacuuuauccaaauaagauuacuaaccauggacuaguucugguuggucuacagagauugcacacuugugugccuucauguccugaaaagcccuucugacgaacagggcuaacuguaauauaucuacauguuaagucuccaacccaaagugaacauaggccacauguuacaugcauguugguucaauacacaugugucaggaccaccuucaugaauauucacagcucuuguaacacauugaauauauguguuuagcuaaucuguucagcauaaaucuucuaccuaagcccuuuuccuucgaaguacccgucucuggggucuugguuggaggugcuucccagccugcgggauggccaucuugcaggcuguaacccuuuagaagaaauaaagucuccucuacuuuacuaaauucauauauauauauuuaaguuaacacaaguauaucuaaaugcaaucaguucaugagacagucuuaacugcacugggguccaaacaccaaaaaguuguuuuagguuguuuugguuacucccaaaggggccaugcccagucugccugccugaugggcacaaggccauuuaaccuuuugggcagacugcaucacuuccuggucacuuugagucaugaagacuccauuuuguaugaaauccaaacucauaucugauucaaacuuuuccuucccuccuugugugucagucuuggggcuuaaaaagcccgggguggauaagagaagcucggucugcgcuuugacuucuccuaggagaggugagggcaggugucauggucuaccuuggauguucccugccccaagcucuaccuacuucauguguuuaguuggggaggaagaaacaggaaaaggacgaggucccuuucuugucuggcuguuccucuggcagccgcacugcuuuucagcuaacguuaacauggucucccaugugcucuacguagcagcugcuccaaccuagguucuccuguguccccgugugauuucuuuggagagcucuucuaggauagagggcagguccucccacugcacaguuucugcuggcagaaaucugccucuagcuugacuucuuccaacucccacucagcccuccuaggacacaugcaugcccccugaaggggacccagggggacaaacauaaccccagacuccuucugcacauccauguggcccacaugauauggacacacauccuugucacacagaacaguagaagggcgggcugcucugugaacacucccccucucugccagggcaucccuccccaagacucucugugucagcucgguaggugcuaugugaccugccuggcagaaguccaauuauggauaccaaggccaguuuucccuccugcaggcacccccaagccagauguacauuccuccuggaccccuucucaccaggauuggagagcacgggaaugcauucugucuccucucucauggcaaaggaggaaaagccuuaguucuuuccacaggacucagacaauucccuguccuucuccagcacuaaccaauguucugccuauguggagagguagcugacaggggcagggcaggauucacacugccuccuuguaaaccccgaacuaggugucuggcuccaugauugauagcuuucucuuuagggugugcagugcuuaguaccuacaggaaaauucccacuuagcauccugggaauagaucuuccaauagugaauagaucuuucacuacucacagaaauuuaccagaguuaagaagggaaaagaggauccuacgccauacuuauuucauuaaaaaaaaucauauaaaauuuuucucaaugaagaauaaagaaccuaccccuagucauauacacugagaguucauacauggcuuauguacauuuuuuagauguuauaacaaauauuuucuauuuauaagcuauguuguaaauuuagagaaaguaaaaccucuauaauuucuaauaccgucaugcacaacauaacgauguuucagucaacgacagacugcauaugcuacaggggucucacaagacuacaauaccauauauuuacuguaccuuuuguggggguuggaagaaguaaagcuagagccagacuuagguauguuuagauacacaaauacucaccauuguguuacagucaccuacaguauucaguauaguaacaugcuguacagguugggaggagcaauaggcuagaucauauacagcccagcuguguggcaggugacaccaucucacguuggguaaauacacacuaugacguuugcaugacgaaaucaccuaacgaugcauuucucagaacguauccccaucauuagguuaugcguaacugucaucgugucagugcaagugguaaaaagucagaauuuaaaagaguuuaaaagcaguuguguuugaguugugaaaauuauuauuuuauuuuuuuugacacagaaccuuugcucuguugcccaggcuagagugcaggggugcgaucucggcucgcugcaaccuccgcuuccuggguuccagugauucuuguaccucagccacucgagaagcugggacuacaggcaugugccaccauauccagcuaauuuuuauauuuuuaguagauaugggguuucaccauguugcccaggcugguggucucaaacgccuggccucaagugauccacccaccuuagccucccaaaaugcugggaugaaaauuauuuuuuuaaaaaaucggaugcauuccagauaccgcaguaguuuuguuagcaguaaauaauuugucaggcucacagagcaagcgacuuaaggcagaccuguuguaacugcugcauucauaauaugaaauggcucuucuccuagacauagggucauuauacugagugcuggaauuaauuuuuuaaauccaagaguuuccagaguagaaauuaauuauguuuaugaaaauaacauuucaggguaaaacauguauugaaguacugaguuuugaaaaguuuugagaaagaaauauaauaccagucauaaaauuucaucuggggcccaaauuccuagaaaaguagugaguuaaguuuuuuuguuuuuuuuuuuuucuugagauggagucucauucugucacccaggcuggagugcaguggugcaaccauggcucacugcagacuggcccuuccaggcuuaagugauucucucaccucagccucccaaggagcugggacuacagggaugcaccacuucaccuauuuuuuuuuuuuuuuucuaaauguguagagaggaggucuugcuauguugcccaggcuggucuugaacuccugggcucaagcgaucugccuucuucggccuccggaagugcuaggauuacaguugugagccacugugcccagucuuaaauuuaaguuuuguuuuuuuuuuucuuuuuugguggcauuggagacagggucuugcucugucacccaggcuggaguacaguggcacaaucuuggcuuacugcaaccacugccuccuggguucaagugauucucucccggguucaagugccucaaccuccuguguagcugggaucacaggugugaaccaccucacccaguuaauuuuuguuauuuuuaguagagaugaguuucaccauguuggccaggcuggucucaaacuccuggccucaagugauccaaccaccuuggccucccaaagugcugggauuacaggcaugagccaccgcaccuggccaaauuaaacuauuuuguuuuuuuaguuuuuguuuguuuguuuuugagacagagucuugcucugucacccaggcuggagugcaguagcguggucuuggcucacugcaaccucugccucccggguucaagugauucuccugccucaaccucuugaguagcuggcauuacagaugccugccaccacaucuggcugauuuuuguauuuuuaguagagacagguuucaccauguuggacaggcuggucuugaacuccugaccucaggugaucugccugccucggccucccaaagugcuuggauuacaggcaugagccaccgcgccuggccauaauuaagcuuuacaaugucuucaucuguaaagaaggagaauaguacuugaccuacuuauuucaccaaguuguugugcagcuucacgagagaggaaacuuuuucacagcuaaauguuuagggcuuggaacacagaaggaacacauuuuuaccgaaugaauggaaucauauaacacauucaaaaggccuugguaaauggcaaagcauuaugcaaacauuagucacuaccguuauccguuaucauuuuuaacuggucuacucuauuggugccacuugugccuuucauaagcuaugucacugccaacacacuuccgguuaauuguaccagaaacugcugacuuccuauuggaagauuccucauauuuccugauaaagacaguaaagggcugccagcuugccgaagagagaaggaacauuugucauuagcauaccuaggugucaaaaggcugcuuguagagcuuagaaacaguuccaugaaagaauguuaaucaccccuuugcaauuucauuugccuauuuucucucaaucccugucacauauauugcaaagccucauuuaguuuuucugaaccugaauuacuaugaaacccaaacaaauagggguaaguaaagguagacuuacaacugagauauuaccaauaauuuaauguuuacuucuuugauggugaagucaacacacauuugaagguguauaauuuuaucuucaguucagaccucucucuuagcucuggaaauguuuucuuaaaaugcaaugcaugucucgcucuuguuaccgucuuauacuuucgguuaccaugacuucagcucagaaaauacaacacaacugcauucaaaucuaaucacaaaauaaaaagaauauaaccaauuuccaaaguuuuccuccuaaagguggacuuccuuuuugauccaguaguuuacaauaaauuaucuccccuucauuaugguuuguccucuuuccuggagcauucucagaaauugcuauaacaucuuccaucaaaagcaaacaaacuccuucccuugccccaacaucacccucgguuuccugcucaauuacucuaaucuucuuuaagcaaaacucccugagaaaugucuagauggucuccacuuucucuuuuccuguccucaucugagcccacucuacugaaacugaaacaauuuucuauuuuccuugaccuaugugacacccuugaucacuccuccauuccuuagccucuuuggcugcuuccuguuaucugagcaucccuggaguguuaguccucagucuucccuuccuucuuggcuauacuagguggucucuuccaguugugacucccaaauucauauuuccagcccagacuucuucccuaaauucaagacuuggacacccagcugccugcuugaugcuucuccuuuugcauuuauuaaaucagcucaaccuuaaauuaaaugucagagaccaagcuccugaugaccucaccucccugugagcuuccuuguuuuggcaaauggcagccauuuuuuuuccaguuccucagguucacaaugcuggagcucuccuuucuccuguaucucgcauucaauccagcagcaaagccuauugaaucuacuucuaaaauuucaccuuccugucacuacuugcuccaagcuacucccuuuucucguuugauuuauuccauuggcuucuuacgggucucacugcuguuauccuugccuccuuaguaucucuucucaguacuacagccaaaaugacccaucuaaaaugaaagccaggucauuccacucagcuccauucaacacagaagauaauucaguccuaacaaugaccugcaagguucuccguucucugguacccacacugcucuaccucccuacccuccucuccuacccaucuucgucuugcugucuggguucuugacagcaaagcacauucuugccucauagccucugcauuugcuucucuuucugccugacauguucucccucuggcuacuauaggccuagcuagcucccucacuuccuucaaguucuauucuaaugucacuuuuucagagaagccuucccuaggcauauuacauccaaauuaagucugugcuuuccacucuauaaaagaauuauucuuucaagcagaaauuauuuauuuauuuauuuguuuguuuuugagacagggucucacugucacccaggagggagugcaauggcacgaucuuggcucacugcaaccuccaccuccuagguucaaaugauucuugugccucagccucccgaguagcugggauuacaggugugcaccacuacaccuggcuaauuuuuguauuuuuaguagagacgggguuucgccauguuggccaggucucggacuccuggccuuauaggauccccucgccucggccucccaaaguacugggauuacaggugugagccacugcaccuggccuuaagcagaaauuuaaaauguaaaaaauguuuggcacauaagaaccuaucucccugucacccugacauucaugcaaaaguaguuacuggucaucuacugugugcaaggccugggucacaaagugaguagggaucaaucuugcuuuuaaucaacguuuauggcaugaaaauugcuuucuccguggacagaaccaguaguaaacugggacugacaggcugauggugggucucagaacagagcaaguagaugacagcuccaucaacucgauaaccccuauuaagcucuggaaagcuucugggagucugcugauauuauauagcuaaucuaauaaagaaacuuuuaugaauagagcccuccagucagauucuaccagagaugaaauuuucugccguguucuagcccugaaaaaaaaaaagaaaaaaagacuuuuucucuguuucucccuuauguuugucauaauacuuucaacacuucaggguauucagaaauugaccagaaagaaaccagcaagaaauaugaaaguuucagagugaaagcucaaggaauaaugaagugcauuccuucuucuggaugauagugcuucuaaaagaaaaugaaaacagacuugaagagcaaacaaaacagcuucaaaggcagaagaaaaaagggcaucccagcaaaggaagccuuagccaauagccagcaaacucaguggcuccuugagcagagacugggaugaaaugagaccugucaaaggauggagucaaacaaauucagugcagucaagggguaacgcaccaaacaccuuguaugcauauuuucuuucagcagugacagccccacaguugcuucuucugugggcauuaacugaacccugccuggaaaaucagaaaauuagagccuuuuguuucuugugaguuacccagaggccgcaggccagcaucugauuacuucuuccugcccaccaucggagacagaggaacacuccuccuucucaccucuugagugaguuuugagauacacacucaguccuguaacaacugcaugggauuuagauucuucucugcaaccacacuguuagcuucucaaguucccugucugugucuauuuauuucuaguucuaaagugugaaaaaguuaugcaugcacccacugacccuuuuuauaaaaggucucagcugaacuauuucauuugcaggaaaugcuagagucaagaaaaugcugcuuccugccauuucuccaucuuucugaagggcaauccuuccaaaacuucaugaucgugaccuuccccugugccuguggggaggauuuuuggacagaucaguuaucaccugcugggaaggaaaagccaggccaacaguuguuucucuaacaacaucugcacgugugacccaugauugcuggagucagcauuaaucaaccuaccaagagugggaggaaguaaacaacacauuugguuccaucuaaguccacuggcaugauauaaauucuaacacugucuucccaaguuuaagguuuuccuuccauucccuuuccaaacucccuucccuuucccauuccucuccaguucccucccucccucccuccuucccucccucccucccuuccuuccucucuuccucucuuccucccucccucuuucccucuuucccuuccuuccuuaacucuaauucugggacugauaucacauaaaagaaguccucggcuacuaaaguaggagagaaggagagaacuauaggcuuaugauauuccuguuauucauuuguagagguaauauauaaccuguauucccuaauaugacagcuguagcccuaaauggcauuacacaauuguuuaugaaaucccuuuacaagaaaaaaauagagcagaggaaaaaaaugagcauugccuguacaauccagcucucauugugcagcuccccagguuccagggauguugcagggaauuugagucaauugggaucaugcuguuuauagcaauaugggcuguuuuacuuguucuaccucaaagucuggaugcuaucaaacguuuuucagggccacuaaaaagcagaacauuaauaacuaauucagaaaggcagugaucagcuuuuuaucauaacaugaauggcugaaaaaaaccuagauuuugcaaaguaauguuguucuuuguaacaucucuuuacaauauacauuauauuccuuucuugcaaagugagguugucauuuccuuuacuuaaauucauuuauuaacuggagcccgacuguuuguuuccugcuucugacagaaaagaugcauugggcagagucauuuauucaaugauguuuauugagaccccaccauuucuucauuuuauccuugugaaaaauaugaaaaaacaaggugcaguugaacaauccucuugaacgaugccaagcuaagaggucucuaguagaaagcucacaguuuuuuuuucaauucuacuuuaaucaacacuucacucaauacacugauggaugacuucaaagguuuguuguuuugagguaagauucuuaaaaugagcacauuacauaguugaaaaggaucacugauauacugaguggcaacuaagucuuagaaaggucuugauagacuaggauuauuggaugaguaacuuuauaaaaacugcuuuaucuggaaaaggauaauguaaauccagcgcugcugagaaaggaggcguagcuauugauaaaggcugggaaauuuucaugaagaaaagcacaguaagaaugaaugacauguuaauguugaucugcccagagcuggggaaccaggaugcuguacggcccacaucccccuuaucacaugggauuggcaaggagcuggagacauuuaauauagugaagggaaaauaucaaauugucuucagucuuaaaaaaacucuucccagcaaaagggagcagauguauucuuuguuguuucagaagauaucaugaacuauguaggaguuauagggaggcuuauuucaauucaauauaaggcaaaaguuauaucaacuagaccuuuuccaaucauggggcugccuuacaaagagcgggccagcuuuccagucaaguuuaggcagaaacuuguggcugucuguaaggauguauuagaaugggugccugcaucaauuaagagaugggacuacauacauuuucuggccccuucucaucuuaaaauucucugcuuuucuuuaacaguacaguuggucaucuguauucucaguucugcauucuucugacugcacagaagaaucuucuagcuauuaaugcauacagacaaaagcaaguuaucacaaauuuugugauccugcauucaaaccucauuagaauagaggcccauacagaaaggaggucauaucauuucacaaugcuuuacaugaagcaauuguuuacuaucucugauuuguaaagaaugaaaaauuggaugucaggagcaaaggauuuucuucaaauacaauguuuauccaugcuacuuuagagguuuaauucucuacugaaguugcauuuacauaagguauuagauauucuuaauaggauuuuucaaggaacucaaaacauugcauuggagcauuugggguuuuggaauuucuggaaugugccacguccgcuaguucccaguuugcagagacaauaugggguguucaucaacacugugguucacacgacagcugugaagcuaggcugcuggcauuggaauccugguucuguaccuuuuaauuuuuguggccgugggcaagccacauaaaugcuccaugccucaguuuccuccuuauaaagcuguacuaaucagugcuggcucugacgaugaugccgaugaaucaccaggccuaagcuagaccgaugauacgcuauuguuccaggcaguguauuucccuaaaaaacuggagaccaucucaauuuguguccaaucugaucugucguagagcccugugguuuuaugaugccuauagccuuacauaaaguaauuuggucaacaguauuuacagaguguuuauuuuagaggaauuaaaaaaugacuacggaagagugaggcauugcccccacauagccaacauacacuuuaccaaaaaagaagcaaacauuuaaaaaugaaauauaaugaaauauuuugaaauacacuaacucauaaacauccuuuaauuuuuaaaaguauuuaaguauggauaucauccauaauuccuuuuccaaagagcaccaguguuaacuagguuauaacaugaauaggagcuucuuggacaguguuugcuuucauaaaaacuaugauuuccaagucagugaagagguauuaguuugggcuuacaagcuggaaaacagaaacaguuuugcaagauguagcuaaacaugagauuuacuuuaaaaugcauuuacucccagaugcaguugagaaagcauaauguagaagaaaacuagaaguuaucucaaaauaauaacaauaauuucuaaaacaacccaaacguauaguuucauaguuuguaaaacacuucgaaaaaauaccauuuuauuugugccucacaacaaugauguggggugggcauuaaccucacucuaggaagagaaaacuaaggcucugcauagcuaagaagcguguccaagguuacagaggaaauagacaucagagaugggauuuuucaccaugaucucauuucuucaaaccuggcauucuaacaaagcucaucaaauuaaguaugaaaaaaugaaaucaauacucaucugauauagcaauuuuccaucagacaaucucagaauuccaaagucagaguggauuuauucagaugcccauuauugcuauuucugccugcuuagaaaccagccccucuucuagcagcagcggccuggcuguucaugggaggaggugccuccuuacuccucaguccacauuguucacauggagcuaaaaccaccccuggugugggaccucugucuugcuaaucaaucugucugucugucugucucucucucucugucucucucucucacauauacacaccccuuugcaauuagcucagggaaggacacuugauccaauccaggcucacuggaacugauggaacguaauacugagacuuuuucuuuuuugagacagagucuugcucuguuucccaggcuggagugcaguggugcgaucuugcucacugugaacuccgccuccuggguucaagugguucucaugccucagccucccgaguagcugggauuacagacaucugccaccaugcccagauaaucuuugcauuuuuagcagagaugggguuuugccauguugcccagccuggucuugaacuccuggccucaagugauccaccggccucagccucccaaauugcugagauuacaggcauaagccacgaugccuggccugggacuuuuuuuuuuuuuuuuugacacucuuggaaagauagguucucuuucuuguaacuucaaguuaaacagcaauuuggcuugaaucucuccacacggagagggaggcucuuugggaaaagagccaacacagaggacagcagagccaagagaaggagagccagagagcaaugcagcaaaacagcaccuggauccaggacuccugcccuuuucugcuuaagccaucuugaguuggauuuuuuguuacuuacaugcaucuggaaaaguccuugcugauaaauuacuuuaggccuauacgcacagaauuaaccaagacagggccacacaaacagcccuauuucuacuagauguuaaaaaaccuucuuuuuauuuuuuuuaccacuggaaaaagaaagggaagaaggagaaggagaauaagaaccagagaauucuccuacccuugaaaauuuagcaagggcagauuauaacagccaaaacugaccuguggacccaagaacuggacugcauguaauaagaaacauucugaaaauuuaacaaguggaaaaauaaccugcugggccucuuugugaacaagcugcucaaugucaacaagcccaaggcaccacuaaauaucacaaggucaauuccacugaaauaggguuuuuauauauugucagauuuuuuguuuaguuguuuugaaaacagaauauuuucuauugauaucuucuuuuucuuuuuuuaaauccauggucugguuuuaacugcaaacaggacccuugguuaagcaccagcacauggagacaagguggagacgucagagcuucucuagcaaaacgacuggagguguuuagggcugacgggucuaucagaaucaacucuggcuaauuugccuucuugaugaccuugacagggaagaaaacaaucuagaccuguaagaugaguaucaaagccugaaaaagaauccaucugagugauucucccacuucuuccaauuauuuguuuuaagacuauaguacaguauucacaagacacuaaucauauugacauuaguguugcccaaaagacacuuaaucauacuggaauuucuaaucccaaaguugucucagauagagcaggguguauuugcuaaaagaaaauuaacugaccauauuaauaaaaaagguguacaauacaucagguuuaaauuccaaguauggaagcgcuauuuuccacuuuuguguuggucauagcuggcuaguggccuagaguucuuggcuugaaauagggcacagauaucaucaacauuccagaugaucucugaagcucgggugucagcuugucaacuugacgagcugucaaaucggaagcuccugacggaagagcuuauugagugcacucuugaccuucuuuuuugguuauguaugaucugucugugcuuaaguauuaagaguugcucuuuagaccuucauggaaggaaauguugaaaucauggacaagcugagccuuucugaguaguggcuaugugaugaaaaucuaaauuaaaucuaggcauuaacuuacggacauuaaacaaaaaaucugaugugacacaguaauaggaaaacuuguuuaguuuggggaaaaaaacacucucuuuucuuugagacagagucucccucugucacucaggcuggagugcaguggcaccaucucagcucacugcaaccucugccuccaggguucaagcaauucuccugucucagcucuccugucucagcugggacuacaggcauccgccaucaugcccagcuaacuuuugagucuuuaguagagacgggguuucgccauguuggccaggcuggucucaaacuccuggccucaagugcuccgcccgcuuuggccucccaaagugcugggauuacaggcgugagccacggugccuggccaaaaaagccacuuuccaaaaugcuguuccuuucuugguugugcuauuuucugaaaacugauucuguaaauuccaguaaugccagagcaguggguagaauuucugggaacaacaggccuauucucucaggaaaaguauauaagaggagaaguuacuguccuacuucuuucccagacauggcaaaguguuugccucauggcuuucugggauauccaugcuuuuuaagcuaacaguucugugcacaauauauuuccauaaaguuccaaauuucacuuaaagaaaaaaaagcccucucacuugauauuuuaucuaacaauguuacaauaauaacguguuauuaccauaugauauuuuuuguuacaauuuuguaaccugaauugguagagaaauauggcauccauucucugcuuucccuggcuuugacaucauucuacccagaucccucugcaucgugauauaugcuccuuggcagaugauguguuuacacaauuaaaauaauaaaagaaaaaugcaaauuccauucucaaucuacaugcuaaauauggguaacacuggaacaaaagauggucuuuauagaaugcuacaaccaccggagcacuugcccuucaacucucuuugucauuaauuggccuacaaugagcagggaccuuugaauuagggacugacaggugaugggucugaaccgauagucauaucugucuauauagugcuuuacaguuuagaauaugcuuucauauaaauuaucugauacauacaggccugagaagcagacauuauccacauuuuaaagacaaaaaaauugaaauucagagucaccacauaacucgguccaggucacacagccagaaagaaaccaaaucagaauuccaaccgaagaagccacuaagaaaacagcaucgacuauuuggagaaacaccacaagcaagaauuuguuuguagacagaguuaaccccacaccuaccuacaaagcuuuucacaaacaugggagacaggcagcguucugacacacugugcagggucucugcugaaggaucaacaaauaaccagugcaguuuugcauuuaaggauuucaugguguuaaccacgaguugauucaaucaguuuccacuaaacuacugugauuuucucuucugcuugcugugcccacauaaauggaaucuauuauggcacaugagaaauuaguauuuguugaacuguuuuuaaaauauuuuauaucauuuuaauacagaggcaggcacagggcaucagggacuauagaagaacaaggauaggguuaggcaggccagggcuugagucccagcucuaccauuuaccagcugugaggccaagcacucacccuguuuggcagaugugcacauaggcucuugugaggauuaaauaagauacugcaugugcaaucccaggcaugaaccuggucacagcagugcuucuguauggcucagcuucuacuucccuuccuuuaauaauaucaaaacaacaaaccuuggaagaacuaaaauguaauauacaaaaugcuuucaaauagagaaguaauugaccuaguuguacuuauuaauacuauuuagauugagaaauauuaagcuugcaacugaauuaauuuucuaauaauuuagaaaaagugucuuuagugcccccagguaauacugcuuuuuuuuaaaucuuaggcaagagcauucaaaacauaaagauuuuauauuacacacuauucucacuaauauuuaagcuaaaguuuaugcaaagauaugcauuucuuuuacuguugagaagccuuuguuuugugaaaauacaaguacuauuucauuuucucauacguuuuucuguaaauggaagccuucuauaaauggcuuaacuugcagcauuuggaaacuuuuuuuuuucuugcaugaguuuggagaauguggccuuaaccuuauucauuccaucacucucuuauuguucauuuuaaggguacuucgacuucuaaauaucauucaagaaaacuucugaagacugcaauuagguccuaaauacugaaaauauuuuccuccuucugauauauuuuccauuuacuaucucauuuccacauaacucagaauuaaaagcugaucugccaugugcuguacacacauuaauaguguguaggacaccuuguuugugcuaaaaugagauaacagaugucaaaguacuuugagaauuuaaaaucacuaugcacauuaagguauaauuacacauaugugaaugcaacauuuauuuauuagggguguggaaauuggggaguguuucagaacuucugggcuaaugaguccaguuuagaauuacaggcuggagaagcuauguuuucaacaugauaggaaacccaucauucagauguauuuauaucauuacauucaguucaugcugaacucaaauuuuguuucuugcauauucauuuaaaauaauuugaugccagaguacugcuuauaucagaauaauagcaaacaauacucacaauauuugcaaauccccuguaucccaagacagguauuuuaaauauuguuucaaauugaaaaaaucaauuaaaccccauucuaguguuuuauuuuaaauaucugccaacaaauuuaacagguaaaauggacauuaaauuuaucucaauuuaacuuuaagcauugcuuuuccaaguuaagcaaagcaccuccaaacaucugguaagcagaccucaagaaggcaaaacuccuaaugaauuauugcggccaccaagaacuuaagguuucuggcccagggcuagaauuccaaaucacucuaaugguagcucagcuaaacuugaaguagagggguuucuaagaacauaaaucuguccaggugauuuucucucaacugcauucucauuucuuuuaguagguaagaaagaaagccugaagguggacuuuugcauuuuagugggaaauggacugguuaggcaagcauuaaccaagcuacaguaagcuucuugggagaaacuccuugggaaagaacuggaggaauggagcuccagguuggaaggagguauaacuggcugcuugcuugcaaaaauuuuaauugcuaauucaagucuuuaggaagacccaacucgauugucuaaacacauaacuucaggggaaaaaguauggucuagagagauaugacagguuuuuaaaaaaguauauaaauuucaaaaaguauuacagcaaaugaccaaaaauaagguagaauaagaaaaaaacaaacaucaauugaguaguugaguggugaaaagucacauaaauugaauuauucaacaacaagaugacagaguauuucauauuuugacagguuaaagcaguauuuuuaagagguaugcauucauugcuccauggguuuuggccuuccauacuagcgaucaugcucaaaacugcaauuaacaccacccagagaguugcaguuccagaaucccuuuuucucauugaucagauuccuguggugucaucuccuauuuucucugcagcagaagugcuguauugaacagcaggcuuuuagaaagcuucuaauaagcuccugauggcugauggagccugugugucuagcagucacucgaucaucguuaguacuccacaugaggggaaugcaugcgugcacaggugcucuaguucacuacgucccaucagccugcuuaucucacucuguuuucugcuuuuaggcuuuuuucaccuggccagauaaaagcccauuccauuuucucaaggcaagacaauucucauaagggaugcauuucugauuggagugacccguuaaaagauuugugcuauuugguacuacugccccugcuuucgaaaaccucaggcagcauguaagggugcagucuugcuaggccaccucugaguguuuauacauagguagaaggguaagucguuuuuuaaaaaaacccugcaguauauggagaaauuucauaaauuaugugagcagcugagagagguaauucugcuauacugcgguugacacagucaauaauagcuaaugcucauuaaagaacuauacucccuuacccagggaagaaaugggcucagaaaagacccaguucauauuaauacacaaagacaacauggcucaaaguuaaaacaaaccacaucucugaaaugcugucauuagagaaauuuaaccacauaugugacucgaaaauauaacaaguaacgaaauaaaugaaaaguuuggggggaaaaagcuuucagaugcccuauuuaaaagagcaccagugaaaacaguaauaaaaauuaaaagacaauaccuagcaacagagaaagauaaaauuauucuuauuucuccuauauuuuccauccccuuucaauaaaagagucuccauaaucccaacauugccauugccugcacaaagaacccagagaacaauucaaaauuaaaggagcugaaagaagacacaguaucccaggccuucucuccccaaggcaucugcaggcagaauagccaugguuuccagaacauucucaucacauuugucucucgugagcugcagcauacaauguuuaccagaggcuuuaaaaauaaaaucucacuaaacaguugagaaaaauauuuaacaaccaaggcaaagcaauuacagucaaauuuucaccucgagauucccaucuuaggugugggaggcagagagaagacuccugcacaucagucugaaccuagaaugaggaugaaaagaguugauucugccaaugguugacaacaaauccauauuuuugaaucucagggugaaaugcggagcuacccgcccaucugaauguacauuaagaacagcgccacuguucgguuaaggcugacucaaguuucuaagcagcaauccgaggacaggcuagacaugaacaucccuacuaaaaacauggaaaggucugaacgugacagaucucccuuuucaauuacuugugcuagaaagcaucaucauuuucaacuagucaaggugacaauaugagaaaacgcaacuagucccaguagagcauuucuguaugaauguauagacuugggaggaaauuaaccacaucacacaggguuaauccuuccccccaaacuucugccccauuauccaaccaauuuacauuuuguaaucuagacuuuuauuacucauuuucauuaugauuugacuuugacacuauauuauucccuucagggcaaagacuuucugggugcaaugagaucagacauaauuucuucagcaggaaugcauaacaaggacauguguacacauuccauucccagacauuucugucucggucuaguucagaugagcaaggaaugaaaggcggggcauaacaugguauaaauucuaguuaggcacggacaauaagcauccauaggaagcuacuguucacuauuaaaaggcauuaccugauaugguugaaaaauaucacaaaggcuuauaacaccuuaccugagccaucugccucuccaguuuugaucggggaauaucaucaaaguaguuuucauuucuucuccuccuugcaucgcccugcaugauaaugugaggaacgucuagggagccaccagugguguaagugcuuuggcuaagugauggagacaacugaggaggagugugauuaccacuggguuccugaauggaaauacaucaugaaauaaauaccauguucuguggcuaaccuuugguuucaaaauugugaaauacugacaagacaaacuguggggguggggagucgcuuuugaagcaacagccaaggaaugaaugacauuccaccacuuuauuaauggcaugaucuagucaauacguuuuuccccuaaguauuucaggucaaaggucugaaauaucaagagucagguucuguuuuccuaaagcagcaucauggauggucucaggagggaggcacaccuauguugggcaccucugacacuacugcauguguuuacaggggaggaacugggcccucaugugggcagagcguccucaccaugguagaugccaugaugagaaagcuaaaaugagacccaaugggucuugauccuucaucaaagaauggucugacaacaggguugggaagaggacacaguacggcaacacagcaugucacacgcacagacugcagagcagugcaugcuacgacagaggaugcuuuuccaaggcaaagacaacuccauccaagggaaacgggucaggaggaagauagggggcauagacagcucagcucuacuauuugcaaguagaaugaggauugggaucaugguguuucuccagaucccuucuccuccggauauucuggaccuucuaugauagauuuagguccuauacuuuugcauggaaaucucugucuuugaucuuuuuuuguuccccuaaaucucuuccagagagccagaaugagagguucagaaggggaaggaaaaagagcaggguaaguagcaggaaaugacuccucuaaagagucauuuuagggugacuacacugauggugcuuauaucuuucucuccuuccauguagcaaaaugaaggcaaaacaaaaaucuuuuuuuuuucuaauuuauuugaggcuccucuuucuaaggggugaaauuucuauuuguacuuuuaugacucccaaaacucucaaguagccuccaaauaucccaguguacccuaaugcccccaguaauuaauuaaaccaguauucauguagucccuacccaucccacuccagucucucucaggaggcuaagcuuguccuccuggagccaauucucuugcauccccugaaauccuugcgcauuuuccucuccaaagcugaaucaacuccaaauccuaacagcuccuuuccuguccugcccucuguuauccugacaguggcuaugcuguuugcugaaguuuauugauaagaggcagcccacugcauuucaucacgaugguuacguccgggugccgugcuuguguucaucucuucagaaaagaaaucagaagcaagcaagugcaggacaaaauagagagcagagugggcaccccacagcuuucagggagaucucagcuuuucgacgaauuuuagaaaaguucuuguaggacucaugaacaccagugacugccggccacuucuugccacugccauuuuugccuggaaaucaucuuucucacuuccucucugcccuuuccucccucccuuccuucacuuccucuuuauuucucucuccuuuauacagguucucuuuaguuuccuaccucauaauuuuuuuuuuuuuuuuuuuuuuuuugagauggaguuucacucuguugcccaggcuggagugcaguggugcgaucucggcccacugcauccucugccucccggguucaagcgauucuccugccucagccucccgaguagcugggauuacaggcgcccaccaccaugcccggcuaauuuuuuguauuuuuaguagagucgggguuucacuguguuagccaggauggucuagaucuccugaccucaugacccgcccaccucugccuuccaaagugcugggaucacaggcaugagccacugcgcccggccccuaccucauaauucuaaaguguaguugaauaaaagaaauacaauuuauuaaguaagguuuuagauucucuauucugaauuuuugaagugaguaaagcuggacaaauuuuacuucuugaaaaacagaagacccuaagguuaauuuuaaauugaucuuuacuuaacugugguccuugaucaauuuucuuucuguggguuugaggagucugacagaaaacccauuuccgcucucuuggcguagauggggugugggaugggaggugagggagugguucuuuaaagguagugguuugucaggcugaauuccauuauagauggauaucuaaaucucaaaaauauauauuuaaccaaucuagaaaaacaaaucuuguuguuuugauugugucaaacaaucaaaagacagauuguuuucuacacagauaugguaaacuucauagaaaagagccagcacuuccugaucuauugcuucaguuguauaaagugcacguuuauaaaaccuauaaaacuacauaaaauaauucuuuuauuuucuuacucuguugcccaggcuggagugcaguggugcgaucucugcucacugcaaugcuccgccuucuggguucaagugauuuucaugucucagccuccggaguagcugggacuacagacaggcacaaccacaccuggcuaaauuuuuucuguuuucaguagaggcagggucucaccauguuggccaggcuggucucaaacaaauaguucuuaagauaagggcagagaaccagaugaaugugcuuggcacuuacccugagggugauggaccgagggggcuucugugggggaucgucgugcagccugucucccagagaugccaaaauacguuuccuguggccaaucaaauugauuuuuaaaaccugaaacaacauauauuuggguuaaauauuucacuggagaacaaauaauuuuuauauguccuaaaacauguggggugaaaaaagauuugugcaaaguuacuccugcaccaugagauguggugucacuucagugugaccgcugaaguccagaaagauugcaguagcaucuggaaagccuggaguggcuaaguaucaggggcacaaagagaagggaggaugguucuccuuccacucaugcugccugagagccucauucccaaugcagcagccucaagagaaaccagcucuucuuauaagcagccgaaaccucacaggauaaaaucugagucuggacucaggcuucagagggacaggcugcccucugucucuuucccuccauccaggauaugcagucaugccagccuccucuagguauuagaagcuccacauucauucucaccuuggggccucuaccccugcucaaccaccugccuggaaugcccccucuccccucugagauuuucaaauaaccagugacuucucaugguucuggacacugugcugcugaugucuccucagaaagguccucccccgccuccuuauugaagaagccaugcccucaaccccugacaugcucuccacgaugauccauccucauuuuaucacacucuaaaagcacuuucuuuacaagcuuaguguuuguguuuuguuccacccucuccagguaagcucccugagagcagggcacuggcauauguagagcacuauuauuucccaaaagcauaaaaggaugacuaaaaaaaaauaagggauuaaugaauaugaaagaaugaaugguaauagagaugggaguugcaaaauuagagucaucuugcauaaggauacaguuagaaugaaggacugccuauugggguagacucagagccuccccaggaugguauuuugaaucugaccaugcugcaaagggcacaugguagaagagcucucaaagggaacugagaauugcagcgccucaauccucagccccauucccggugcuuuaccagggccacaccccuuucaaucuucccaacuucucuaucuggaaggaguucucacuugacagaugaagaaacugugguuccgagugguuaagucaccuacccaagagccagcaugucguggcucugggauuugaaucagauuugccugauuccaaagcauguuuuacuccaaaguauacgucacaaaauuugggcauuucuccaaauguuaccagcuucuuaaaaacacauuguauauucauccauucauaaaaauguguuuaccucuucccuaccuauguguagucccaggauauaauaaucuuguuggguaacuaguuuccaaagucguuaucccauguguacauuuuucucuucucuuuucaaguuuuaagauagaagguggggagagcguuucuuuggcaggcaucccaugauaccuugaauuuuuuuuaaauuucaacuuuuaauuuagauguaggugguauaugugcagguuuguuacaugaauacacugagugaugcugaggucugggauaugaaugaucccgucaccagguaguaugcauaguacccaauagguaguuucucagcccuucuucccuuccucccuccccuccuuugucguccccaguguucacuguugccaucguuaugcccaugaguacucaacguuuagcucccacuuauaagugagaacaugcaauauuugguuuucuguuucugcguuaauuaacuuaaggguaauggccuucagcugcauccaugcugcugcaaaggacaugauuucauucuuuuuuaugucuguguaguauuucaucuaccuugacuuuuuauuugccuauuuguugguuaacuuacgggccuuuuggccuaaacugauguagauuuuaaacucacacuacgcccuauuccuuugacagccacccucugacccaugucuguugaugaugaggaggguaaauguuagccaaggugaauguccccaugcaccauaucccuaugauuuuauaaaaccuucaucuccccaggcugauuaauccuaaucuuugcaaguuuguuuucauaaagcagcuccucuuuuccauaaaucauuucaguugacauccucaggacuuucuccuacccuauuauagcugcuuaagguuugcugaaaaaauggcucacaauauuccagguguaagugaaccauggcuuuacauuuaugcaggauacuguuuucugcuuuuaauacccguuuaaaauguccuuccuaagcacacgugauuucuagcuagccuuuuagcugcaguaggaauaaccagggacaaaaguauacacugacuauaaaaucccuuaauuuuguuauagcuaauaguucaaagcccuuuaaucuaggagggaugauuugaguuauuuuucccuaaauuucuuaucuuacaguuguccaggcagaagcccaucugccauccuucugcccacucacacagcccuauguuagcuuuuugcauuuauauuaaccaguuuggcauuucacuaccuggaagagcuuagugauuuuugcauaucuggaaauuucacuauguauuccuuucagaugauuuauaaauaugcuaacuaaguguggcccuacugcugauuacuugcaggcagcauuguuuauacgauccauagaaaugcccuuauauucuuguauuguuucuguuuuuaagcaucaagaccaaauaauuccuccaucucagaaaaaauaugauaaccuuuucaaagguauuuugcaagucuaaauacagcauauuuucuaauucucuuuuauucucauccucaauuccuuugccaaaggcuucuauuggauauaaauuccucccauaaaaucuucaccgccuuucucccagcagguagcuggaccucaugcugaugguacuaccuugcccccucccugaguccugcuagaaauguuuuuuauaauaaagacauuugcuuaauuauuauuauuauuauuauuauuauuauuuacaaaacugacacuaaauaacacauaacugugguacaauugagcugauguaauccccacuauugcuuuugguuuacucucccacaacucaauuuugggcagguuaccugacuccucugaucucagguuuucucacauauaaagugaagaaguuaaugacaauuucaaaugugguugggaagaugaagaguaaguugugagaauaaccagcauagugccugacacauagaagaagcaacuuucacagugugcuuauuccagugaauggguucugagggugcacaggaauccuggcccagaagaacaaggacuuguucauugucauaaagucaaucauguuaaacaaauacacuggagcuuuggaugaagagauguggcuaaccuugggaaagcccucaaugaaguaacuuauccuaguaggaacauggcugauuucuagcuauuagucugaggccagacccaauuuaaaagaauaugcucuucugccauccacaucgcuuaaucuucaauaggagguaagcugaggcacuccucugcacugaagcuucauugcugucuccuccauagagcuacccagaugaggguggacggaugaaugaauggauugauggauagaugauagaugauagacagauagacaggaaacgaauuaacacaggaugguuaguacuaucaagaucaccuggauaacucuccuuuuuaucagaaaugagcccccaucacugaagauacugaugguaacuuccauuuacugaacauuuucuauacucuaguucuauguccuaguugugcuagaaacuaccaagugguuauacacaaauauaaauaucuccuguaauccuuacaauagcauacaauaaaaccauucucauuuuagagaugcaaaaucugagauuaugaaaugcuaaguaacuugcccaaggucacacugcuaagagguacauggcuaggaugugcaccugauucuuaaccagcccuucacuacucuccuugcucuucuucuugcuguuaaccucuauaccuuuugaccuuuagcuacacuauugguuaugucaucaugaggcuucuuaagauguugcuucuuacuuugaguuaucauguuuaaagcauuuauauaggguuuugagcaucugaaaacauuaaaauaauucacuuuuuaguaaggcuuauagcauuguuaaagcuacaggcuacaagggcagguaccucacaguauucccugugaaauacacauauagaccaaggacaggaaacccucaucacccaagauucaauccgagcuggcucacuguggagugguagagagggugacagugggcuucaaaacgcccaaguugacaguaagaaauccaauuggcaaaacaauaacagagagaauauuccaaagaaagauggucauuauggaaaagucaagucugaagguggcuggguuugccuugagugagaaaggcuuuauagcagacugucuuugcaagcagaugggguuccugaguaguggaauccuacaaccccaggcaucaugggugauaaccagugugaaaacuuuaguuuucaagaacaccaaagcaaugguuacugcaguagagaagaauucuguguuuucguuacuguuuggguuaaaguuaacuguucagacaagaacauaaugggaguaaaagacaaaauaaugguaauauauuggagauucaguuauucuaagauguugaagcaauucaguucggcucaaaaaacaauacugaauuucugcuaccaauuauuuggaggauucaaaggggaacgucuaugaacagagcuuacaauauuggagagaucaggcacaaauaacuacauuaucacaccauuaacuaagaaaaauuauuauacacauaagcauaagaauguggcuccaacugcugaguuccaauagauaagaaauaaaaguuggccaggcgcaguggcucaugccuguaaucccagcacuuugggaggcugagauggguggaucacgaggucaggagaucgagaccauccuggcuaacacagugaaaccccgucucuauuaaaaauacaaaaaaaaaaaauuagccaggcaugguggcgcacgccuguagucccagcuacucgggaggccgaggcaggagaaucacuugaacccgggagguggaaguugcagugagccgagauuacgccacugcacuccagccugggcgauggagcaagacucugucucagaaaaaaaaaaaaaagaaaaagaaaaggaaauaaaaguuauggcauguguucuuaaugguuuuuauuacaacuauuguaagaggaaugugggucaaaggcaaggaguauuguugaaaccacaggagucagccacagguggguauccauucaucacagcaguagccgccuccaggaauuuucuccaguaucacuuaaacaggauaauuccggaaaccccacugugaaucucagcaacaggagaauaaucaugcuggaugacaauccuauaauaucacgucacugcuguuuauguuucuggguuuggcugugggaauucugccagacaguaucaugauauacccuuacauggaauagcuuacuucagaauauaugucauagcaaagcugaaagucaauguacuuaaacuuccuuuuuucuuuuaaaauuuaaugugauauaaaauuaaacauguuuaaauuuauaucacauuaaauuuaacauguuuaauuuaaacaugauguaaaugaagcauuuuuaucugcuuuuaaaaaaguaaauaacauuuugauuauaauagcuauacugcuuucccauuuuagacacuuuauaaaauacagaaaaacaaguaagagaaccaguaauccacaaacuauaucuaaauagauauauuucauuucucccccaugauuauguuuugugguggucauaucacgaguaccauuuucgccuuuucuucaguucuuuaaagcuaaagaacuuuucuacauauacaacucucaguagacauuuuaacuaacuccauauuaucacauuauuguuucagagaaguaugucauaauucacuaaacauuuccccuaucauugaaaauuuugguuugugcuccuuucuggauagcaaacauuccacaugcuuaaauaauucuaucauccuacaauuuccguucucaaugccauguuuacauagacacagcauagaaaacaccaaagaagacugcaagaaucacacaagucacgcagaaaagucauguagcaacagucugucucuauguucugcaugaaaucucaauccguuuauugccggcuggaccaacuccugggaaaaucacaaacccacauaauguuccucagugccauauuuugcauuuuguuauguuuuuggaguucagauuuagcugacagaugugaaacagcacauguagcuggaauucuucagagaguacacaugcagcgaugcugggcacacaagcgauucuaguucucaccaccaggcgacugcauccuuuuuauuucuagauuguuauugagggagggaguucauccugcauuuggaacucccuuccauuuuaggggguagauuauuuccccuuuccuuucuagauacuuggccaacuaaagagaacagcuccuaugcaagucuguagagcucaccuggcuucagaguagccucuucuaauaaaacugcaaguguucugagcaguucugguguuccuaaaugccaagaauggaaguugcgguggaaacugaucugcuuuguucucaucugcagaacuaaaauugcaaauaauugucaaaguuuuccccccugccugauaacaauuucuaaacacuuuccaccugaaagcaucaaggcaaaagugccuguguaaaauuccauuucgaauuccugcaaucuuagaaauccucacuugaacuugcauacaguuuugaccaugacauuuuucucucuuauuucuugaacugcaauaauccauguccagcaugggauggugaacagaaagaccucaggagcagaaagucaugacauuugguucuucucuuacucuucuucuagcuaaguaaucuuuaaugucuuugaguuguaauauaaaggggacaauaacagucuuauucaacaaauauuucuuggaugccuuucacauauaaccaccauguuaugcaauuugugagccacaaagaagaaaaaauaucgaguccuccagggcucucaauccaggcaguaaaaaaauauuaaaaccaugugaacguauguguguguauauuuguguguauguauguaggcaucuauguauguauguauguaucuaucuuucuaucauccauccauccaucuaaauauauacgucuacacagccuucccagccuaaaagggguuucuguggaaugaaugagaaugacuaggaagcuuaucuggaaauuauaaagcacagaacuaagguacuaacuaagguauuauuucucuuuuaaguauaacagaaacuuaaaacuuucuuacccuaucaacaauauuuagauauuaccuuugauauuuaaaugugccauuauggauaucucuggguagauuuuagauccagaaucaugccuuccacuucuccaaucuucucuccuguuauuucuuugcuccauguauacacacuugugcauauuccagagugucucugccuggauuuucauuagaaucucacaaggaugaaaucgagauccaccuaaagccuugcuugcucaccuuggauuacauagaccuuucucucuuugaauuucuuuaguaucuguggucuacccugugcuguugacacaugauacauccugguggguauagcuaacucucuuuuuuuugcguaugugucuuaccugaucaacuagacucuaggcgcugaaaagucagauauagugucacugcaucucagggucccugaaugcaucuagcucacgaauacaacucaaaggugaucucuaagaucucaacucaaaccccugucaagguggacaacaaaugaagcaggggagaugucucuaaaagaaaaagagggaaggaaaauaacaccuaugucuuauuucauuccguuucuacucucaagagucuucuauucuuucugagcuuuggcaccuuaauuccuacacacagucuugccacgggugaugcaaaacuuccuuacaucccaccaucuguaacucuuucccuuuaccucugccacuucaucuaaaaaaaaucccucugacuacaguuuccaaauucccuuuuccuucugcuauuacuuuccaaaccaacugcuacuaaauaaucagcaaauaacuguuugacagaugccaccgaaauacaacuguacuaaccuauggaaaggaaaagagguuccaaguuauacagcuccagagagagcaaaggauagugagaaagagcgagggaggaggaaugcguguuuucugaauguagucugucucauuaaauaggaaauacuaauuaugaggaaaugagaucaucuuugcauggaaagagagaccuuaaugguauaauugccucugaacauuuaagggcucuggagguacaaagccuucuuuuguaaucaaugagaaucuuagguuuauuuguaaagcucucugaauuaccucuugaugaagguacuaauuuucugauuuucauguaaacauugcuucagaagauuaaaaacacacacaaaacaaaacaauaaaucaguucccaacuaauuucccugaaaguuacuuuuaaguaaagcuugcugccaguuaaguuuuuauaggagaaauuugguuuacauugcucaauaacccaaucauugggguuauugaaggaaaaauuuguuacaaaagaaaaugggaaguaugugcaacaucccagaucugaaguuauucuuggagaugugaagaugugcuaauagcaucugaaaagugcaaaucucccugcaguacuaugaauacauaaaaaugcucugcaucuuaagaaguagagagacugcuguuuugcuauauuuugcuaaccaugcaggauauuuacugcuaacgaggguauuuucuaacuuuauuuccuuucaauuuuugagaucauaaaauuuaugaucaauuauauugugugacugaugcucucaguauuguaaaggaaauuaugguuaccgaaauucauuaacauauauccauauaaaauaaacagaaacacgcaacauacaugaacacacccauauuuguaaaagaagcucuaagacaaauugagucucaagagacaauccuagguaagugagggccugguuacuccguuuuuggauuauaaguggucuuuucugcucuguugcugcucugccccucuucuugagguuuagcuacuuuaauggcauauaacacccuccaucagcagacagaauagugaaagaggcagugaauucaauccagccaauucuguuucugucagcagcucugauaaaaggguuuuaugugggaggagguaaaaaaucuaccuaaaacuagcuaaacuaaaguuuuaaaaaugcauccacagauuuuacuuagccuagccagcuacuacugcacuuuagaauuggacauuuaccauauuucagcuacguauggaggcaaaaaggauguuaagguuaaaagaaaguauuauaaggaaagcagagguugagucccaaggaugaguucaaaaagaggaaaaaaaaagggguaacaacagugagagagauuucuuaucgucccuuuucucccuuuguccccacccccaccacuauccccuuccuuaucuucuggagagucacaucacagaguagagcuaggaaucacccuaaacccauaagaauggcuaauguuagaaaagaaugacccuaccucggaugauaaggauguggaggaacuggaacucucaucuugcugguaggauuguaaauggcacagucacuuuugaggaaacugccaguuucucaaauuuugacccaguuuucuaacauauaacccagcaaguugacucuagcuagcaacuccuagcuaaaaaugaauacauaugcccacauaaagauguguacaugaauguuuaagcaacauuauucauaauagcuaaaaauuagcaauaauccaaauguccgaucaacuggugaauggauaaguaaaauacaguauauucaugcaacaaaauacugccuaaugauacaaaggaaugggcuacaugauacaggcuauagcaucaacagaccucaaaaacauuaugcuaagugaaagaagcugcacacacaagaugauagaauauuguaggauuccauuuacaugaguuucuagacagcauaaaacuauauguacagaaaacauaucagugguuaucuggaguaggaauaggagcagggauugacugcaaugagcauaaaggaacuuuuuaggguuauggaaauguucuaaaaugggauuguguugaugguuggauagcuguauagguuuacugaaauuuacccaacuguauacauaaaaugggcgauuuucaugauguguaauuaaauugcaaugaaguuguuuuugaaaaaagaauaaugcugggagaaugcauucaguaugcaguaucguauaaauaaggccauuccugaaggcuguaauccaggcugcucgagaagaccucuguugucuuggaauauaccacuuaucagcuggauggaagggugagcaacauauacacugcaggaugucuuaaggaaaaugugaccugcaggguagcuuuguucuaggagccuaguacuauuuaacuauaggcuaauagaucaguagcauauucuuuauuauaagugcacaauacaguaaauuaguacgacuuuccuauguauguauauuuuugagggucuuaauccuccaagucauaacacuucaguaaaaauguuuaugcuuucuaaguacuuacaacaaauggcuuauggauguuugcggagugaucacuaggagccaacauggguucucucuggauggguaacagguggugaucaugagaugacacucaagaaccagagaauaagguugcauucuaagcaccaaauuaaucacaucaacagugcuaugauuugaguuuucucugacaaaaacucagcuuuaaauuggaucuccaauguggcaguguuggcagauggggccuaaugggagauaucugggucaugagguggcgaauccuccuugaaauaacuuaugccauucucucaggagugagugaguucuugcccuggcaagacuggauuaguugucacagggaugaauuaguuccugcaagaguggguuguuaagaagccaggacauccuguggguuuugccucuucacacgucagcuuccccuuuaaccuuucaccauguugugauacaacaccagaaauucucaccagaagcugagcaggugcuggcaccaugcuucuugaacuuccuagccugcagaaccaugaacuaaauaaaccuuuucuucuuuauaaaucacccagucucagauguucuguuauagcaacacaaaacagacuaggacaaacaaagcgacuggagucagaaugacuuucuagcccaugaagagucaaugaaauagacuggcagugugacuacaguuuaaucggugauacugaaacccagcuaaauaaagaaggugugccagggugggguggagaagcaaggguagagggcauauugaagcagugaaacuaucuagcuuuggcagcagcauggggagacacugaaucuuaacauaaguaagcucccugauuacucaagggguuauuuuaucagguuuuguacugaucuaaaugaaacaucccucaaaauucccuuuccuucaauaccacauguaccaggaagcaguaauugcugaaucaguuuucugagugcccagauaugagaagaggaaauguugaagacgggggaucagggaggggagcauuuggucagagaauccuucccaucauguauuaacagaauggacaucuugauacauugaucucuccuuaauuaaauuaaauccacaccaccgaggcacagaaccugcucaggagggcauagugauuaagagcagggcuuggugucaggaugaccugagugugaguguugguacuggcauuuacucuauaugccuuuuggucaauuacuuaacgucucucaguaucaccuaacuuguguaaaaugauggagcuaagaaacaguauucgccucuuaguguaauuguuaggauuaaaugagacauaugcaaugcauuuagcacagugccugguauaaaaugagcuucauaaaauucuaacuucauucaguguuuugauuaagcccaguuucugaaauggaagggcugagcccuccccuggaaccccaccagaaggagcucagcagccagccaugcaccuuuucccuggcaacaaucccugcaucaucagccacucuucaaacuuugguggccucauugaaaaucaguuuuugccaaacuuuauugacuuucuuuuuuugacagguauuaguaugagguugacagaccaggagaaugucauagauauagugucuuugauuccaauaaagcacuugaugaagucuuucauuaucugcaagauggugggcucuaugagggaaaaauuaaguggauucacagcugguuguacaucuauagccaagaggcuugaugaauggcucugucauaaccuguugggggaccacugauugaaugccacaggcucugccccuggauucugcucuauucaauauuuuuauuaauggcaucaaaauagacauaagaagaauacuuaucagauuuuucaaugacauaaaacugugaaaaauauuuaauauaauaauaggcuaauguaaaauucaacauucucucaacgggcugaaaaggccaagcugacaccaaaaagaugcaauuuaacagggauaaauauaaugucuuacauuaaggauccaaaagaaaucaauuguucaaguucaagaugggaaagauauggcugugccacaguucaaagaaauagcugaauuuuuaguuaaacguaggaagggguuuagcagaaagaaugcaaaaguaugggucuaauggggagggaaugaacccauuuagaauaauuuuaccaaauaaauaaucucauuuaccuugcuauuacaaccuaacaaggcugguaauuaccuuaacuuuagaaaugaauuaacugagguucaggaauuuaaggaacuugucaaagugaugacaaaaucaggauuugaauccaguuccgacuuccaaaauuugugcacuuuggauucauucuaucuugcugccacuucucucccagagaugcuguguggcucaagugagacaauuuuaauggacguaccuagcacagugccuggcuccuaccuucugcucaaaaguggcugauuauuuuucucccagagacucauuaaauguaaggcugggugcuuauaugaacaaccaguacuuuauuauuauaauaugaacucugcagucuauucuaagucuuuucaaguuuauccauuaauauaccuagugcagaaaugauucuguugauuuuuauucucucauucaccauuauuuccaaauccuuaaugccagaagaggaaguccagccuggaaaaggcacuggaaaauuugagggcaaucuaaaaaucucugucagucaguaaugauucccagauaauuaaaacuuuuuuuuuuuuuuaauuaagguaacuuucaagggcugcauuagugguucaaugcugcguauuaacaugacaaaaaccucuauuaccuuuagauaaugaggugguguguuaaguaaccuuaguacaaugauaugcauacagaauguacaaaauuuucaauuaauucaauuauuuaauuaguuuagcuuaugguuaaaaagauacuuuuuuuucuguuguuggaggucuuauuagaauucuucauauauauauauauacacacacacacacacacacacacacauauauguacacauacacacauauauauauauguauauuuuguucuuuccugccuaagggugguuuauugacagucuuuaauucuucccuagauaucuggaauacugcauugcaucugagucaugcucuguguagacuauuugucacugggccacagugcugcugcaaaagguggcugaggaaugcacacuggcuccagcaguauccuguaagauuuagcucuuuuaaauaaaggaauucuuaggagcaguuaguuuucauugccucuugcacuaaaagcaaggccugacaacauuagcuauccaaaaguuccaguuaaugaagguuucauuguaaaaaagaauccauuugggggaaggugcaaacucuuuguaauuuucucucccucuuucucuuggccuaggccagccaugguucacaaagcuggagaauggagaaucauuagcugcugauggugcuggucaucccacccuggcaaggaaaggaacagguauguugagugaccagguugaccugugcaguggaugagccgaaaaccucuuuuguaagcuguuuuguaaagauauggagacaacugaugauucuggagguggaggaugcuuugagggccagaacacacacucugcaauaaagcaggucacuuccuucagguuuuaagcuaaaaugugaacacaucaguggacuuucacauaagcugugcuuucuuucuggaaugucuccuuuuccucuucuccaucuagugaaccucuacucaucuucuacucuuucgaguuaaauacuacuuuugaacaaauaauagcaaaagaacaauuaacggcaacagaacuuuggaaugacaguuaucaaacuaguccugauccauaaacaaaagucuacuuagcacauugugugaaaaaaugaagucucuuuguuuuuauuuucuuaaaccacuuuauuccaguaugacugacauguaaaagguuguacguauuuaaugcauacaacuugaucaauuuagggauaaguacauacacaucaaaccaucaccaccaucaagacuauaagcauacccaucagcucccaaauuuuccuccagcuccuuucauuauuauuaucaucauuuuugugugugugguaagaauacuuaacauaagaucuccucuucuggcaaauuuuaaauacacaauacacuauuguuaguuacuggaacuaugcuacaguagaucucuagagcuuauuucucuugcauaaguaaaauuuucuauuuaaccaucaccuuuccauuucugcccccagccccugguaaccaccauucuacugccugcuuuuacggguuuagcuauauuagauuccacauugaagugagaucauauaguauuugcuuucugugccuggcuuauuucacuuagcauaauguccuucagguucauccauauuguugcaaauggcaggauuuccuucuuuuucauggccaaauaauauuccaugguauguauacacuacauuuucuuuauucaucuaaugauggaaauacagauugauuccuugucuuaggacauugugacuaaugcugcaaugaacacgggagugcagguaucuccucaagaucuuaauuuuuuuucuucuuuugagauggagucuugcucugucacccaggcuggagugcaguggagagaucuuggcucacugcaacuucugccucccggguucaaacgauucuccugcuucagccuucugagcagcugggauuacaggcaugcgccaccaugccuggcuaauuuucguauuuuuaguagagaggggguuuugucauguuggucaggcuggucucaaacuccugaccuuaggugauuugcccgccucagccucucaaacugcugggauuacaggcuugagccacugcgccuggccaagauccuaauuuaaauuuguuuggauaaauauccagaaacagaacugaagaaucauauggugggucaauuuuuaauacauguuuauuuuguaucagguugcaaauuuguugaucaaaauuaugaguucaagaugaaaaagugaaaaguagagcaaugcuuucuaagaaauagauacugaaucaucaaauggaaaaguaauauccccacuugcuaauuuaauucaucauaauuuacaagucucuaaugaaaaccaagcaacaaacaaugacuuaguauuuguuagaaaacaguuuaaucuccaguugucacugaacucauuagcaacauaugucauucacacacagugaggaauuauuaauuuuucauuucaagaaaauugucaaauuaagcuggauagaauaacaacauacaauaaaaaaauugguaauuuauucuuauauugcccuagaaugaugauaguguguggcaugucauuaauuaauaaacauaauauuauucacauagugggcccuugauauccaugaaauguguaauuaaugaugaaaaugcuauaguguuacuaucacacuuacugaucacaucgaaguuuuuuccacccacacuuaaauuaaaucucccugaaaucccugguucaaauuucaugagauucaaguaauuugugauuuuuuuuuuuuuuuuugaugcggagucucgcucugucgcccaggcuggaguacaguggcaugaucucagcucacugcaaccuccuccucccagguucaagcaauucuccuaccucagucuccagaguagcuggaauuauaggugcaugccaccauaccuggauuaauuucuguguaugugugguuuuuuuuuuuuugagacggagucucgcucuguugcccaggcuggagugcaauggcgugaucuuggcucacugugaccuccgccucccagauuuaaacgauucuccugccucagccucccaaguagcugggauuauaggcgccugccaccaccccuggcuaauuuuuguauuuuuaguagagaugggguuucaccauguuggccaggcuggucucaaacuccugaccucaagugaucugcucaccucggccuccccaaaugcugggauuacaggcaugagccacugcgccuggccugauuugcgauuuuucaugaagaauuuuuuaaaggccaaaguucauccucaagauaagaaaaaugauuguuugccauagaauucuucuaaucucaacuuuuaaaagaauuuauuaacauuucaggucaaaugccucaaauguugaaaucucauauuuuaauucuuugagaugaaguguuuuccccagcauuucuuuuuuuuuuuuauuuagauuuagucuuaacucgcaucaagguuuauaaaaaaugauauuucuauuucaugagcauggacagaauguguugaagccucccugcaggaaaauuaugagcagagguaaaaauccuugcagcauucuuagcuccuuagcuguagugucucuuagagaaauguugcauauaaggaaugcuaauuaaggaggcugggagaaaagagaugccaccuuuccaaacacaacauuucaaaaacaaguauuacuaacauggugguuuuaugaagcacuugaaucuuacauaaguauggcuuguuuuuuguuuccuaaaaaaagacugcauuugagcaaaccaaaacccgaguaauuuaaaucaugaauuucagagaaaaaaguuuugcaucuagcuaggaacuuaauaaaauauaaguuuucaaauacuuuuuuuuucuauuuuaaaaucagguacacugcuauuugcaaaaucucuagucaaguagaagcagaaaaagaccgucuuaauuuuaaaagaguaacccugcucccauuuaugaggauuuuugcagggagaaagauuuuauaagauauucacuucaauacaaaagggcuuaaauucaagaguauuuaaacuuugaauuucaacuuaucccuuggaauggccucauggcuaauuucuugucuauauacaaggucaaauagauguaugucuuugguuaauuuggacugacugccaagcaauuuauuaggaagcuggaggaucuaaauugaucaugaagacaacagaauaaaugggcuuugucugauuacuuccguuuaccugaugauuaaauccugccugcagaaaauuuaugugacuuccaaauaacacagagacagacagacaaccccaugacacacuauuuaaaacucuuaucuucauuaaaugaaaaaaaaucaauuucaaaaguaccuuuuguucuuuaugucuuuguuaaauuacgucugaggaaguaaaagagcuucuuguugccguacuuccuggucuauugucauauaucccacaauuggagacuuuuugcaagauggguaauuuggauaucaaauaugagaaauuauaagugccuuuagcagauacugcuuuuccaagaguucagugugaucuuggauaaaaauuugggcagauggcuuccuuuggaggcuuauacauuguuuuccacaaaauguaguugauggagaccagagaagcauugcauuuuuuuuuuuuuuuuuuuuuuuuuugagacggagucucacucugucgcccaggccagagugcaguggcgugaucucggcucacugcaaccucugccuccuggguucacgccauucuccugccucagccuucugaguagcugggacuacuggcacacgccgccacgcucagcuaauuuuuuguauuuuuaguagaggcaggguuucacuguguuagccaggauggucucgaucuccugaccucgugauccgcccgccucagccucccgaagugcugggauuacaggcgugagccaccgcacccggcccagagaggcaauuuuuaagauggaaaaaaaaaaaaagauucucuccaacucucuuugcccagccugccaaugcucccauuuucacagcacccaggccagccaagaccuaaccuuaugcagaaaaaggaacaaugcuuuaacuaggcacagaguucuauuacuuuugcuaccuaauaugcaaaacacuaaaggaagagggcuuauuaaagaaccgcagcauguuuuguaaaaguuggucacugagucuuugacagaacugcuacaguacuacaguucuaaguuccuacuggcagcuucuauuuugagagucaugccuugaugggagcuacaaacaaugcagcccacaguaguacacauucauccauccauucauuccuucagcaaauacacauugaggguggaaugugauggcugauguuaaguugguuaggagcacacaaaaaugcacaggacauacuuauugcuuugagaagcucugggccuaguggggaagaugaagugacagaugcucuuagggaguagguucagaguggugugaaaaguagggaguggcaaucucuaccuggggagcuggggauggccucacggaauagaagacaggcuucagggcugagaaggagauuuccaaguaaagagcuauaggaaggcgauucuacacagaggagacaccgugugcagucucagacgugugcaaggacacaacaggacaugucuguuuaugguuucaaaauuuuacuuaguucccuauuaauuuugcuaagggggaaccauaugugugaguagcaggacugggggauaugaaggugggucagagccagauuguuaagagccuucaaaaggaauuuggucuucaacuuaaacaaauuagaaaauacguguaaagugcuuggaaagauguccagcauauaguguauacucgguaaauacaagcuguuucuguuauguugaaguagacaggaaaccaaccaagguuuuaaagaagggaaaggaugcucaugacuauaaucccagcacuuugggaggcugagguggguggaucacgaggucaagagaucgagagcauccuggccaacccagugaaaccccaucucuacuaaaaauacaaaaauuagcugggcaugguggugcacgccuguagucccaccuacccaggaggcugaagcagcagaauugcuugaacccaggagguggagguugcagugagccaagauugugccauugcacuccagccuggugacagagcgagacuccaucucaaaaaaaaaaaaaaaaaaaaaaaaaaaaggagggaaaggaugaugauggcagaguugguuuauaacaauaauucugaugccaauauugagaaugggcugcaguggggaggcacuguccacaggccaggaaagggaaauaauucaaauagugaggauaaggcucagcaauuagaacuuguucauuacuaaauucccaggguccaacauaguggcuacuugcagugggugcucaaugaauaguugcugaaugaauaaaugaauggcaaugggaggagggagcagaucugagaaaucucuaggcggcagaaacagcaggguuggugaguaccagauguaggcguuaaaggagagggagguuuuuuuaaggaugacucuggaaauuaggcuugggaagaugguguugccaaauucugcaaucaaguagaaaggaggaagaacaggguuggcagggaacaugaggcucugggaguacuacuuucuaugcaucugcuggguuuagccucuuggaguguugagaaaaagugggcaagggaggacaaagaacccucacaugggcacugagcuggguguuuuccuuuuuacuguguuuaauccccacggacuaugaguuugauauuguuaucccuguuuacagguggggaaacuggggcucaagaugacacauuagcgagguggcagagcccacauuaaaaacacguaucuuucugccacaaagccugagcuuuuucccccccuccauccaucaaauugccuccuccauuaaaaugaacauuuggaauaugauauauuccauauuuagaaggcucgggggugcagggugaguacuuugcaaaggaaccaaagccuaacuucuguuaacuuucugcuucaucgauacuccaaaucugucuuccucauucacagagucccuaugaggauccaaaaagaugugagaaaucuuuugaaaaauauaaagcguucuauaaaaacaaggugauaucaaaaaugagaagaaaaauauguucagauucuuguuaaggaauucuagaacacuguaaaagaugacagaagcuggauacugucuuaggaccauuugacuggcaacagccucuuuccaacuaugguucagggagcagguugagguuuuucugucuuuaggggucagucuuccuaaaauaugaaaacccggguuugagguauggggaaagaaugaauuuugccuuccaaaggcagaguuuacaacuugacggcuuucacuccucuuucaaaaauaaaccuaaauuccuaucaguugucugcagaguuccaucagggacuugguagaguggccccuaacuggggagcaggaauuauaugugcuuccuccuuguucugcaaagccucugaacaccaccgagggcccauggagagcgugaugaugugucucuuggcccaucacaacguaagcaugcugagcagaggcucuaucccacauccucacuguagccacaguguccagcaggaaggggcucacuguauguaacuacaagaacuuucgguguuugcauucuucccuuugcucuuuaaauggcuggcuucuucuucccacucaguuuucagcuuaggugccacgcugggagaggccuccugugacugcccuaguuaaauagauccccccugcuacucucuaucacugcacucugucauuuuucaugugguuccuuucagaauuuauaaucacacauuugcuuguuugguuaucugugccucccucucaaaccagacuguaggcuugagggcacaaagcaugucaacucuauucagcccagcaucuagcauggggcuggcaugugguaggcauucagggucuaacuguuguuuuaaugaacaaacagaccuaaaccugagauggugggacaaccgacaggaaagcagaaggcccccucagcacucgggggcuguuguuccauaaucaggcuucauuaugaucugggaccagggauggagccguggauuggcucacauguggacugggcccaccccucuggacucaucagcaagacaugcaaaccacaugagucaaugguccacacacagccccaaaggagaagaacacaaguaucacuauuccucaacuuuggaguagguuccuuggucuccuaguuaaauaugcauggcacauaaaaauaauugugcagacagaaggacucacaguugcuuaauguagaccaggaaaguguuugaaccauucaguggguggugcgacuccuaggggaaaccagccacgggugggaauagaaacuacuccaggaaaugguacuguauggaacaauuuacauauuuuggggcaugggaaguuuuggaaaugcauuuguucuccuccauaucuaccacugaaauaaauccuugagauuuaaaaugaguagaugauauuuaguaauaugacugaaaaaucacauaggacucauuuaugagccaggcuuuaugcgcaauuuacaaccuguauggaaagcaacaccauccccuguuuuacaaagaaggaaacaaguucagggagguuaugcaagucuguuagauuuuaacacuugcacucccuucaccauggagccaaagccuagacuuaauuguuuagaauaucauucuaaauugcuuuuugcaaugucauuucuuaugcauuucuuacacaccuuuuaggugccaggaacguauuucuaaaggcaggauagcauugcagaaaugcuagccuccaagagaugggguguauuuuccauugagaagcagaauuaggggaaggguaguuuuaccuccucagugucaacugaaauggcagucauucaacauuucacucauuucccaucagacaauuuuaaucugaauaaaguuuuuaaaaaucucuuggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguaguccuagcuacucgggaggcugaggcaggagaauggcgugaacccgggaagcggagcuugcagugagcugagauugcgccacugcaguccgcaguccgaccugggcgacagagcgagacuccgucucaaaaaaaaaaaaaaaaaaaucucuuaagaaaccaucuccuuacaaauucccuucuugcaaaauacuuauuuuucaguaaauaucuucguugacaauucuaacaaagguacucaaauucuauauccuggcuaugccugucaagagaguugaaggaggcaguggccauauuuagagggccaaaaccuguucuucuggugguauauuuugcugaucugcugaucuugaaggacuccagugccuuaaauuuacccacaugucauuuauugcugccuaaugugcuuauucauuauuuuuugaaaauagaagcauauucggaaacauauuuaauuuuacgauguuaaaaaugaucacuucugguucuucaccagaacuauauggaguaccuggaauacaguagguacucaguaaguacacuauuaauaaaugaagaaaauauacgcaggauaaaauaaacuguuuuucauaauucuauccauauaugauuuuuaggauuguacuggcuuaaaagcugggacuauacaaauacaucaucaaugugaaaagcugggaaaaugggaaugcgaaaaucaaacuggcucuuggccagugauuuuuuuuaaaaaaacaaggucuucaaauguuuguaaacugcaaaauguccuuguuguccuucucccuuuuuuuuuacuacuggcauugucauacaaacuuugugucucuuccaaauuagucuguuguuugggauccuuaacuacggagagugucaacugugcgucuccaagacaaacagguugaugcgcugucuuucucagaccuaugcuuuaaagcccaggcuagggucaugcucugagacuagagcauucugacuuucucuggucugcucuuuucugguccuugauuuucuuaucugaaucaugggguguccauuguuuagacggaagguugcaaauauaaauuaaauaauuccucagcaaacaauaucuuucugugaggugcauauaucaguggcuaggaaaauaucugaggccugcuacaucaugguuuagugaauaauuugcauuuuaugauguauauacaguguagcuaugaauaaucugccagaaauuauagcuauacauauauaagccauacacucacuaaugguaacccauucuccuuauuuuugaacccauucucgguaccaguaauagagagcucacuggcuuugauuugaggcagaccuagguuugaauccuagcucuaauauguacagguugaaucucagggaaagaauucaucuuucucagcuuuaguuucuucaucugugaaauggagauaauaccaacuucauaggccuauugaaggcauuuaauguguugauuauaugcaugaagacugauuuguuaacaaacagaugauuucaugugugugugcaugaguugggugcagccuuaauaaguguuccccuucucuucuguuuugcuauuuaaugugauggugaggagaguggucaguguuugucugucucuuccuucuagaaguuaggguggcauaagaugaggauaugggggacagcagccucagggagauacugaauaaccucugggagccuaggaggacagaugcuugacacuagcuggggacaaaaaaggaagagcccaaacaguuuuuaaagcagaaucuucugugucuagaagaaucaauaggaaggugcaucaucaaaagaacuagagaacacaaaugacaggguaugacaugaguguucacuuucauuaaguaaacacugcugggguuuacuuaauaccuggugagagggaaaaaaagcaguauuacuccacaaacauuuguuaaaauaucaacuaugugagcaagccauacaauggagaggcaaugauuccuaagacauaaccccugcacacaaugauuccugacauaaccccugcacacagugaguucuuagucacaggggaagcacacacagacacaagagggcugugauuaauccuauaugaaaggacaacaugccauggagcacagaggaggaaguaguuacuucuaagaagaccaaagacauuuucaaagaggugaggauauuuuaagcgaggucuuagaggacgcuguucacagggaagaggagauguaaaagcauucuaggccaaugcaccugcaugagaggagugggauacggugugagcaaugcuuggagaauugcagcuauuuggauacugcugggacauaaugaccucggcagccaggaauugugguuacauugcagggggccuugaggcuagagagagagaacugauugagcuugaggagggagagugggaagggacccagagcacagauggaguuauuggcuuuggagauaaaaagggacacauguuucucugaguaggugagucuggguguuacuuggauaagucuagagaagaagagacaguacguucuaacagaacaugccuuguuaccuucaugcucucgguguagugggaggcaaugucacugguugaauaaauaugaauaaaugaaugaaugaauaaaugaaugaagguggcuaggguagaggauuaagaagcauuaaaaugaauauuucaagaacuauuuaugggggucaguaaauauaauauuucuaaacucaaaacuucuaaacucaagguauuuauaagcuaguugaagauguaaagacaucauacaucuuuucaaagcacaggaaguuaaaugaaugguuccuaaaauaugaauguucagagggaaaaguacguuuauuaacugcuugacaaagaaguauguagcuauauuuuguguaacacacuaugguguagucuuaucuuuuuggguauguuuuucuuucuuaauguuaaaauauuucauagcugguccauguaacuauaguuauacuuuuaguuuuacucagguucccgauaauguuugucgcacagacagguuuguguacugguuuuaauaauuccauuguacuuucuaccuccuccuccgcccccauccccagggucuucaggucacaguugggaccuacucuauguacucuggugcucuccauaagcaaaugggaugauuucucugaaaagacagcucuagauuauaguccugaaaaagagagcucuugagucaaugaaaaaaucauaguuuagaguagaagagaaagguaaguauguucagaggaaaagcuggucagaugaauguaagagaggcuucuuuuauuuguucauuuaauuuugagacagugucuugcucugucagccaggcuucagcgaagugcugagaucauggcucacuguugccuugaccuccugggcucagccauucucccaccucugccucccgaguagcuaggaccacaggcccaugcuaccaugccuggcuguuuguauuuuuuguagagaugggguuucgucauguugcccaggcuggucuugaauuccugggcucaagugauccgcucgccucagcuucccaaaguguugggacuacaggagugagccaccaugcccagucucaagaggaaauucuuuuagcagagcuuugagagauagguauggaagaacaggcugggguuagaguauauguugcuaaggaaucugacccucacuccaugggcaauaaggagccauggagcagggauagaacacuucucuggcacuacuggaagcugugauguccaauguaugcucucuggaagaucuaacuaaacacaaccuuagcacuucucucaauuuucuuugaaaaggcaaaucuugugagucauuuguucucuguaaaaugagagaggaacauacauuaucaccuuauauuaucgauuuacauuaagaagacuuccggauucucuuaggguuguugugucuuucuaagauuucaggcagguggguaaauccuuauuuucauggauuuucuauuggcuaaaggaacgcuguguguaguuuguuggaauauacuuuguagaagacauucuugcccuugugaaccaguuugauucccgaaucacacaagugcuggguuccagaagagauuuuggauauaacgccaggauuucugacccuacagcuaagaauaggcagcaauaggaacucaaguuacaaaaaaugacuucaauagagcauucacauaugugaugguaucagagcccaagucuucaaagagaaauauuuugaaacuucucccugguuucuggcaagagcagcaaaucuugauuuuucaggccuuuauaaaaauaagaaaagacuaacaauuuuaaaccugggcauuaaucaaccauuuaaugaugccaacaaaugaguuuuacuguaauucagugcggggagauuaaaggaaaccuaagagccacaaauaagccauuaugaacaguuuacagugauugaguacauaagcugugauuaauaaugaucagaaguaaaucuaugaauaacaacaaacagaaaggacuuguuagauugagaauuuuaucagaaagguauaauuuggauguugacucagugguaacaacaggaaaaauaaauuaccuuuaugcauuuuaguuuaugaaaaucaaauagauaauauaugaaacaacauuuaaaucgauacagcccaggagauauaaaaguauagguuuguguggucuucuaauuaacugacauuuacacauuuuucuuaagaucacuguaagcaaaaugggaaagcucucuaaauuuuuggccuuuugggagggaggcuuuucagucuugcucauauuugagucaauacacugaugucuugacuugcgaaaaaauuuucacaucccuguuuugggcucucauauuuucuuuauuacacaggaaaaaaacuuuauugcacagacaaacagaaguuaaauugaauugauuuuauaagcugcaauaaguacagcucccagaaacaaaugcaaauggaaugaacaguucuuaccauauguuucacauaggcuacucacguuuucucucguuccgagaugauuucaaaaaaccuguucuguuaauguauguaugaaauucugcaaucuuaaagauuuaaaaaccuauauguuuucaaagaccugaauauccugauacacauccuuucacaccuggaugccaaacacauacacugaaauauauucuaugaacaaaggaauuugaaagggaccacaaauuucgcauugcaugcugaagcuguccugugucagcucuucaaacuggggccucugaauuuuaggaaaaagugcuauuauucugguucaguaaguuugacccuuuguugucuaucucugcuccuuagagacacaagcaggccuugugcuuacuaagugaauauuaauaucuucauuaaaccuugauagacaagcacacuacagcccucauccaaaauaugcacaaaauuagaaggcaaaaauaaaaaaagagccagacauuauaagcccgucaauggaagcagagagccacaccauuaaugguggauugaaaaagacucuguguuguucaccucccacguauaaaugagaacacacgguguuugguuuucuguuacuguguuaguuugcugaggauacugguuuccagcuccauccauggacacagggaggggaacaacacacacuggggccugucaggggucagggggagggagagcaucaggauaaacagcuaaugcauguugggcuuaauaacuaggugacagguugacaggugcagcaaaccaacauggcacacguuuaccuauguaacaaaucugcaaguccgguacggguauccuggaacuuaaacuaaaauuaaaaaaaagaaaaagacuuccucaguuuuuucucuaauggccugaagcaaaaauuacucucauuuccucuucauugauauaauuuguuuuugagaggugaggggacaaugggaagagagugguuuuaagucacuauaaaaagauuauugacagaugcgugguaaaaugaaagacucaaaaauuccugacccuuucuccccuccagaguuagguaggcgggaaggaccccaaacuuccauacaagagucucuuaagguaaaauuaagacagcuuccccuucggaguuuaugcuaguauuucauaauuuuccagccaagagcuggaaauuaugaaauaguugcauaaacucuguuaauauagauggaucaggcuccaaucuugauuuugccauuucucauaucauuuuucuagggcugagggggcgcacuucuuggaguccaguuucugauauaaagagaaaagccauuuagugucuuggaaaaaaacaaaagaaggaaggaaggguguuguugauuuaauagaucacccuuauuguucuaauggcuccagauggcucuccuacuguguggaugagauuugacagugccuucuuggggagaaacagaagacuucacuagcuucgcucagcaaaugaccacugauugccuggaauggaggaguuaaugugaucaauuaacaauguuugaagaaaaaugauguuugccagcuguugauuucaucagcaagaaaaagcccacaauaaucaucuuagaaaagaacuuaauuaguuuugauccuaagauagcaugcaaaaguucuggacuaauuucuagucugaagauauucauaacauauuagagcuggcaugaacucuggugauuacuagaaaaaaagauuuuuaaguuugugaaaacagagaugugcucaaggucacccacaguuaacagaaaaacuggggcugaauccuggggcuucugagcucugauaugcugcuuuuucccaccacaaaucacaguuuuugagauucacacuuugaaaagaaugauccaaaguaacacugccauuuuggggugaguguucucuuaugacagaugaguuuuuuuuuaccuuccuguuuccauauguuuaaaaugcuauuaguauuucaaaccucauuuucuuucuuuuuaaaaauucagccaugauuuuagagugacagauuugccauaucaauuucuaaagguaaguguuugggucaguuugcuuuuucucuaaauuguguuugucaucccucaguguaguaagauuuuggugugguuaugcugacauuaaaguuuccuuuucuuaaaauaaaacuaaugacuugaccuugauauuguauaagaguacaggcccuagggucagucauccuggguucagaacccagccuaccacuucucagccauguauugcgggagaguuauuuaugguucccuacauuucaguucucucaucuauaaaaugggaacaguaauaaucccauucucaaaggguuguuugugugagaauuaaaugagcugaucuaugcaaaguacuuacacagugacuggaacauagugaacacucaauguagcuaacaguuauuauuauuauuacuagaaaaaaauugaaaaauaauuuuauguaauuguuacuuacaugaguagcggggucucagcuucccaacacaccaugagaauaugaaauuucaucaauaaauucaaauagacacuuuauguaaaacccuuugcucaaauaauguaacuuagcaaugacugacuuuuagauacuggggaaaugcauucauaugaaccagugcgacauucugaaaacugguucauugaaucccaauaauauagguucuuacucucaaguaggaaucaauaaugcacauccccucuguacccacaugccccauaaaaaagcuguucaggacaaucuugcuuuauauauuauacacauucagggcacauuuagaguucugaaauuugaggugcaaaguaagcauuuugauagggauauuuuuccaaagaauguuuuuggccccagcauaaaaugaaaaaucucuaccacagacaguugcauuucaugguccaauauagucucugcaugaaaaccaacagaucauucuacaugucuccugacacauuuacaacaggcacucuguguaaaacccauucgcaucacuggggguucucaccaauucuuaggcccuugacuuauuugugacugggauaccuuuaucacaaagacaugcuuuacagauauuuucacggacacaagcuauuccagucuuguccugcauaauuaaguuuuuacauucaguaaguagaguucaccucuuccuccuaaugguaaguguuuauuaaccauaaugacuaauaaagagguucuggccuccgucaccugagaagaacaaaacagugggguuuuucugcagcucggcuggaucccagcuucuaugaccucugcugcuaacaggcucuccacaggcaaugaaugggagacgccagcuaugcaaauuagaguacugauguuccuugucagcugcaaagcccaaauggcccugaaggugacccaagugaggcuucugugcugugugccugguuagguggagacccugauuagucugauuauggcaacaaauuuuuuaauugcuuuauggggugcaugaaaauuauauguuuaucuccuuuuauugaauaaaguguguugguuguauauguucaauguugguagggaggaagguauucuuauauauaaagagaaaaucuguuacucuuuaugucagaucaguugauagauauuaaacaaaucauguuguuuucucauauugaguauagaucacuaaugaccagcuggaacagaaguaaacuuguacauuagccaguaaugaacaaaaugcuaaagauauaacuagagaaauucuagagguaaggaaauaguccacauauauuaauacauuuuuucccacagucaucuugguagaaaguugaccgugaugucgaugauauaacugggucagacaaauaccuuuuaauagucuguauuacuuacacacgcauacguggcaacagauuuaccuuagacauaaacacgaguuuauauuccuggagguguccuagaagcaugcugacuguuguguccucaguauuauucacuucaauaaccguaagagcuggcguucucuccaagacucuguuccuugaaggaaggaacuaucuacuguuccccuaguaagaccuggccuacaauaggugucugugaugcuuuuuuuuuuuuucauuuuuaaauguccauuuuguuuauugauacauaauauuugugcauacuuaugguacgugugauauuuugauacauguauagaauuuguaacaaucaaguuuagaauauccaucaccucaaacauuuaucauuucucuguguugagaacauuucaagucuucuccucuagcuauuuugaaauauacaauauacuguuguuaacuacacaguagucacccuacugggcuaagggaugguuaaugugucuacucagcuagaucacagugcccagauaugugaucaaacauuauuccagauguuucugugaggauguuuuuggaugagacugcuguucacacugguagauuuugagugaaguagauuacucuuccuaaugugggugggccucauccaaucaggugaaggccugaguagaacaaaggacugaccucccgcaagcaggagggaacucugccagcaggcagccuuugggaucaaacugcagauucuggacuugccagccuccauaacugcaugggccaauuccuuaaaacauaccuuucuauguauguauacuuacauccuagugguucuguuucucuggagaacccuaauacuguguccaguaaaaaucuguugucugaugaaggaaagauaauugccugccucuuuccaucccuucaacacucacccugacucucagaacacacgcuguuuggccucauccuaaucuccauucccucaguuucucuguuacaucccugccauuuaucccauuuaugauaucccuccuuccuuaggcaggauaaacuugaagauacuguuuucaucuucagcauacuaccuccuuugucuuuccucugcucgccuuguaaaucuucaacaucuaaucaaaucaugugccuucucuaaccucacuguuguuuucugcuggagagaagcccugccaccagccaguacauauucauaaugguugacuguauguggcugggcccucagaccgcucagaacaccuuuucaugguccuuagucagccccuacucucuaccaccccaaaucuuucuugcuauuccucuggucucccauuucuaucuucagacucucgaucuuauugccugacaaauguuucaagcagaacucaucaccuuccccacuucuuguuccucuugcuuagucccuguugugauaaauuaugucccuccccuccccauucaucugcccaagcuggaagaaaauuuggcaucauccaugccucuucuuucaucuucaauuccaucacccauccaguuauuuaacaagcguuagcugaguggcuauuauguuccuggcauuauucuagagcuugggauauaagaguggacaaaguaaaacaaaaacacuccugcccucauggagcuuauauucuagcaggggagaaggaucaugaacauaagaauaauuaaauuuacagaguauauuagaaagugaauaaacgagacagggaaaaauagagcaugaaaagggugauaagaaucgacguguguguugguggggagguggagugugcaguguuaaacaugguggucaggauaugcuucaaugagaagauggcacuggagccaagacuugaggugagggagggacucacacagauaucuggggacaaaucacuuugggucaaggcaauagcugguauagagggccugucuuaauccauuugggcugcuauaacaaaaugccauuggcuggguagcuucaaaacaacaaaaauuuauuucucacaguucuggaggcugggaaguccaagaucaagaugcuggcagauucgguaucuggugagggcaugcuuccuaauagauggccgucuucucacuguaaccucacgugcaaguguuagaaaaguugggggagccugagggugucucuagguuguuguuguucuuguuaagguacuaagccccucccaaaggccccaccuccuaauaccaucacuuuaggaguuaggauuucaauauauaaauucuggggagacacaaacguucauaucuaaagcaaggcccuaaagagggccuuuuugagcgaaguaggcccuaaagcaagagugucccuggcauguugcucgagcagucacagcacuucugcgaaucuucaguuacagcacuccugugaaucuccaacuguccaucucacugcuacuaccucaaucuaggcucugggccuucucaccuaaauuaauauacugauuuccuaagugguuuucuuauaucuggucuugcugcaugcccaccuacuucccacaccgagcuagaaugaccuuucaaaaacacagaugucaccucaucagaauucuuccauggcuccccacugcccacaggcugacaugugcacauugggagggcuuagcccucucccaccuggcuccagcccacugcugcaauaucacaauaucaccucgcccauccuugacgcuuauccagaggucuguacauaagauucucuaaaugcaccaaguucccucuggacccuucaccuuugggacacugcuuccuccucauaaaacaccuaucucuuuugcuacccauugcaacccuccucgugcuagaaagcauggccuggucagcucagucucauuucccuuucccuauacaacauugcuuccugcagaaaguuccuccugcccuuccucucucuggcuuagguacccuccacuaugcuuccacaagaguguggcuaucucuacugcagcaauuucauacuguaucuucacagucucuuuauuuuuugggcuccccuaguagguuuugaauaugggcaaggaucaugcuuuuuaaauaucccagcacuuggagccuuacuugauacauaaggagauacuacauaaguuuuggucaaaugaauaaacaaauacacaaauaagccccauguggaaaggugaggauuauauagaugcauaaauagggaaaaacuauaugcagaaacuguacauagcuuccucuaaaaaggaauuucuuauggaagcagaaucuguaaccaugaggcagccacccagaggaguagaguaaugauuugugcugcuccagugacuauggguuaggaugaguuuccaggucaacuggauuacucugaucccucuuuagagccauugcaagaaaucacaucucaaggaaagacucuucuggcaccuaaucucuuuuguacuuuaguccagacagugcgaggccaucuucaaauaaaacaaucucuuuggcuucacagacaagaaaaauguaaucuauuuccuacacgugacaacaagagaaaaucuaaaauggcacaaaaauguaaugguaauauccuacagagaggaaagagcugaaucaaaaugaaauaugaccaaaugcaaucagcagcuaacagcaggaaaaaggcagcugucaucuucauuucuuucauaaacuucuuagaacaaauuaugucuuuuagaauguaagucaguuugucgggcgcaguggcucacgccuguagucccagcacuuugggaggcugaggcgggcagaucacgagaucaggagaucaagaccauccuggcuucauccuggugaaaccccgucucuacuaaaaauacagaaaauuaguggggugugguggcgggcaccuguagucccagcuacuugggaggcugaggcaggagaaugguguggacccgggaggaggagcuugcagugagccgagaucgcaccacuacgcuccagccuggcaacagagcaagacuccaucucaaaaaaaaaaaaaaagaauauaagucaguuuucuuucuggauacuacuucguaaagcuucugccguuuaugggagguaaagcauucucugcaucacccaacuucgaagcuggccugcauuugcuuagacauuucauucaugaaagccugcccucucuuagcagaggagcgaucuaaacaccacagucccaaacaccuccaucugacugucuccucuguuugucuaucaaaccacugauuaaaacacauucugcauugauugauuaauaaacagguuucagcagcucuggacacucagagucuagaaggagaaaagucuagacucaaauagauaaaaacccguaauucaaggcagaacacacccugggcccgagggggcuggaggagaggugccaagugugggcugcgcauggaacgggaacacugguguuaggugugggcugcuuggaacgucccaggaguagcuugccucauguugcagacuaggaauccagcugucuggagguggaagaauccauggauggugcauauugcagagacacgguuucaaaaucuuuugcaggaugcacauguuagaaaagagaucuuaaaaaauaaaaaauccucuaauggcuuuaaaugagcaugaagcauucagauguuaauguuuagcuguguagacaagguguuucccaaguuaucucaaagguugaugacaugacgaauugcccccuuuaaagaaaauaccaaauacacgaacaacaaacuuccccgaauguguugacuaucuuuuggaaugaagagaaaaucugggucgaguugaaaucaccaaaagucaauccacaaaguggaaugacauugcuaacacacuuagcaugagaccugaccccaucugauuauugcucagcaaaugggggcuguccugauugauuacuauuuguccagucucucaccagcugagcucuuuccucuguuccuaaaauaaaggguagggugggggacuuugugccagauaacuaaucuuuacucaguaccuuuucuguuucaggcauucuguuagcagcuugauguacuguucucaucuaucuccucaagaguccuuugagagauauauuuuauaacuguuuuguagaaaaaaaccacgaaggaucuggagauguuagguguauccaagggcacaagaugauugggaaggagugaagauauggaugccagagccugaaaacacuccaugugucccaugguagcuuguucuuuggccaaguagcccuugcacacccccgccuugucuugagacaugucaccaaagacacucaaaccauaagcuccaugaggaaggaauuuuuuauuuucaccauuaauuauaccccaguuccuuccacagugcuugaugcaugcuugguauucaauacauauuuauuaagaagugaauagacccaaggccugggaugaaguuucugucuccaccaccacuuuccacccauucaagagugagcugcuccccuacgaggacugggcacgagucaaaacacuccugggaaggaugaagucuuuuggggaguucaagaacuccugaguccggacaagacuugugccaaccugggugacaaaggaacugugagacccuggauggaguuacaacccgaagauaugccugaggccugucauucagcacuuaauuccuuuuucuggugaaaauuaaaguaacuaaaauccuggaacccuagaggcuuccagaauuguaacaacugucuucaguagccaucaaucuaauuacauuuuugcaauauucucauuuugagcuacaaagguacaaauuacacaaaauuguguguggaaugcauacauauguauguguguguauguguguauauauauguauauauauaaacguuaacauuuagauguuaauguuuagccauguagacaagguauuucccaaauuaucucaaagguuaaugacauaauuguccccuuuaaaaaaauacugaaaacaugaaaaacaaacuucccugaaugugagccucacuuuguucuguacaauggagauaauaaaaccuucuguuucacaugaagaguacaugauggaauauggcaaaauguccugaaaaccagaaaguagucuugucaauagccaagaucugccugacuuuuucacuuggggugcaguaguuaagagggaaugugcuggagcccagcucuggcauggccacuagcagguuugggagagccugugcuucaguugcuuuaccuguaacagggagauggaaauguacccagcuccuggaauuguuugaaagauucaaugugaauucaaugauauaacacaucuaaagcacuuagaagagcccagcacaugaacaaugcuuaaacaaauguuugcugugauuauuacugugcuuucgggaucacugugcaaaugacgauucuggucagcuaugcauucccagagcaguggaaggguucacuagcagcuaucuucaguaauacacugcagugagggguagucagauccaggcccacaauccaauaaaggugguuggucccagaaguuauuuugccagauaggcagaaaucaaauugaagagaagagcuuuggggagcauguguucuuuacuuccuuuuccucccucccucacccuuuucuuuucuuugcuauuuaaauaaaccaccacuuucaggccugccugggagaagauauuagggcagcagggaguccagcugggagaugaugaggaaagcagcugagccccugcuauuccaccucauccacuccauccuccccaauuaacugguaacgagguggugacgcccuaaccacauuucacuuccugcuaacaaagcuuguacaacaaaugcaaacacuuggcugucagcuucuguccagcacacagccucguuauccaucucacccuucugcaucuaugucagcauccaggaggcaggcccaggacgacaaaccuucuuugugcuacacucaaugccguaccaggcucugauggugcuuacaaaaugccuuugcccgacaguaacaagaaaggucccuuauagaugauuuuguaagaggagacauauucugugcaggcuugugucauuccucugauuauucagacugggaguaggggcagggaaggugccaccauuucauuucuuccuuucucaucugauaaaaauuucuucccaccucuuugaauugaggucaggucuuuuucccuuuucuaaauuugccucaaagaagucuuuuucauuuuuccuuaagaaugacuuuaauggucuacauuuuaaccucuuccucauguaauguaagugaucugcaaacuuucuuauaucuuauuccuuuugaauuucaaauuccuuuuuuucuaaaucaaucccauuauggcaagacauuauuacuuucugcucacauaaauacuaucauccauaauuuucucucuucccucauaaagcaugauuuauguugauauuuaaaaguaaauucugauauuuagucuaaguacugucuuacauauuaauucaauaacauaauuucuacgauagaaaaguacauaagaguacaaaauaugaaauaagcuugauauagacauaguuaucugcauuugaccagugaggaaacaaaagcucagaaaaauuagauaccuugcacaaaucacaaagaaaucagugguucagcugaaaauuagaaccaacaucuucugaugauuacacaacuuuucugguugacuaccaaagaagauacuagaaaaauuacuaaugagugaaaauaaaaagacauuucaaagucuuucauauuuaacacaaaauuauuuuuccauagaagauauucaagaagcaguuacacauuugaggagcuguuuuuuuuuaauuaaaaaaaccauauucuuuaucuacaucuagauaauguagauugaugauccaucuaaaucaagaauuuaucuucuacagugggaacaaauuacuggaauuuaagcaacgugaaaucucaucacuuuagcaaugacaaugaaugugauguagcuuucaaugcaguacugaaaaagcuuguacacugucacaugucccaggcccuuaggaacaaaguuuaguaugcaaugagugacgagcucuauaauauuuucauucgaaacagagcuacacaggaaaucuaggauguuuauaauaauauuuggaauauuugguauaaauguaaaacauuguaauaguuuucugggcagauaagagcucaucauauauccuuuuaguuaagucaagugacucuggaguccaguuauaccauuaguucaaacacuaccaaagacuaaauacaagcucuuacaggcugaauugcaucuccccaaauucauauguugaagcccuaauucccaauaccuaugaaugagacuguaguugaagacagggcuuuaaaagagcuaauuaauggcugggcaugguagcucacgcuuguaagcccagcacuuugggaggccgaggagggcagauugcuugaggucaggaguuugagaccagccugggcaauacagugaaacccugucucuacuaaaaauacaaaaauuagcugggcaugguggcgugugccuguaaucucagcuacucgggacgcuaaggcaggagaaucacuugaguccacgaguuggagguugcagugagcugagauugugccgcugcacuccagucuggguaacagagcuagaaccuaucucaaaaaaauaaaaaagagagcuaauuaaguuaacaugggggcauuaggguaagcccuaaucccauaaaacugguguccuauugagauuaaaacacagacauuacagaggguugaccuugugaggguaaagugaaaagggggccaucgccaagcuaaggagagaggucucagaagagacaaccgugcugauaccuugaucagcugacaccuugcugauaccuugaucaggguucuggaggcaggacuuccagccuccagaacugugagacaauaaauuacuucuguuuuagucacugugguacuuuguuauggaagcccuagcaaaacuaaugcacuuaacaaacuuaacaccuacuuucuuccuccagccucugugccuguguuucaugccaacuuuuaguuucuccuugaucugccaguaauacaaagaugagaaggucuggaaggaggauuuaggauaagcugagaggauccaucuuguaagacuauacuuuccuaugaaaugcuguuuccuccuuguugccuggaaaacucauccucaaucuucuagaccuacaguuggguuauucuucuucagaaccuuaaucucuucaagguggugccucugcuacacccuauaaacccaccucuggcacagcacauaucacaccauguuagaauugcuuccauuggcaacuccuuccugaucuugugaaugauuugugcugcuccagucacuauuaggaugaguuuccaggucaaccuccuguuuugaaaggagggacuuaccuuuguggucauguauuugacaccuaagacuuacucguuaaguguuuguugaaugaaugaaugaaauaaaaugaucuccauuccuauucaaauaagccuguaaauaacaguuuaagcauggucauauuuguuuguugagaaagagaaguauuaagugauauaagguuuaaaaaagcaauaaaaucugcaaaaagaaaagugucuauugaugaauuuauuaacaggaaagaaaguaaucgaggauaagaagauggaaaagguggaagaagagaccuugacaaccugaaaagguuauacccuugugcagaugugguggacaaauccucaccugagaggaggaaucaaaggggcaacugcucugaaaccggcccuagagcauccaaccuaaaaacaaugccuucaucaugaaguuccagaaccaaugauucaaaggauaccccacugaaaaaagacagucgucguccuagagguaaaaaucacuuuacuugccaauaaacagaaacaugagcaaaugggaaauaagcaaaaaugaaaugaugugugugcucucuuccaaagggcagcaaaagcagcugaguuaaugcuaauggcucacauaugguggguggggggaaaggauguuauaagucacaaaacccuggaauggagcagaggccugucggcaaguuagguggugaugauggagucaggaugacuuggaaacacugugaaaagauggcuucagauaaugggccauuaucugucugccucuuuucacuuugacuacuguccucuauaaauaauguagcuggcuaaucuaaaacauacagaaucaauaggaagccaaauauuuagguaccacaaaaugaggcaaaaaaagagcccagauuuucaaacaaugcaagugacccugaaaauuguaacuuggcaagucugcaauauugugagagcaauaacaaucuguuaacaucuagagggaauaaacccaaaagaaauaagaagccgagcuuuaugaagggaaaaaaaaaauggcacgccaaauuugauugcuuuucugauggaauuacaggauuacuaguuuaagggaguggagcagaugugauauauuugaauuuuauuagggcauuugggagaacgucucacacaauuuccuucacaaaacuaagugacuuuagcuugaacaugaacugaggagauaauaaaugaaggguaauaauacguuacagucaaucucaucgggaggaagguguuuaagaggugacacuaaggcuccuguuguuugggguggauagaacauugauuuuaaugaucuguaaaaaaggaagaauaagagugacagagaggaaacauggagauuuauuggacaaaaagacuaggaaccugguuaaaaauaccugaauauagggaaaaugcaagcuaacaaauauaucuguauguuuagaaaaguaaauauauuuggaaaaauauuugcagaaaugcacacaugaaaggagaaaaaugagaaauuaauaacacugaaaaguacacaggagaagcuccuuguaauaaacuugaacugcaauacagauauaaaauaagagaucuuaauaacuuauacugucauaacaaugacacacauagcuugccccaaaguaaauuuuagguucaaaaagcuaauuuuacuccucuuugaauuguaucauuauaaauuuuaaccuucaaguuuagcaauaaaaugacuuaaacaguuuaaacaaaaguguaacuuccuauaaugacagcagcauccaucgaaauacuguaccaucuguggacuagaaacuacccuucuucauccuagacuuugcccucuuauucaucuccacugaaucacaaaucuuagacaauucugccuccuugccucucuuugggaccuauccuugcuccuuguuccauagaugcuaauuugguuccagcccucauucuuucuuaccagcauuauuaccagagcccaguauugcaguaucacaucugcucucugugcugucagaacaaucuuucuggaaagcugaccauguaaauucucccuguuuaaaaaccuccaguggcuccccaugcccuauaagacaggccuaggcauaguguucaagcccuugaggaucuggucccuucugaucucuuuagcuccuucucuuuccaacucucuccucccuuuccacacucuggccugaagcccuuccaguucucggcagcucuguugucuguuugccugucuaccccuccuugcuuccuccuucaggaugccaugcagaugccauauuuugaaggaagccuuccugguuucuuucuuuccacucuuguuucuuuaguuuguuuaucaugcaauuuuuucuacucuaucuauaaauggugggaggcaggggcuguuuuaauccucuauguugcuagccugggacacacaguaggcccguauguacaugcugaauaaauggacccaaaccaccaauauaaucagggacugugucuacugguaaggcaggccuggguuugugauaaaaagugcauugguuuugugggcagcauaguggaggcagaaauaaccucuaaaaggacuacagugaugacacaacugacacacugcuguaacaagccaggggguaacuggggugugcaccuguuggccgguggcucuugaauucagucuuccucauucaucuggccuacaaaauaccauaguuuagaucagacccugcaggaaccauaacaaaaacugaaggacaggcuggucuuuaaguacaacuuagcagagcaugacaaaugcagauugaaccaaagugacccuucccaccuacaaauauagucauacuacaccucugcuuaaagucccuucaauggcuucccauugcuaggaggcugaugucuaacagccucaugucucuccucuuccucacacucacucauauuacauuaccacugguugccacaggcaccacaugugggaugcucccaugccuucauccgugcuguuuccuguaacugcuggaagugcccuuuacccucaacccuuucucagguuuccuggugaauuccugaucauccuugaagucaucucaaguaugaccuucucugagaagucucccacaaccuuucuagguagagcugagcaugccuacucagugucgccaaugcaccuuguaaucuaucaauuaauguaauugaacagauuacaaagugcauuggugucuguuacaugcuugcuccugucccacguuaugggccuuacacgucuuuguauucugggauucuagcaccauaccuggcccagaucaaggacucaaauuauguguugaauugaauuuguugaauucacaugaaagacaauacuuauccaaagccugaauggcuaaagugguuaucuuuggguuucuuuugacaauaggaagcaucaucagaauggacuaaaaugaucaagaaugugcagaaggaccuccauaaucaguaacuauagagauaccaaacuuuuuaguuacauaaauugaagacaagagcaauuacagaagauuauauuuaauggccuucagguacagguagaaaucacaugauauuuuagacugcuuucuuuaaaaaugcaucaaagcacugugaaaagccaaaaacauccuuuuggaagcagcauuuuauaccagguauuuaaaucuauuuucacugugaguuuauucagaguaauuguauaauaaagaaaagcacuuggcuucaggucacuaugcauauauagcuaaauuaugcaauuagaugacauguaauuaaccagaguagcaacacagccaaucuaauggggccaguuggggucugagugacucauaaaaacauuauguaguuaagcgauaggcaccuacaagaacaaugaauuuuggucuaccugcagccuaaugagucccuccugugacuaaagagguaaugcaaagagaggucucagagacagggcagugucaauggaaauucugucuaagaaggagccaagguaucaucuugauucuuauuuuccaaaacuucuaaugagauaagaaaucucuccaaacguacugcugccaacauuaccagcuugacucuuccauuaccacaaauaauaaacaaaaaacauuaguuaaagcuuauuuugaaugaacuugaagaaauacuuccugacccauuacucagguaguauauacaacagauugacuauucaguaagugaaaacuaacggcggaagaaauccaaauuagcuuucuuccuuuuccuucaaggauguauacauggcaagcaugcaugaauuaacacaguuaugaacaagaaauauuaucucuuguguaaagaucaagguuuacugucucauuguguuugguuuugggaacguaguuuugauuuuguuugcuuaagagauggaagaauuccaguucugaaagaauucaagcuaugaacaggaaaguauacuucaauaauugucccagugacccuuauuuuuauuaagaagaaucuagcaacugucauacuugcuaauguggcaauaauucuucuaaucuuaaauuuuuaaguaaggaaaaaaugaauauguagccauuuaaucacaaacucauccucuauuucccaacaccacuuauuccauauauauauuuacugaauauaaauauacuaggccucaguggaaacacgaaggaugugcaagacucaguaccugccuuuaaauagcuuacaaucuacuagaggaaugaaaucugucgcccacucuuuuauuuucuucuucgaaaugguuugaguauauacaguauacucuaaagguuuaauuaaaauggaauauauaaaaaucugaaaggauacauacuaaaauguaaucugaaagagggguagcaaauuauucuuuuugcucucuacauuuucuaauuuuuuuuuucccuaaugaggacguacuacuuguguaaaaaggagaagaaaguuauuuuaugaaagaugaaaaaaaaaaaaacaccucacucugguuagccugauauuuuguccuuuugaacacuuaaaaggccccauuaccaggcagagguugcaaugagcugagaugguuccacugcacuccagccugggugacagaaugagacccugucucaaaacaaacaaacaaacaaacaaacaaacaaaaugccccauugccuaaacucugaaaaagucaauacgggguuguugacaaaaucuauuauuacugcccaucuggugaucugcugcuccccuaccagugaggaagcuucuugaggucggggacucugucuuguuugcuauuuuguuuguucaauuccuaacagggaucagaggacaccauagauagguaauaaacguguggggaagaugggaggacaggagagcaggaagagagcagggaaagcugaagguacacacacuucugaggcuuuuguuaaaauuaaguauuuaaugcgaucacuuuggggaaaccacauugauuaaacugacgggaggcaugaaaaugacauaauugauacaaccgauaauuuuauucuucaacaaaaucuacuauuggccagagugccccuuugagagauaaugguucauaucagggagcaauuugcuuucaccccuugcauacaaagcggguuucaaaaccuauguaguuucggaacaaaagaaaaacuguaaugucuuaauuuuuaagcuuuuuucaaugcagagacucuaacaaagcagaucuaaugaacagggcaucauauugcauacugucugugugauuggcgccuucuggaguugugcagaagacaaccugugaggccauauuuagccacucugggcuugcuucaggcuuuaaguucuuguuguuaaacuuaauuuuucagauccaugugguuuggaagcauugugcuuaugccuaacuuuggugauguauugaccuuuguggaccaaggaugaaagcuggcaugaaauaaguacaggaaacuucauaaaauaacagccagcauuaauugagcaccuacaaacugucagagggcuauccaucuaugugucuaucuaauauuuagucuucagaauaacugugcaagguagauaucaucaccauuuuacagaugagcaaaauaagucuuagaaagguuuaguuuaguaauuuucccaaaagcacacacagcuaauaagucauagagugaggauguaauuuuaggucugaucagcaaccucaauaugucauucauccucgccuuuccucugaagaaaagcagcagcuugucuuauguauuuuaauaacacuggcauguuauaaaaaguuaaccuuuuuguuuugcaguuccucauuuuucuuuauguauuucucuugcuucuuguuuuuuuuccccucuccuccaauaucaauuccuauuccucuuacguuuuuguggcauuugagaaaccuucguugaaaauucuuugacagugucugcaagucuucugagacaaagugccacaaagauaauguuuaaauaaaauaccacauaguacagauaauuauauuuaggcuuucagucacccugaauauuggacaaauaaauucucuuggaaucuucauauugauguacauaggacacacacacaugcacacauaugauuagaauaauuuuuuccaaccagaaaugacauuugcuuuugaaaugauuaaauauuacccucaccaucagccaagauuuccaugacacuugaauaaacaaaaaaggaguugauuacugagauucuuuguuuuuccucuuccuuugcacaguaggaaaaguaaugauuaaaaaaaguauaaaacacauauuaaugauacaaaacagaacuaucuccaaugcuuugaagaauguauucuucauauccacuagggugcuaaccuucggaaagcuacaaaaucaauccugaaaguuuuaucucccauggcgacagagcccuuuuuuaagucaguaaauacuaaaagugauacaauaacagcucauauuuaggauuaccaaguuucucuacaggagacaggcucagguaucaagaggaaaacaaauauucauuaaaauaauuuagcaacaacaaaagacacgugaugaugaaagucuguucaaauaacaagugacuaaaauaagagugcugauaaaaaggaagguagcacugauauggaacuggguuuugguaacaauaugccaaucaggaauaaaaauauaaaucaaacuuaacuggaaugcauaaguauacccagcuuuacaagauggguagguuucuggccgggcacgguggcucaugccuguaaucccagcacuuugggaggccgaggcggguggaucacaaggucaggagaucgagaccauccuggcuaacauggugaaaccccaucucuacuaaaaauacaaaaaaaguuagcugggcgugguggcgggcgccuguagucccagcuacucaggagacugaggcaggagaauggcgugaacccggaaggcggagcuugcagugagccgagaucgcgccacugcacuccagccugggcgacacagcgagacuccgucucaaaaaaauaaaaauaaauaaaaauaaaaaauaaaacaacaacaacaacaacaacaagauggguagguuccuaaaaagcuuuguauaaauacaguugcuccccaacccccauaauuacuggaaggagagagagaaagacccuaaugaaaucuugcaguaaauucuaaauuacaaaccgaaaaaaaauuuugaauggcaaacagacacugcuuuaauucccugcuuggaaaguuuuuuuuaaaaaaaauuuuuuaaugaaugaugauuugaauagcaguauauuuuuuaaaaauuaggcaaacacguauaucacugcaaauaauauggaaaauaguauggaaaguggagaaaacccccaaagagcuaauuuccauuuuauauuugguauuuaaaugccacauugauaacugaacacuguaguauaaauaaauuauuguuaaacugucuuauaaauugcucaguccuucaguccauagucaauaaaauauaggccuugccugugguuuacucaagacuauagaaauucagaguaaucaaucauuccagguggcuuuuauagcuuuccagguagcaagagcuauauuuuauugaaugaggcauuuaauuaguggguauuauuaaagugcaauuuuccauauuaaacuguuuucuauauaaauuggcuuccugguaugcugacuuguaaugacaggauuaucuugcauucacucuuguagagacagguaauaacucaucuuugugccuguuuuuugauuccacagaauguuauucuuucugcugucaucaaaaaauaguuucugaacaaauauuauccaagauuuuucuuaugcuauuguccuauaaacucaauauuuuaagacuaaccugaaugcuaauauuauauauugugauauuucuuauguuauaaaggaaauuguaccauaauuucuaauuguagacuaaucgcagccauucuaccacaaaaaugccauauucaacacuuuuuccuauuacaguauaaaacaccauuugaccuuuuauuuuaaaaagacugugacaaauaaauacuaauuuaaugcauaaagucuaauaaugaucuagauuuaccaguguaagugacaggagguaaauuaauauggaauaaguauauacuucacauguuucuuggcauauaugaagaagcacugaagcaaaugaaucuaucucauguaaggcaaauauuauggaaaaacuccagaaucaguagaaagagauauuuuugccuuuucuuacuauggaaauucacuguuauaauacuuaaagcugcagaucuuuucuuuaauaauaacuucuguuuaaaaaucuguaacaagagauaccauugcugauuacauaacauuggugacauacuacugugauuuuuucaguucuguaccaaaagacaagaaaaaaacaaaaaacaaacaaaacgauaaauucugccaauguuuuuaaacaagaaugucuucuacaccaagugcuacuuucagauacagggcuacagugcuugaacaaucaccguauuagaaacaauaagugauacaaagaguaaaaacaauuuucaaaaaaaucaaacuuuuauaacauuuacauagacaccaaagaggacaaaauauccauuuccagaagaugugcaguauaauuagucagaaagguaucgcaaugcuuuugauuaugaucagccaguugcaaagauuaucaaauaaacaaucuagcuauugcugcuuugcuagaaaaaugaucaucuuaguggcaaagauuaauaacugcuuuuuaaaaagacaaaaacuagcuuugugauuuacuguguacuuucucaagaaugcacaguaaguaaaucaacaguuuguuuaaucacuaucaauguggcaugcuuuaauauauuggauauaaauaauugucacuaaaaaaucaucugcugcauguucagauaaagcuguagagaucucugccuuguuaccuagcaacugggcaaguaacugccauacugcaaaaaaaaaaaaaaauuccuuauuauuuagguaaagagaaugaucauaaaacuccacauuaagauguuaaugaagccaaaauguauauuaagauacaacagcuaacgauuuuagaugcauuuauggccuugguuuugaaauaccaugcaguaaugaaaacuguaaagauuuaaaucuauuauuucagcuugucacaaacaacaacguucuuuagaguguauuuuuaaaagaccacuguuauuauuaauuuuuuauuuguacucuuucacagacaaaggaauuucaaccagaucuucuguacugagucuauuuauugaaagggugaugcuuacuuguuuaaauacaauaaaacuguucugaguaauuaguucacugcaagggaucccaaauuauuucuuauauuucauauaacagcuuaauguauuaauuuuauaacaucuggaggaaucuggcuuaaguucuguuucaauuuugcuaaaaaucuggauuccaagauugugcauaaaaucucucuuaaaaagcaauaggggauuagggcaauuauaaaauuucacuucugagguccaaaauucagcauauggccagucuucaggccucaaucugaaaguaauucuuucuggugugugaugaaggcugacuggucagagcccauaugacgauggucacaugagaguaaggaaaccacucaucauugcaacaaacagagacuguuuugugaacagacagagcugugcuugaugaaggcuucacaggaauccaaaccccauagcuuacauggcauuccucuguugauuuaauguacgaugcuuuuauucauagucacuuacaaugcagggacacaauucaagaaagcucuucaaauuauugcauggaauuaaguuucuugauaaaacuuuacaauuuaagauaaauuaugcugaaaaguuaaagggaagguuggcuuuacaaauuaggagccgaaagcccagagagauugaguaguuggaaguugugcaacgauauaacuucuuauaaaaguaaauauauauaaagugcauagaacagugcuugccacaccagaaggauuauauguguuugauauuguuauuuuuuauuaguguaauuauuauuagaaguauuggaucuagaaucuguuuuuucguuuccagaacaauguucuuuucacuaagcacauuaccucaaaauaaagcacuguuuuaagaugcaccauguacaucuucuaugagccaaagcuguauuuuaaugauaaagguguguauuaaaugaagauguauacguagauucacauuaaaagcagaaaaaauugagucuucauaacuaguaauuuauaguuauuuguuuaaaaucaaaucuguaucaccuucaaauauauaucauuuacaggcuaauagcuaaacgcaagucaaaaugguaucccaaaggaaacacuuuacuaguguuaguguauagaccaagauguauaaacuuucccaucuuuaaauauuuucucugaguuacauuuucacuaauucauaucaaccauuaaccuguuauuuuuauuuuuauaacauuaacuuuacauacauauaaccugauacguuuguacugaaagauuucagacauuuguuggauuaagaaaaguuuacucugagccuaaagaguucauacauauguacuucuugaucuugauuaguauauauucaucauaugcuucucuguauuuacauucucucucccuagcuggucucaucuaggcacguggcuuuagaaacuaucuauuugggggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagcugagauugcgccacugcaguccgcaguccgaccugggcgacagagcgagacuccgucucaaaaaaaaaaaaaaaaaaaagaaacuaucuauuuggggagucucucagauguguaucuagcauccugaucuuuccccugaguuccagacuaguagacccaaugaucugcuugacaauuccauguggaugucaaguuucucaaacuuaaaauaccacaaaaaaacucuugcuuccuucuuucacuaguagccuaaucuguucaucauccacucaguugcacaggccccaaauuuagaagucauucauaacuccucccuuuuucucaucuuucacauuaauucauuagcaagaucucuagguuccaucucuaaaauauacauuccagaaucugauuuaagauggaaaauuuaaacugcuucacagaacuucccuuccucaauaucuaaccaaaggagaaaaaaagaguaaacauuaguaaaaugaaaaaaagaaguuccaacaguaaccacucaaggaaaggaacauuaacaacuauaauaaacuucaaaacuggcagccaaggaaagagaagauucuggaacaggcuaaagagacacaguguuccuugguucuuaacccuguguucaacccuagagagguaaacaaaauucugagacuuuuugcuaauaauucuaaauuuagagaaaaacacauucagugaacauccuuauguuuccuuuuacuacuaaggaguaauaggaacaugugcaaugaaagaagaagaucaaagggcugauucaacagaagugaacacuccagggcugcccacuauuuuggggaaacccaucaagccccagauuaucucgaggauagcuacuagcucuuauggaacccuuuaguuaauuauaaaaaggcuauccuugguaucucucccuccaccaccccccuugcccgccccgucaauuuggugaaauaaaggcugauaauggagacauuuaacacaaguuaaggaagcacggcccaggaaaucuaacaaagauugcauacagcuugaguugagcugagcugucuaccucccucugcaauuucuuuagguugcagaaaaguggauagauccaagcaauaaaacauagcucaaagaggaagcaaacuggucuccaagaaggugggaagaaauuuaagaaguuacucacacuaugucuggggaaagcugcccaggcaccagcaagaugaaaagaaauagcacggcagauaugcaagcauucuaagggagggaggcaggaggagggaaaagagaggaaggaaagagggagggagggagagagagagagcaacaaagugaagaaaaaauauaaaaugaaaguaucacagcauauaggaacuaaaucuagaauuuuauucaaauaaacagaaagaaauccucacacaaacuuccuacuguagaauaacgaguucaaugaaaauugaaguuuaaagacagaauaaugaagaaaucugaaugagaugaaaaaggauauuguggaccuaaggaagcaaauuaaggacuaaagaucauaauuuuagaaucaauaaacaaaucagaacaucagaagcagaguagacacuucugauaguugaauuacugacacagaagaaaggacccagguaccaugaauggagacacuucugauaguugaauuacugacacagaagaaaggacucauguaccaugaauggagaugaaaaugacaacagauuuucaucaaaugauaaacuaauagauauggaagagaugaaagaugauccaaaauaaggauaagugauguuccugaaguagguaacaauguaaguagaauaaaagguguuuucaaagauaugauacaguaucugaucuaaauaacacaucauauuguggaaaauucuuaagcagaccauccaacaccuccacauaucuuagcuauguuauuaagcuauguggauaaagaaagaauuccuugggauaaaggcagaaaaaaaaucaccuacaaaggguggccucagacuauacagagauauucaaugcuauuaaacaaugaaguaauagcugcaaaauuauaauggaaagaauacaugacauaagaauacaacguucggccaugauauauuguucgacuacaaaagcaauaggaagacguucuccaaaaaacaaaacaaaauaaaacaaaacaaaaaacucacaaaugcagaauccaugggucuuucucgaaaaaaagaaacaaaaagcaguuggcaaugaaaucuaggcaauucagugaugaaucaaagaacucagucagaaugaagaagauauacuaaagggcugggaggcaauggauccauuugaacauaggaauuuauacuaaauaaccauaguaauuaugauuacagaauagaaaguaaauauuauaaacacaggcaauauaaauuaguuaaaauuguuagcugaggagaggaugggcaaaagcauuaccuuucaaagcaaggaaccaaucugauguguuuaaaacuggaauaugcagcuuaaaaaugugauuccaacucugagguggauuuacuguuaacgcuaaggaagcuuaaguuccaagguuuuuuaucuacacaggugauuugcguuuucccaugcccuggaaggggucacagcagugcauucauauugucauauuuuuguaaaauuuguaaaaauacuccauuuucuuaaagagggcccccaaauuauauaaccuucccacagaaaucuugauccacuccugaucaaaccucuuaacauuuuucaucguauuuuuucuuaaccauaagggaaaauaauaacucccauaauaaggagacacuuauuggaaguucaacaauuauuuaguuuuucuuuauuuuuuuucugcuguuaaauacaauaaaaccauuuuuuuuuugagacagucucacucugucucccaggcuggaguguaguggugcgaucuuggcucacugcaaccucugucuccuggguucaugagauucucaugccucagccuccugaguaguugggauuacaggugugugccaccacacucagcuaauuuuuaaaaaauauuuuuaguagagacaggauuuggccguguuggccagacuggucuugaacuucuggccucaagcucuccaccggccucagccucccaaagugcuaggauuacgggcaugauccaccaauaaaauaaauuuuaauaauuuuuauuuaaaaauagcaucagcauuaugacuccacaguuauaaagucuuucuuucuauccgcacagucauguaucaaucccuuugcacauauuuauagaaagaugccuuaaaugauauaagucuacugcuaaaggugguuauuucugggcagugguauuugggguaauuaaaaaauuuaaucuuuguauuacaugcauugucugaauuauuuauugugaucauauaacaaauauuucaaaaauaauacaaugacuuuuuuccuucaaaugccaagauaguaacagauauuauuuuggauggugagaacuauagggaacuguuauuuuguacuuuguauuuuccuguguuuuuaaaauuucaaaaauguuuuccaaaauuugauauucugaaucauuccacaucucucccuuuuucuucuuccagccaagucacuauuauuucucaccuggacuacucucauagucuucuguguggucccaccuguguccauccuagcccugguauuacccagucuuuacacagcagccagggugugcuccucaaauguaaaaggaucacaccucugcuuuacauuccccagcugcuucauauugucuuuagaauaaaacccaaacucuuugccacgaccagcaaggcugaccugagcugaccgggauucagucacgcuggacugcucucugucccccacacacugcacuuguucccccugacagauauuccaugagcuguuccccuagccugggguguucuuucuccagcaucuccguauagcugguuccuucuauucaggucucuguuggagggccaccuucucagggauacccccaaauuuucuaauuucucccuccaucucccucuccagugcuucacccugcuggauggccuucauggccuuuaucaccaucugaaaugaucuucuccauuuauuuauuuacuuccuuuguaucaauccucucccacuaaauaucugcucuagaaaacuaggaccuugucuaucuuguucaucauuauaucuccugcucaaagaaugugcccagaagauagcagacacuuaauaaauauuucuccacucaauggauacacacagagauuguuucucagcuuaaaaaggcuuguguuugcaaagcugucuuuuaagucaguuguuuagaauucagaaugcauguucuuuaaaaugagucacaguacaaauucaauaucaagccuagcucacaaagucuacuggacccauaaugaguuaaacuucuguauaucugcaacaaaaaugcuagaaaaucaacaugaugaauuaucacugggaaaauaggaaauuaaaaagaaacauuucaacugaucuaaauaugaacaaacuaugacuauuauuucucucucauauuggugaagacuuuugugaauauucugaagggaacgucagaaccuuuuuuauuuuuuuuuuuuuugagacaguguuucacuccuguugcccaggcuggaguacaauggcacuaucucggcucacugcaaccuccaccucccgggcucaagcgauucuccugccucagccuccugaguagcugagauuacaggcacccgccaccacauccgguuaaucuuuguauuuuuuguacagacugguuucaccauguugccaagacugguuucaaacuccggggcucaagugauccaccugccucagcaucuaaagugcugggauuauaggcgugagccaccacacuuggcuucagggcauuuuuaagagcugcagaaguuucugguuuuuuauuguguauaacuucauccaaaaauguguagcuuuuggcuccuuugauaacagaccauuaaauuagaauaauguuuguaacuaugaguuuuauuaucuguuuuugguuuuaguuaaagcuugggaaugacuugcacguaguuguaacugcaacaggugguauguuuugugaaugcuuaccugucauuacuugagucacuguuugugucaaaaauguaaaagaggaacgaguuucugggagguauuaggaagagaggggcucagaaggaaaggaauuaaagaggacgugugauuggaaagauaucugagauaagagcagcgaacgagaggaaagaagaaauuagugaugaaugaucagaagaagacagggaagacgacuuccuccugcuagcuacuaggaaauguuaucuuccaagacagcuugguuccugucuagaguagcucuggguggguaaauggagggagggccaguuuguaaauaacgcugaaauuuaagagacuauauauuaucuaauuugaggcuuugucccaaauuugguuuggagugaguuuuuaugacuaaucuaccaguagggugaaauaaauagcaucauucauaucaggaguaccaaccaaccccauaagagauauugaagagacaaugccaaccuuccauucuggaguaaagcuauagugcaagaaaacaauuugaaccaauuauuuucauacuaaguugacaguuaagacagaaaaaaauauauauauuaagagccaagagauacugcauauggucugcaagucuuuucuggagaaaugaaucaugaagauaaagagaacuggcuuauuuuuacaguuacauuuuauauuucuagaaaaauaacuacaacauggucuugaugucuaaacauagggaaaugagacuuuuaugaacguuacacaacacaaaacauaccacuuguugcaguuacaacuacgugcaagucauucucaagccuuaacuaaaaccaaaaacagauaauaaaacauauaguuacaaacauuauucuaauugaacuauacuuugaaaaugacugaaugcucaaauauucuuaaaauacaauguucucuugccaagaaaagaguguuggucuuaaaauggccacaaaaccuagccccgucccauguuacuagagcuacagaaucaagcacccuccaaauauauggccaagcagccuuggaggcaccuaaugaguccaacgcagucuucccaugugucucagaggcugcugucuguagugacagaggugauagaauaugguaaaguugcguaucuaggaaaaucucaauguagucccugauuucccagagaauguucuuguggcuuauccucugagguuaguaguuucaguuuaguacauuaauuccaaacacuaaagagaugaauccauucaagucauuuacagaaaaauuguuuugagauuuacccaaaaaacaaacacacuauaaagaauuuaguaacagagaagauuagaacuugcacuuuugcuucugcugguucaaguuuuguucugauauucucugcauuuccuauuuccauaugagaaaaccaccaguacaucuuugcugugugaauaccaacacugagaaauauuggccaaacauaaagauuuuuagagaauuaauuuuugauauucaucuaaacaagccaauauauucucacaauuuuuuaaagaaaaaaaaaagaacucagcuuaaucauauauuugacuucuaaaaaaucaucucaugauuccaugaagauagagaaaaaaucagaugaacaggaaugguuuucauuucacacuggaauuauaagaaagguuaauuuuugcauaaaaauuacaucuacauaaaaauaauuucuggaacaaugcauuauugacaguuaugugggaagauaaaugcauucacguaaauguucuuucucaagcaaauuacuaaauauauugacagcacugcacuuugaaaacaaccauuuuaaggcaaccaaauacauauacaagaguaaaaacauuacauauaauagccaauguaauguuucacucaaugcauauucacucaaauaugcauacuuuuuuucaguuuauugauauauacugcuauuaaauuaaauagcaaacacuuaugcuuuguuguuggcuauugcccacagaaggaaaaaaauggguagucaacuggagccuauucacacuucuguuaauuacuggugguccauggaagauguuauaguuugauuacuagcacuuguaaauauuaaccaagucuaaguuacugcuauaaaauccaaaauguguaaaaaccaaacacaccuauacaaauacaaauguuuuacucaugaucguuaaugacuuuaaucaagcagaucuucuaauuaauuuugcuaauuguucauuccucucaggacauuuauugguuugauggauauuacuaugacauauguugaugccagcaucuggucagaaaugagggcaucaauaaacucuccuugguguuucuacagaaugugccaaugcuauaaacacugucaaugccacagcauuuauuucaauauaagauuuugagaacaugucugccuuucauuuagagaaaggauaaaccuacuucgaaacacacggugcucaaauaugcuuauucaaugaauggugcaaugagaauggcuugauaacaaacuggaaaacaucugccaacauuuaaaauagaauaauaacaucauaaacgauuauuaggaauggcuucccccacaauguacucugucaauuuauacccuauuucgaauauguagacuaacuuuaaacaaauauaguaccgcuaucuuaaaggaagugauccccuaaacauuucugaccaaagguaaucauaugcaguaaauuaauagacaagaaaugcaucagaauucgauucauguauagaaauuuggcuaaacuugcaaacuuuuauguuguuaguaacuauucagagauuaucacuuuaaacugcugacaaauaagugcacuuaugcaguuuuauuuuuaaaaacuaguuaucccaaaauaucauauuaaauaauacaccaugcuguaucuauauuucaaaauuauuuuaauggagauuugaucuccagguagaggcaaaacacuguuuucuccuucuggcccccauuagggaaacuguaacaguaugguugucucccguuucuacacaugaaucuauugucacucuacugucauggcuuaagaaaaaaauauugcuucuacucaaggugccaaacugcaccaagcaaaguaacuccaaugcaguaacauuaaguuuggcaacugcaggacaagguuuccauccuugaacaaggagcacugauacuucacuauuuugccccccaacaucauauuucccccugcauucugaagguuuuuuuaaaaaauauuuguaacaauguuuuuguaugacacuggcaucaagucucccaggcagcaugcaucuguuuuaauuucauuuguauucguuacuccuuucuucucuaucugaguccaagagaaucacugcuaacacacccagcacuacucaggauagacaacgacagaaugaaacacuucugaggaagccuuuccgguggcauaaugccagcacuacucauuauagccuauuuuaucacagagccgucaacauuacggacucgaauaacccagauaccagcggcauccccuugcacgagcucaucugcggaguacaaggaauacagauuuggaagaaaccucugagagguuuucuaaucuuuccucucuuccuucugacuucuaacuuuaacgugagcccaccccaaagaagagaacuagacucucuuaguaacuugugcaaaccuucagaaaagucuuagguuguaccuaaauuccucauguugccauuccaacacuauuuccuguaguuuucccuuuccagaugcaggaguccacagagcaaguauccuuauaagugucuaagaaucaucaagcaauuccaaaguucccgugucucuaaucuacugauccaacgugcccggcgcacauaagcagcaccgcgacugaauuucaagucuucucaaacucacaccucaguugcucagagaggagaaaugcagcgaggacucgccuuccuggccagucucugaaaacgcgaaaccuuccugagcuguccauuuguuuuaggggcuguuuauaaacggcugguuuucuuggaggaaaaauaaacaaauaaauacggggcgauggcagcauccugauaaacacaggaccuuguuuggcuuuuggcaaguuguaaccuggaguaaaaucacauccaaguuacaagcacgcaaauuggaauuucgcuggaaacacugacccgaccuucaccgaagcagcaaaucgcagucucugcugcucugcuccugcucuccaaggcuuaacauuggaaaguccaugcccacgucccccucuaauuaaucaauguagaaagaaauacgagggaagagagagggagcacacuccacaccaaccuugccagcuucuauucuuccugcuauuccuuaaaggcgaugcacagcgcaccuggaaauuacguggacuuggcauggcuuuuuaauauuaaagacaaacgaccuuuggaaaauauacacuguuaaagucaaaccauuuggagagacacccagcaauuuaccuccucaaacuccucggaaccccaagaaugaggaaaggaaauggaaaaugcgcuuaacccggggguggugggggaaucgauaaccagaacagguuugaaaaaaaaagccccccucccgcccccuccguagagaccgcuagcugaggcugcaacaccugccccggcaaagcgucuccgcagccuucccggcuugcccgacucggcuuccuccgccucugccccggcugcggcaccacuucuuggagccacgucucggcgagcgggggccgcggagcgagggggccgcugugccgcuacucacccgagccgcucgggcuggccgcgagccgggauccgcgagggcuggcgggcucuggcccccgaggacgcagacauguggcuugaaccuccgcuccccuagccguugccucugugcaucuuucugggcgcccccagcgaaugcgagcggcgaggcgagggcgagcgcgccgaggaagggcgggagaggcgcggagcuuggccgcgccgcgcugcgccgagcgccgggcucuccccgcgagcuccccgggcccgcgcgcgcgccccccacugcccccgccccccgcgcggcgcgugccccccaccccccgccgcgcgcccucgcacccgcccggcuccacgcggcgcgcgccugcccuggcggcagcggcggcggcggcggcgcguccucccccgaacgccgucuccagggcugcuggcugcgcucuccauuguuccgcggcugcugcccggggugggcggcgaggcgggggggaggugucggcuuggccgccggggagggcuuaccgcucgggcggacccucacugcgagagcgaugcgggcccaggcgcggcgcgcgggggcugcagggcgccuagcacuggggguugccggcgcgcgggggccuccuccuggcucccaggcacucgcugcugcugggcgccccucgcauccucgguuacuauggauaucucgcuccuccgccgcccccuccgcgcacuccgggaggccgccggggcgguagcagcggcgcggcuccgcgggugcccaggugaccggcucggcagcggcagagcaguggcagcagccgccacugccgcuguuacugcggucgccgccgcuggagagaggaggacgaggagggcaaggggcagaagcagguccugcucugucugccccagaggccaccucggguuucuucucacuaaccaagcgacuucguguuuaccucgcaggagacgccucggcaguccucaacuugugugcgccgguggcccucuccugugggacuugcguuccagcuguucucagagcggguaugaucggccuccaguagacuuggagggucacgggugagauuuugauaagguucaaauacuccucacuccugccuccgguuuccaccaaaguuaccauuguacuacuaccaacaguuguggaaauuuacuuuggcaaagguuuuguguuuuuguuuguuuguuuuuccccccaaaaauuaugccaauuaaauccgaccuuaaaugacaaggcuuuucucucauguuuaaaaucccauuuuuuuccccuugccauaaauaaauaaaaauaacuuguggcuuacaggcugcuuaauaccacaacauuuuaaugagcaugucagguaacccacaggcuucaguucuuuguugcuuacaaguuccauccguaagugugaguugcucacuuagucugggguaacaaccgcagauucccacagagaagaaucagugucuuaaaacaagguaauaccaacccaauggucuaugaauagguuggaauggcgguacuuuaaguaaaaguauaaagaaaugguuaacauuaugaggaacuuccagcaguacuaauaaucaacccuguuguucaggagacauucacuugcuaaacuuuaaggcuaggcauuuacugccuugaaagcaaagcaaaugaagauuuugaccaacugcaacauucaggcucuaaaauagaaauaugaaugaauuauuaaauaauagguaacauuuacugagcacuuacgauuuuccaggcaucugugcauuaucucauuuaauucuuacaacucuaugaagguuucauuauauuauccucacuuuacagauuaaaaaaaaggcuuagaucugcaacugguaguuuuggaagaacauucuuuuccuuaaacaggaaacucuaaaugcccucuguuuuguccaccuuugugccacugucugcuucugugagggucaggauaauaguauaccugaaaccgcccuuuuagcaagcggcagggccaggacauaagcucagacuagaugucuaauucacuugcuauacauguaacauguaaaauaaaaaagaccugcaucuugacugguguacucuuugauaaaugggaccugauuacuugauggaggcauguuugacuaucuuuguuuaugacauuagcaaacuuucaauggguuuggaagugaggcuauuuaguucugugucuuacucugcaauccagacaccugugacuugagguaaaguaaguguuuucuugguuucccaaucaugagagugaccgaagaaugacauuuuccaggucaucauucucuuguggauauuguucucugauaacaauauugggcaaucucaaagagcugucauuucuuggcagugaacuacaggcuauuuggaaaggagguguaaaucacuuuuucaucauguccaguccucugcacucuagagucauuugggauguuuugugucugcacuaccucuagagaaugauggaaaucuaauucucugucagcuuuucuaccuggcuagugaaaaugcuucuugggagagcugggaggggaagucgcuguccaugguggucguuacugaagccccauucagcaaaaucgguucauacucuaaauacuggaauccugcuuaauuaaacuaaggagcuucugcacagcaaaauaauaaacagaguaaacagacaaccuucagaaugggagaaaauauuugcuagcuaugcaucugaaaaaggacuaauauccauaaucgauaaggaacuccaaucaacaagaaaaaaaaaagcauuaaaaaccgggcaaaggacaugagcagacauuucucaaacgaagacauacaaguggccaacaaacacaugaaaaaugcucaccauugcuaaucaucagagaaauggaaauuaacagcacaaugagauagucucacaccagucagaaugacuauuauuaaaaagucaaaaaauaacagauguuggugagguugccgagaaaagggaaugcuuauacacaauuggugggaauguaaauuagcacaaccccuguggaaaauaguauagggauuucucaaagagcuauaaacagaacuaccauucgacccagcaaucccaauacuggguaucuacucaaaggaaaauaaauuguuauaucaagaagacaccugcacuuguauguuuauugcagcacuauucacaguagaaaagauauggaaucaaccugugucuaucagugaaugcuuggguaaagaaaauguaaauauacaccaugggauacuaugcagccauaaaaaagaaugaaaucaugucuuuugcagcaacacggauggagcuugaagccauuauccuaagugaaauaaaaccagaaaaucaguaccacauguucucauuuacaagugggaacuaaacaauagguacaaauggacauacagagggaaacaguagacacugggaacuccaaaagcagggaggaugggaggggacugaaacugaaaaauuaccuauuagguauaauguccacucuuugggggaugaguacacuagaaacccaaccucaccguuauacaacauauccauguaacaaaccugcaucuauaaaaauaaaaauaaaaaauaaacagcuguuaauuuugcaaaauaaguaaauauuacagucuggaaauuaacuucaucauggcacuaaugaaauuuggugauauucuccaguacuguauauuaaaacauaaagaucuuaucaguauaaucuacugguuggaguaaaaacauuaaauaauucacaggagaaugacuuuuuacucuauggcacuaaaauagccccuauucauugucaaauuuuagauauuuuuagguaccagaacagcauaaaggggauaaaucauuuccugaaacccucucaccuuacagcaaagaaaauagcuaccuauagagguuaaccaccauaauuagaagcaggcguaaaaccaugaauucuugccacagaaucacuuaucaugauucugugaugcaccaggauauugaaugucagaaucauucuuucuucaguaauuucauuuuuuugcuuaaaaacaauuuccaauuuaugucauuugaaaaacagauaauauauagucugauguaauauguagcucauguucauuuauguggaguguaucuaaaucuuauaauauucuagcuguauuaaguaauauuguuuccugcaaagugagacaguagaaaaaacucuuaugguaccaauuucugaccacuguaacccagugaaaagcaaagcauuaauuucauuacaggucaucaagaaugcaaccgucaacauaaacugcuuauuuaagagcagccauuuucuaucagaaaggacuaauauuaaaauuccccacuuuccuauauucucccuuuguauuaaaaaauuauccaggggaccauguugaauauuccagucucaaaaauccaaagauggugguaauuuuucuaagagauauguaaggcccuuuguaagauuuagaggaauaggauuuuaagaguuuauucauuuguuuaguaguaguauaaugcaauaguuaaucuccugacuuuggaauaagaccuguggauucaagucauggguauuuaacuuaauuguuuugugaucuugaguaaguuacuuuuuugagccaugcuguucuaauuugugauaugaaugugauaauaauguaagcuacuucacaagaguugugguuggaaauaaauuagauuaccaauauguaguacuuuucacuaaguaccacacuacuuuucacuaaguaccacacauugguaauaucauuuggccagguuaaaguuuccauuuacucaaucaaagacuaaucuagguguuucugugaagguauuuuguagaugcaauuaaagucuauagucaguugacuuuaacuaaaggagauuaucuuagauaaugucauucaacuaguugaaaguccuuaagagcggcuucccugaagaagaaauuccaccuguggacggcaguuucggcucauccacaagaguuuucaccugcccuuccuaauggcuugccuuagcucagucuuguccagccagucuccacaaucauguaagccaauuccuugcaauaaaucuuuuuguauaugucuccuacugguucugcuucucugacugaaccccaacuaacacaccauguaaagcauuaacuauaguaucugugacauaauaaacacuccaaaauauuaguuaauuuuuuaaauuaacccuuauugaacaucucucacauuuauagcacugagguauacacucugauaaaaaugucugagagcucugaaauagaauagggauagauagauacuuauugucuccaaugauaguaaccucaaccaggaagggauuuaauguuuuaguaaaauuuccaggaaaacaagggaaaagugccaauggguugauuauuccaucuggagcuauguaggggaauuaugcaaauucaguaugaggccaguuuccuggguuaggaagacaaugaacaaaaaggcaguuacuguuuucucaacagauccauauagauguagcaccugaaacuagacacaccaguuuccauggaucaaccauggaauuccauucuguaagaaaaauuuauuuacgacuuggucuuaagccaauuggaauuauauacuugauaacugccuugagauucuuggaggaagaaauacgcucauauuuaagaguauuaaaguaaaagaucuuucuuauuucaauguuagcuuaucuuaguauucuacauuguuagaucuuugaauuuguuuugugcauuuuuaagcaaggaaaaaauacuuauaucacuaaaaagcaggcauagcacaaaccuacuuaaauagaaucugccuccguccuucagaauuauaaugccaaacuuacaaaacuuaaggcuggaaauaucucagaugaguaaacaaaccucagggagguagucucagauauaaauaggauuaaaaggugaugagaaaguaagagagagugagagcaugccuuuugguuuuauauuaaagcucugauaauuuagagugaaucuuagaaauagaaauguuuuaaauuguguguuugcagguguguauguguguauucacuaaagacagcugucccaugauccuuuaugccauaauaguaauuuucucaaaggcagugcuauugcuguaaaaauacuuuuacucauuaugcaaagauuuauugaauaccugugaugucauaugucgagcugguugcuaagggauaggaaaguaaauuagagauggacucuaaucuuguggaacucucucugggcaacucuaauuuauccuuauggauuucaacuaacacgugacuuucucuaggaaauuuuuguacuucccuugcucugcacuggccuaggcaguucucuuuugcucucacaguaacuuugcuuccacuaauauugcauuuaucauuuuuuuuaguaauuagucaauugcuuauaaaucucccuauaagacugcaugaggucaaggaccuuguuuaugugaaccucuauuuuugcucggcucuuguccucaaauaggcauuagguaaauauuuacagaacgagugaaagaaagcuugggacauguugaauuuuaauugcuuuccaaauagaaauaugcaggaagcagaaaauauauaaaccuggagcugaggacagagaugggugcaagggauacaaauuuguauuagcugauuccugguaguuggaaggccuggguggauuaucuucaaugaggcucacauguagaauuaugaacgagaaagucugaggucaggacucuggacagcguccacacucuccauuuuaucugugggaugaaacauggcccacauggcuaggauggaaauguuuugggaaacccaaagcccaaauaaaucuuuucaaccaugugaguaaguuucuaauagauauuucagaacuaaguuacuguagagacaggagcacuauaaauauggauuuauaaucaugacauuguggaacuuuaccucccaauauguagagagcaggguuuucaauuucgcaaaauaaauaaaugaauaaauguuagcauauguuaauagagggcacaaaauagaagucagagagagaaagagugucuguggggacucaacagacucugugggaaucagacucucugauuuucucucucaauggaaucaaggagucccacgaguuaggcauugggaaaggcucucuggguggugaacagacauguguggcuauugguggugaauguccaccacagaagcagcguggcucuuccuuauacucaaggcuuuuuuuugccauuaaugagaaguaagacacagacugacucccagcacuuaccaauuuuauuauucuuauugccuccucauacuuugccaugggaaaaucccuguuuggaucacaaauuuaaaacaauagacugccuguuaaccaugggcauauuuacagaucugacuaugagcuaauacaacccagagugagcagaagggacuuauacuuuuuccugaaggcaagcaggcuuggaauccaaggggaaugaauauaaacacugagacccaucugccccagucuucugaauuaaaaccuagggacuucuuuuguuaacucuguucaaggcccaaaccacauacagcuccauugagccacagcuaagauuuuugcuugcagccuuugcuuagaacuggccccugagagucaguuucaucuguacagcacaguugguaaguaccucauccuucccacaccuuuaagcaacagaacagccacagucaacacuuacagcaacuuucaagguuagcaaugaaagaagaaggcugcaguaaccucaucuggaugccuguuuuacuaaguaauuauacaucccaaauuucacaggacaaccuucuuuaaaugaaucagaucauaaaaucugauuuuucacuuaggaaaauaugguuaaaucauauuagagacucauacuuggagucuucaaggagguagcauaauauacagaaaaaaaguccauggacuccgaccgugguucaaguucagcucuaucauauuuacugguuguagacccugagcaacuugcuuaaccugacugcaccucaguuucugcaucuguaaaaugaggauaaguguucuuuaaagauguuguuuaaggauuaaauauaaguacacucauauaaaaaucuagcacaaugccuggaccacaauaauuauucaaccagagaaucaaguucacccuaguacaaauucauaagcauucagaaucaagaaguuauuccagcuuaucaacagaacuaaauaauaaagcucauucccacagcaccuucuagugugcuuaucagcuguguaagugaggaggagcccaugaacuugggaggggacaguaacuuuuuauauuguagacucauaaaaaugauuuuauuuuuuucucuacaggauuuuuagaggacaaaauagucucucauuugauggugauuauguacauuauuaugauaauucucuaggaaugcacauuaaggauuuugaaauauauuagaaggacaaaggaagaaagaaugacauaauaaauauuaaaacauaauuugggguugggauaauugaaucuuaggauaaaauauggcugauggccauuguuuuuuccugcucaacacccggugcucuauuucuguuaccaauagucugauuuguuacuggggacccaacucucccacacuuagcuaugaaauccuagauaaucaaccuuaaaagagcuggccauggaguggacccaugagccacuggccaagcagaagauuccaucaugcagccacagugguuuguucagagacggucagaaccaagacuguuggaacuacugggaaaaaggggaacucuucucacuggggcuucugaugaugagcuugguauuaccagggugccagguguaaugccuggagcugccaagggccaucuuguggagagggucuacccaagagugaagccagcgcagagaaaagcagagcagagauauggauuggaguccagugauaguuuuugaggcucuggauccagucaugccugaaaccuuuggacuuuaucucuuauaugagccaauaaauuuuucauuuuacuucagccacuuggaguuggauuuuuggcaguuguaacuguaaaguguccugauuucuucagcagggaacuuaaguauaauuuaucucaaccuccccucugauguuugaaucuucucuacaacuucuaaugaaagagucacucaaucaaggcuuggacuccuccagugauagggagcucauuaccaacugaagaagcccauccaucuuugagacuuauauuacugcaaaauuuuuucuuauaucaagugaagguuucugaaaccuuuguaauuaccacuuauuuuguacccaguagaggccagagacccugugcuauguuauacuuaaaaauauacauugugauuuaauucucaaauuaaaaauuugaaaauuuuauuuuugaaauaauuuaauaaauuaaauuaauaaaaauuaauaucuaaugauauuaaaauuauuuuagaagcugcugcacaaauccaagugagaaaugaugagaggcugaagcaagggcuauggggguggggauaaagaagaugaggagggauccagugauguacagauguagcauacaggugacugaguggagggugagggcaagagugaaacaggagacuuggagggccuccagaaaauagacagguguugaaaagcagggagaaacaaccuggaugggaaagaugaagguucugcuguuuaucccaagaguuaccauaagucgaaggggucacuacuuccaaggacacaugauagcucuacaaauuucuuuaaaauuuuaacugaaucugguuuaguguuaagaaauaaucaugaacagaauuggaugugcaucaaaagcaaaguuuuagaaagaccugcaauuuuugcacagaccuuuaaucacaugagugcaagucagaauaacacuuuuauguucagcccuuaagacugguuucucccuucucuccuccugccagugccccagaaggcagaggagaggauccagagaacucagcacgaagaugcagcagaguuugccugagccacaggggaugggagucugaccgugagguccaggaaccaaagagaagugcauuccaguggaauauguuucuaggaaugggaaagagggagaaagggaagaaacauuuuauguauaccuacuaugugccagguccuuuuuauguaggauuauuauuauuauuucaguaucacuuuuuuuuuuucccaaauguaaaaacuguggaggucugcaaaguuaaguaauuuuccaagaucaagcagcauuagaauuaaguccaggauguauguaugccucugagaucuguaauuucuucauuaugcuaugcugucuccuuaaauaauuagcaguuauaagacgcaaguuauaaggugacaaaauacauugacaugguaucuggauuaacaacaacccagaaggcuaguauuucuaauauuguuucuauuuuauagaugaggaaacugagucccuaagagguucauugacuagcucaaggccacacagcuaguaaguagaaccauagcuggaacuaaaaauucccaucuccaagaucuguguauuuucccaugacacugcagcuacuacgcugggcaagcuacuaugaagcuggacuuugucagaacagugacagauaacagcuuugcucugaaacguucuuuccuucaaaggaacgcacccaaccuaaugcuugugguggcgccugcuuucacccacauuggcucacaagagaaagacuccaaggaaaaaaggaaugagggucccuagaguuucugaugaggguagggcggaggugcuuucaaggaugguuaacccucucucagggcugggcgcaaaggcuccugccugugaucccagcacuuugcggggccgaggugggaggacugcuugaguucaggaguuugagaccauccuggacaacauagcgagaccccauaucuacaaaaaauuuuuaaaaauuagccuggcaugguggugcacaccuguagucccagcuguccgggagggugaggcaagaggaucacuugcgcccaggaaguugaggcuguagugagccaagaucguaccauugcacuccagccugggugacaaagcaagaaccugucucaaaaaaagagaagaaaaagaaaaaagacaugagacguaggagccaggcauuuuucagccacaaauaccaaguggauaaaaaaaaauaaugaaaagaauagaagaaugguuagcccacucucuuucuagugaacccugggauaaggucuauggugcagugcugugaaaauucacucaauccacgagaucuauacacuuuguugggaccugggauagaaugaaccaguguucccuuagaauggaaaugacugaguagaaauaaugugggaagccacauuaacucuuucaggccauuaggcuaucauuuaguaaauuacuacauuguucuaaaugggucccuaguggguauggagggugagaauguucuaauuugcuuuucucuccuuucucucagcugcuuucuccuacuaugauguagaacaagaagugguuuaauaacugcucuauuccaaaucacugaaugcucuuauaacuacugcauaaaagugccccugcaggucugcuauauugaaauguguggaaucaaaucuaugcauaugauaugaggggugggggcugcaaucugguacccacaggaucuagaaguaacucgaggaaccaggauaucccugauuuuaaauucuagguuaauggagggcgugugaccgagagccccauguuccuggggagggaacagaugccacuggaagcugcagggcaggaguuucuccaccuaaaagggaggauccacaacucugaucugaggaggaguccgugucucugccuuggcauguauauuacaagagaaaaucauaggaagggcaaggauguucccugacgacuggcuucccucugucacucaggaugcauggccacuguugguugaaggaacuaucauuuuucucccugauugaaaaacaaaagaaucaaagcucucccuugugcuuacaaaucuggggauauuaauuaaauaccuaguagagaugcuggggccuaauauuauugcauaauggugauuacagcaacaaugcauuauauagcauuaaauguuuuugaagcacuuucauauucauuuguuuuuuaaauaauuuuuguuuuuauuuuuuuccaguuucauugagguagaauuaacaagcaaaacauguacaccuguauguauucaagguguaugauauguuguuuugacauacauacacacugugaaaugauuuccacaaucaagcuaaugaacauaucauccccucacauaguuacucuguguguguguguguguguguguguguguguguguguguguguauguauggugagaauacuuaagaucugcucucuuagugaauuucaaguauacaauacauuauuauuaacuauaguuaccaugcuauauuauuaggucuccugaacuuauucauaacugcaaguuuguacccuuuguccaacaucuccccuuugcauauucguuguuggucagggcuaucuugauggacauaugaagaugggcuccaugcuugguuuaauucucugcagucacagucuuguaauuccaaauaacuuuaacuuggaauuaguauuuuguaagcaaggucugaugggacuguggagcaugugcugggcuuggaaccucagcuugaugccguccugccuuccugggauggguuuuuggcugccagcucccugucucaugcugguccugcucagggcccugcccacuccacccccuuaccccacaaccacugcugcaaucagguggcacuggcagggggaggaaagagaccagcuuggauucaguccuugaccacucucuucccccaauggugguggugggggagucucgacauggacggucauccaccucauggcuuuuugggguaggcaaggcagcagccauccuugucccuaauugcaacaucauggcuuguuuggugggugauauaguuuggcuauguccccacccaaaucucaucuugaauuguagcucccauaauucccacgugcugugggagggacccagugggagauaauugaaccaaacuguuuaccccauacuguucuuaugcuagugaaucagucucacaagaucugaugauuuuauaagggguuuccacuuuugcuuggcucucauucuuucucuugccugcugccauguaagaugugccuuugcuucuccuuugccuucugccaggauugugaggccuccccagccacauggaacugugaguccauuaaaccucuuuuucuuuauaaauuacccggucucagguaugucuuuauuagcagugugagaacagacugauacagggggcaauacaguuggugacucugcaugagucuuucacccaucucugacucaaguaccaagcacauccuggccuagggauuguaaucuguuggguagucaccugucugcuguggguugggaguggugggccuguaggaaagggagauugacuucccugucccuggccaggccucacaguuucauuuuauaccaggccuugcaaaauauauagccagaccuguaguugacauuuauuguaauauccaugcaagcuggauaggacaagaauguugcuacuguuaugucugcuuccauuauuucuacugcuggggaggcuaccauuaccuucucugugacuugcacuugggcaagcacuuaacaauauaucaucccauuuaaucuucacaaccaauauacaagguaggguuuauacacuggggugguucccuaacuucucugaguuuuaguuuccucaucuggaaaacugguaucauaaugccuacuugguaaggauauugugagaauuaaauaagaugacauguauauuaagagauggagguaauuuuaucuaccugcauuccucuaauucuauauuuguuaggaagaaaucuuuugguaagcugcuugaggagaagagucaccauggacagacuaaaauaacccaauaagcuugcuuaacuuuugcacuuaugacaaggaguaguguuuguuccuugccauuguucccaagaggaagguggcaaagaaagaguuggugagggcgaagcauuugcaggggaagagaacaggagugacaguauguccuuuagaaaguggaaauauugaaugggguucuaaacaaauuguuugguuggguuuaugcuauaaacagcccaaccuacccaccgucaugaaaucuucaguaaaggcuguguagcugacuaacgcuuuugugugugauuagauaaaugcgggagaggggcucagugucuguucucaaagaggcauugaaauucacauccacguuggcacaagugaaaacagacagcuugugccagaagaugagugcagagcuggugugugguucuaauacuauucuuggaaugcuuccucugagugaccucccucucuguucaggccacgcauuucuggaggguauaacagcaguauauuguuauauuguauauauauguauauucuguuugguuucuauucuuccacaggccccaccaucagguuccgcacagagugaacacucaaauguugagggcugauaaaugugaguagcaacuacuaaaugaaggagaugaauaugcuuuuguauaguaacuucaacgaugcuuugauauagaaauuaguuuaccuaguguacugaugagguacaugaggcucagagaggcuaagaaacuugccuggcgucacacagcuaguaagcagcaaaaacagacauucauguuccauacacaaugccuuccuggucagugacacuuuagcagacuaucuagaguucuggcaucguauaaaccaggcauuauccacauauguauauuuuaaaaccucacugaaagcagaaggauaagaugaauugacuuuaagcauuccuggggaacaaaaagucaaaauggaaaaggagaacaggagcauaagaaaaaaauauauagcauaacucguuaucccuuagauaacuguagggucaugcugauauuagucauuguacugugaugacaccaaaaagggaaaguguaccagcuagccagguagaugcaauucauugugcaagaaaaggcugccucaaaugugucuaaaagcgugguucuucauucagccaagucaagaccaaaggagcacaugaauaauuggcuacagcuccccuuucagcaaguaccagcuuucucugcugaggcugauacagcuccauaccucagggggccgggaaucagcugccagcagccaaugggcuucugagcauucauaagcagaccaggugcugauccaucaggcuaauuagcagccugugggccacaguuagcugggaagguggaggguuuuaacucuuuuccugacagacuccaagccuaucugggcuuuuugagcaauguucuaucagucaaaccacaaagaaaaguauuagaauucaaaaggagggaagcuaaaaggaaauauaguuuugcuuuaaauaagacaagggagacuaacaacacaaaggaagugaacuuugacucucaaauauacauauauauagauguauauaugugucuguacgcaucucagucuacguaucuucauguuacugacuguaaugucaucaccacagcagacauucaauacauguuugcuuuuguugaggaugauauagugauauuuaaaacagaaauaauaaacaagggaagaaaauaggacaggauugcaagggagggggauauuuagcuuguuggcaccugaaauguauuuaauuaucaggcucccaaaagagcagaggaaacagaauuagcuucaaugaaaaauacagagaacaugcugaaaguucagaaaaaaugcaaaacuuacuuuaauuaggagauggagauggaauacaucagaaauagugucacugcaaauuaccagacuuauaaaccaauauguaaaucagcagaggaaacaaucccaugaauuuuaguaaauuuguagaaacuuguuguaaauagugcauuuaaaauuaguuuuaaugugaaauagaaucaacaaucaaugaagccaacaccauccaaaugucuucauugacauaaaaggagcauucuauagucaauugguucuauauuuuugacuuuagugugguuuuguugaucauggauccaauaaucuccagugaagcagugccaauauaugaucuagcgauaggaaauaacaaacaagcauccuaauccuuaaaguagccaaaucugacaaucauagaaaauggcaaggcaggauacuggcaaaagucuuaaaacacagagguaacauuuauggagaugucugcacgggcucucugucaacauauggagaauugaggaagagcuacgggauuucaaugacaagcccaucaccaccaucuggagauaaaaauucugugguagauuuuuuuuuuaaacugugauauuuuacugauaaauuuuauauuagugacaagauccuaaccaaaguuuccuuggacugcuuacuauaaaacuguguacuauugacucugggguuaaaaaaauggauuuaugccucacugagaaacagcugucauugcauuuguagaaucauagugucaagaugaugaaacugagcuaauuccagagucuucagggaccuaaagaaagcauuauacagcccugaggagguuuggguguacuggcaguaaugucaacuguauggcccugagaaacuaaucuccauguugagauuaugaacacaaaucuuuccccaaauauuuacugaguaaaaacauagugagugguccauuagggagagcaggagcaugaguuggauuguuuuuguucuaagaaaugaaugcacuaccuuggacuauaaucaauuuggggauuguggucuuuuaaacagaccauagcagaugauucagugucagugggccacuggauucaugccaagugauaauucuccauaacgcuuccuacagucuggugugugcaaaacaggcaaggucacaagucuguucuacagccaccgggugugcugguccuuuuauuguccuggcaaaguaacaacccuguguaugcaccccuacaaacuaucuccccaugguuuggucagagcugacccccaagcucacccugccuaagucauuuauuacuagcagaggaagaaauaagcauauaaucaugaccuuaucuacuucucuagccucaaaucuagucucuccucaaucaaacccuuuccuaucccucagggacaccuugacugggugccuuugccugugggacucucugcccuuagcaucuuucaauuaguucucugccuggaaggcuguucuucuuucauguguuaccuccuccugaaaugguuucuugauaauaacagcaaacacauaggauuugcuucauaccaggcgcacuucuaaaugcuuuauuaaauguacuuacuucucaccagaacccuuugaaauagguacuguuauagucucuacuuuagauauaaagaaacuuaaaggcagaguuguuaagaaauuuacucagggucacugguaaaugguagagcugagguuaugaaccauggcagccuggcuccagagugucuguucuucaucacgacucugagcauaaugaucccuagacuuugcuguuaguauccugagcacucgcuaccagagaaguagcugcacugcacucuagucauguuuguaagcuuccucucuuuccaugcuaacuccaguuaauccaacaacacucagccaaagcaucaacuuuuucccccuuaagucuuccugauccugcuccccuaaccugugggaggugaauccuccacugcccacaccaugcuucucucugcuagacuccuuaucacaccacgugucuuguuuaccugucugccucccucauuaaucugugaacucugaaguuuugaaggcacgaauggucucaguaacacaguaucuggcauauagaacuguugcuuaauaaauauuugucuguuugauggauggagacuggugcuaacaagucuucauuuugcaacucugguuucuagcuuuuaccggcagauuaagaacaaaagggauuccaucacaaauccugggagaaucaugacaaaugcuuagcuucaguucagaaagaagcaagacuauuuauagcucagggacucaacauuaaaugacccggacuuaauuuuuccuugugaccuagauuugcacaacuuuagauggaaagugcccuuggagaucauuuuacccagguauugcaaacugguggccuagaguuguuuuuauuugacauauauuauuuguuucuauuuuuauuagaauaccuuuagacaggacaugugcuuuuuauuucuccacauuuuacaucauauccuaucauacaccacuuuacucauuuguauuauccaccugaccauucaaagcauuugaauaugaaaugucugaauuagucuaacucauuuuuuuuggucuuuguuuacaguaaagcucccaagucuguacuuagggucuccaauuuucucauuaauucauuccagucagauguucucccacccucuacugauguguagacugauuuccauguaacaauguaccaaucauguaccagugauuuccaccuagcuaaauccaguuccuagcuuggaccucaaccccuccuccuugacauucaggaccauacucuccugguuuuccuccuacuucucuggccuccccuucucugucuucuugcugauuccuccucauacucucgaccucuaaauguuggauccuccaaggugcagcucguggccugcuucucuucuggaucuacucucauccccuuggggaucuuguacaggcucaugaguuuaaacacugcccacauguugacacuuccucaguguacaucuccagcucacuugguugucuagugggccugucaaacuuaauaugucuaaaaacaaacugccaauuucuucauauuuuuuuuguuguuguugagauggagucuugcucuguugcccaggcuggagugcaguggugcaaucucagcucacuacaacuuccaccuccuggguuaaagugauucuccugccucagccucccgaguagcuacgaugacagacgcgugccacuaccacacccaucuaauuuuuguauuuuuaguagagacaagguuuugccauguuggccaggcuggucuugaacucuugaccucaggugauuugcccgccuuggccucccacaaacugucaauuucuaccccaaaccugcucuucuuagcaguuuucuuuaugucaguuagggguauauccgggccaccaguugcucaggccaaaauccaugggcuuaucucucauugcuuccuuucuaugugauaugguuuggauauuuuuccucuucaaauaucacgcugaauuguaauccccgguguuggagguggaaucuggugggagguguuuggaucauggcggcggaucccuuauagacggcuuagcucuauccucuuggugaugagugagccaugagaucugguugauuaaaaguaugguaccuccccacucucucuugauccuauuacuaugugacaugcuggcuccuugucaccuuuucagccaugauuguaagcuuccugaggccucaggagaagcacaugccagcaccauucuuccuauaaagccugcugaaccaugagccagacaaaccucuuuucuuuauaaauuacccagccucaggcauuucuuuauagcaacacaagaacagucuaacacacuuucauaugccauauacaaguccucagcagucaugucuacuccaaucuuccagugccucccuuguucuuuaagaguaaaagccaaagaaaguccuuagaguggucucuaggagccuugauauucuaccuuccuuccuuauuccuaucccuaccuuuauuucucagacccccauucccaccacuaucccccuuauugaccugccuccagcucacuggccucccuucacuguugagugaacacuccaggcauuuuucuacaucgggguguuugcauuugcuguuccuucugccuggaauacccccacccuucccuuccccauccccagguaucugcauguaucugcauggguugcuuccucauuuccuucaugacuacucaaaugaaccuccucacugaagcuuuccuugaccacucuauuugaaauagacuucccuaagccaggaugauuuuucaucccuccuuucugcuuuucucuagagcacuuuauuacccucuaauauccuauauauuuuacuuaccuauuuuguuucucuuccuacuagaauguaagcuaaaugagggcaggcuuguuugucuucuuuguuuacugcuacauccucagcaucagaauaaggcugagaacuuguuauggguugaauuauguuccccccaccacccccaguaagucccagugaccuuauuugggaacgaggucauuacagauguaauuaguuaagaugaggucacacuggagcaggcuggaccccuaauccaauaugacuagcguccuucuagaaagaauggcaugugaagagaaggagauauccauagagggaagaugaugugaagauguacagggagaagauggccaucuacaagccaaggagagagaucuggagcagaucuuucagacuugauuucagacuucuaagacuucuagccuccagaacugugagacagaauuuuuuuuuagacagagucucacucuguugcccaggcaggaguacaguggugugaucucagcuuacugcaaccuccgccucccagguucaagcgauccuccugccucagugcccugaguagcugggacuacaggcauguaucaucacacccagcuaauuuuuugcauauuuaguagggacgggcuuucaccaugcuggccaggcugaucucgaacuccugaucucaagugauccaccugccuuggccucucauagugcugggauuacaggcaugagccaucgugccuggccaagacaauacauuucuauuguuuggaccaaccuggguguguuacuuuaucacuacagcccuagcaaacuaauacucaaaaaaauucucaagaaaaauguaugggugaauaaacaagugaauuaauccuuucaaugaagaaacugaaggccagugaaguugauuaacuugccagaaacacaccauggugaacgggcagaaccaagacucaaauccagcuuuccugccgccccaucuagcucucagccaccacaucuggaugccacgucagucugucucaugagcacuaacaauggugggcugagguugagggggaucuccggagccccuucaccaucuccuaggucuugccuauccugccuuccugcuuaacgcucccaccaccaucacauaaccuggauauguuguggccagacaauuauugacguauguuuguuaaguguucugaucuccucucagaggaaaacccuguguuugacucuucuauuauucaggaaguaauaaaaguuauagucauaauauauaagaaaaaagaaugauucacugcugagcuacugagcuacagggagcaauccaagguuuagaacagacaauuggcuaagaucagucacgaugaugucacagcggaauauacaaauaccucagugggcugauccaagagaacaucacaauuaaaucagcuuacugcugagcacucuuccacaucugugaagagcugcucuccauucugacagccacguuuaaggaggugguggaggcggcagucuauccaacacccuccacacaggaagaaaggauugcaaagugcuacugaguaaaugaacaucauucacauggaaaugcacuggacgagaucauacauguuaagacaguuaacagacagguuaggaacaauguuuucuuuucagaauggaauuacaguaugacauugggcaugggaaacugaugagagccaucagagaugauauucaaaauguuuaacaaaauaucgacagcauaagccaucaauggccaaugcagccuuaucaaugcagagugguugaacauggugcuggugaaacucacuuggcuagaauagcagagaugccauuaaccucucugacccuuaguuuaguuucuucauugcagagugaggcaccaccacuuauuuccuaguguuguuacaaagguuaagaaaaaaaucugugccacaauuccugguacauaucagauccccaauaauaagagcaaacauuuaugugucuuuauuauauauaagguauuagcaaaugcuaauuuacuuaacccuuauagcagcccuaguauucaacuauuuuuuuuuuuuuuuugagacaggaucucacucugucacccuggcuggagugcaguggcacaaucacagcucacugcagccuccaccucccgggcucaagugguccuccugucucagcuuccuaaguagcuggugcuacagauguauaccaccaugcccaguuaauuuuuaaauuuuucguagagacagggucucacuaugccacccaggcuggucaagaacuccugggcucaagcaauuauuauuagcauuuucccguuggagaaauugauauagagagcgguuaagcaacuuucucaaugucacacugcuggugaauggcaagacagggucuuaggacccagguagaaugaaucccaggggcuccuuccccacccuaugcuacccucaggaaaugucggggcccaucccucccacuuuaugcuccagagagccagugucccugcaaaccuaacaucucauugccucaaagucccagcuaaagccuaguggagaggacaucacucuuugguccuucagugcccuagcccuucuuucuagguuuacucaauuuccauuugcaugaagacagacaagaaaaacaguccaauuaauacgaagcguaagaccacaagaugagaaggcuuuugcuuugcuuuuuauuuuguaucagcugaagugcugugaguauucgggaugaaaaauuauuuaucccaguuaaugaaucucaugauaauaaaaaugccugacagcucugagauuagugaguagcccuuaucuggggaccacuuagugaagcaaauccugcgugaacaaaggacaaaugggauuugggagaaugaggaggaagggaggcuaagaacgaacauguguuuugcagcuaucucaugccaggcaucacacaagguacucaacccucauucuuucuuuuaauucuuuugagaacucagucuuuauacaaacacuuauggcagugccagguaccauaauaaguguugggguuacaaaauuaaauaaaucauggccccuguccuuuuaaguagaauggauacagaaaauaaguagagaggcuauuuauguucacugcaauauuaguuugauaugaguauacacaggcaguggaacuaugcuauacaggccaagaugauaccuaccaugucaauaguuccugcauaaggacuauuuccugcauacgcagcuguguucugggcugggugauauaccccugcaccuccccauggccccucaggcccuucacggagguuaguuggcuagaggagugagauucucuuaggaguuuacacuuggaagcagaaagagaaucaggcaauugguugugggaacagaaacugagaagaugaucuaaaaggagugaugaaguacaguagaauggggcugggugggaccauguguaagcggaagcuaugaauacacagaagauacaaggcacagaaaacgcugagcagaaugugaggaagcuaggucguagcaggaaaugaauagaagcagaggauacucuaaccaacguaugccccacaauuuaauccuuucccuaauguuagaucauucucauuuuuuccuguauuacaaggaauccuaugaugaauaucauugcacaucaguauuuguagcauuucugaugaguuucucuaauauauucuuggauuaaaugguaugcacauuuuaaugcucuugagacaaguaugcaucuuuauuuccaggaagauagcacuaauuucccacgcccuucaguauuauaugagugagucuacuuuaacacauugucucacacugaguccuugucacuuaaacagggaacgguaguaacuaccuuuuuaauuguuuaauuauuuaauuuuuaauuguuugcauauuuuucauauguuaugggacauuuguauuuccucuuuugugacuccagcuuguuuaugucuuuuuguccauuugccuauaaggccauuuauaaugcucuuauugauguaugagaaaucaauaaaauuuauauaacaagaccaauacucacugacauauuuagcaaacacuuacccauaauuaguuguuuuccuuuucauuuuuauuugaggcacggaaguuuuauauuuuucaauauauugauauuuuccuuuguaauuuguuucaaaggguuucuuuuugcggaaaaaaaucuuuuucuguuuucuagaucaggaaaauacuuggcucuguuucuuuuccuacuuuuggaaaauguuuuugcuuuuauauuuaacuuuucuguucacuuacaauuuauuuugguguauuugaaccuuuaugaaggaagauuuuguacuaaauuaaaaaagaggauggugugauccuguuucagaaaaaucuaaucuguguuaauguuuguuccccagcagaaucaaccauggauuacuuccaaugaccagugcaaugacuugagcacacacagacccauuuaaauacauaaugagggagaacauaugaucaagggcggagaugccaucauuugugcucuguauacaaccuacuuuuauuaaauggaaauuauggucacugaauaacucaaucuaccuaaacucuuacaaggaaucagaagcccucaguucuuaagcugggucuguacugauuuacaaugggacacaaacacacuguaccuccuuaacccuaacacccacuuuccaauugccugucuuucaaaacuaucuaauuagauuucuuuaaaaagaacauuuuugucauuugugaggaauuuuucuuuucuuuuuuaguuugcucuuacugaaaaaccaaggcaacuucaacuuuaucuuuucauagggucccuuuccaaguguuaugacugaauggaagcugugugguuggugaaguacuucggcuauauuuccaaaaauaugcaauuguuaggggcugcaaugcaacagccaguuccagagacuagcaaaaggcagggggauacucucaagagugacuacacucgagacuuuccauuucagcaacuucaggaauuggggaaaacucacuaauucaacacugaguucucugaaagugaugguguauuaguuugcuaggucuaccauaacaaaguacagcaaauuggguggcuuaaacaacagacauuuguuuucucagaacucuggaggccagauauucaagauggcagcacuggggagaaaaucuagcuucuggugguuugcaggcaaucuuugacauuucuuugcuugcagaaacaugaccacaauaucugucuuacucuucacauggcauucucuguaaagccacacuauuugcuuagauuguuugaagaaggcacuuucagauguguuccagaggcugggcaccuugaucuggaucaaacgcugccaauuguugguugaaggugaguguagaaauguaucuacuuccaaagccaaaauauuacuguauuaguccguuuucaugcugcugauaaagacauaccugagacuggguaauuuauacaggaaaaaggguuuaacggacuuacaguuccacguggcugggaggccucacaaucaugguggaaggaaaggaggagcaagucacaucuuauguggauagcagcaggcaaagagagagcuugugcaggaaaacuccaccuuauaaagccaucagaucuugugacauuuauucacuaucacgagaacagcacgggaaggaccugcacccaugauucaguuaccucccaccuggucccucccacaacaugugggaauucaagaugagauuuggguggggacacagccaaaccauaucaauuacuaaguacacagaaaaauuuauaagucuugguccauguaccucaucaacuucuucuagcaagaagcagcuggcugacuugcaaugaaaucuccuuagaguuuuaucuuuaaaucauugaucucaauggauaucuuauaccugaaaauuugcuguuuuacuaagggugaaguaaauuaaauuccacaagaguuagaaaauaauuuaaucagcuggcaaaagcuaaggaugaaagcaaguuaauacaaauuucaauuuucaaacaagauucaauacauguauauaauuuauuuggcuagauucaauacauguauauaauuuauuuggcuauuacagggagagaaaacauaauuacuaggucuuauuaaaaguaugucuuucuucuuuucccugucauccuuucuucccuuucuucuuucauuuuuaaauucccuuccccucuuccucauuccuuccuccuuucuuuucuucuucccucccuugauguuuuccauuuacucagaaaacauuuagggagcaauuaccacaaguuagaguauacaccauaugccaaggaugcacccaaaauguacaggugauaaagcagcaguuccugcccucagcaaguucauagccuaauagaaucugaguuauguaagggugaaggcccuacaguacauucucuauaauauuguaguaagaggaauaaucucagaucucaugcaugcauuccaugauuuuucucuuuacuuuugccacuguuuuucuaccugauauuaaucuuaauacuauaaucuuauacuacuccuucaagcagcuccguguguuuucuauaggcccaccaauuauugccauguucuaauaagguuuuaaagaaaauaugugacccuuuagaacaucaccccacuuccaugccugucuuccauccucuguauaaagagcagagggugugaagaauggacuagaaggguuccuggguggcucauuguugugaucuguuugccugcuuuggcaugcuuugauuauaauaaauaucuucucugaggggagcauuuugaggaaagugauuguaaaagaagauggaaauccaucuauaaagaugguaaccacaggaacuaauuugaagagguuuuucauauuuauuaauagcauagaauuguccuuccagaaagcauaaaguucuaaauuugaacaaaguccacagucugaaccaaaauucuguaccuuucagaauggaucauaaaagaaaaaaagucuacagcacaaaaauaguuuccuccuauaaccucaaacaaaugugagggcgaucugcccuugcaauuuucauuacuucaagauaacaacaaggaaacuaugauucaguuaguucuuuccuuucacacauucagaguuacucugcaauugcugagugcuaguguaucuauccucaaguggcauuucuguuugagaacuguauuuuucauuauuuagaguuuucuguaauuuuuacugguaauauuaauauuuaacaauaucauacccccagagguaucuuugugcaacuuuagaauauacguacuuuguuucuuuuuaugacucuaaccuuuuauucuuucauuccucuaguacucugaauauaagagagucuacacgcuuuuuagugaggauuuuuugaucccugcuucauaagugucacucauuguaggcuuuccuuugacaacaaaaauuccugcucucuuuacguugacucuaauuacuucaccagaaaagguaaaccugucauuguguaagaaaaggaauuaaguuaauguaacuguuucuuaaggucuuauuauuauuuuauuuuuauuuuuuugagacagagucuugcuguguggcccaggcuggagugcaguggcacaaucucggcucacugcaaccucugccuccuggguucaagcgauucuccugccucagccucccgaguagcuggaauuauaggcaugcaccaccacgccuggcuaauuuuucuauuuuuaguagagaugggguuucaccauguuggccaggcuggucuugaacucccgaccucaggcgauccacccaccucagccucccaaagugcugggaugacaggcaugagccacugugccuggcucuuaagggcuuaaugugaauguugcauacacauguaauuucugauucauuuguggaccuuugcguaaaaauaaaauuuucuuagaaauucauagaaaaacauggcaguucuuaccaugcaucacagucaauuuccugaggguucuguucuuuggagucuggggaggggaggugcugugguuuggauguguuuuuuucccaccaaagcccauggugaaauucaauccucaguguggcaguguggggagauagggccuagugagaggugucugggucauagagguauaucccucaugaauagauuaaugccuuccugcuagggugagugaguucuagcucucaggggaauggguuaguucccuugaaagugagaauggguuguuaaaaggagucuggcuuccuugguuuugcucuuuugcuuccuuucucagccugugaucucugcacacuuuggcucucugucacuuuccaccaucaguagaagcagcaugaggcccucaccagacacagcugccuaagcuugggguuuccaggaucaugagccaaauaaaccucuuuucuuuauaaacuacccgucucagguagucuguucuagcaacauaaaacagacuaagacagaggucuucaauaccaaaagauagucuacuugaugugugaagggaggcuuugguuugccugcuauaaaauaauuuuaguugaugaacccgaaguucccugaagguuuaguuucuggugacuuucauucugcaauucuugcacaaauggaaaaaaauccauccuaguugaauggaguaccuacacuacaaauguagagugaaucuguagaaaccacuuuuuagauaacugauaaaccagcuaguugcuaaucacuucauugcugcuucccaccaccagucaauguuuaaaaaaaauaaagaauucuccaccuaacuuugacaacuggggaaagguaggacuuuguuucagcaucaaaaggaaguagagccacguagaauuaucauuuaguucccucagucauagccauuucucauuuuucaucuucccuacuuuucucagggccauuuauuguccucuaaugccucccuucucuucauucuuuuuugcucuuaauaucucuggagggacaccaaagaagugauuucuuucugcauucauuaaaaauagguuuauguuuugccuuccuguucaauucccacuugggcuguaagcaaguaacuaaagcaagggaaggguugggcaugugggcgccagacuuagaugccucuauuuaugccuagauucuuccuauuucucccauucuucccucaggauaggagaaaaaggagguggcagaggucugauuaaagcagggaugagcaacugagccaccacugcagugcugagauugggugaagcccccagcuucacagaaaggccugcaacaucauugcaagauuaaaugugccaauauucuugcuaaguuacuacuuuuugcacauuaccagagaauagacuucccgggccuaaaggaauggcaauguuuucauugucauuuauuucucuguucaguaagguagauaguacagguuuuaagagucuucuuuuuuuuccucaugagacucuauuucuuuuccccucuauuuucuucuaugcuaaauggcuguaucuacucuugaaaauacauucuaacucuaaguguccuuuguggauuugacuuuaggaaaccaaaguagcuucccccaagccacccucugucucucuuuuuuguuuuuuugcccauuggucgauuuuaccuucuuuuuguauaccaucaacccaaagacacagcauacuagggacguaaguguggaacugauaccguuaguuuuauuucggggugaugcaaucccucugcuaauucuuagauggucuuauggugucagaagaaaauuuccuucugucagaaagccuuaaguacguuuggaaaauaauucagaaucaaggcugucuucuucuguuuuuuaaucaauucacuaaauagucuucaucauacagagaaauuauuccuucuacuccacuccaaacuaagacauuauuuugaaauagauuaucaaauaauagugcagacuaauuuccauagcucaaugaguagaaggcaaaguacauuauuugcuaaugcaaaugcugagccuucuccaaaaaauuuaauauucaaaguccagacgggauaaggagacaaaaaaagauugcuuaacaauuuuccaaaccaaagugaccuauaacacacaaaauaugguucuauuaugugcaacugauauuuucuuuguugagaauaaugagcuacagcagaauggcauaauguagaacuccacagcugauaagcuuucugcauaagaacaggaagaggacauuucuuaaagaguucuguguucauugcuuaccuugaggaggcagugaauggaauuacuguuaauaguaacaauaugaagcuaauugguuuaaaaugaagcagcaggaaaugcugaugaugagacugggguauaugaaggaagaaugaaaaaucuauacuccggcuacacaaaaaugaugcuuaaaauguaacuuaaucuugauauuuuauucauaaaugacaaaucugcucacuacacugauucccuaggugacucaucaaaucccaucucuagguuuaugaaucucaaaauuuuguagcuaguucugacuguuuucacuggcaaaauuugucaaaaucaacuucuuaagaauuuggaaauuaacccaaaguuugcaauaauacaaaaagcauuuacuuuuuuaaaaaauggcugaaucccaguaaaaacagugagcuuuguggcauuuuaacuugcacuuauaaccaucugccucuccacagcuucacaguauccuugaaaaucaacagcuuugcagccaugauagcuaugaaaacuagcagccuagcagccacuggaggggacaggucagguaugaagcucccccaaaauucccauucccagagaauggucacuauuuaaccugucugaaaguuccuuaagaaagcuccauucuuauaguuugucuuuauuugccuugacuuaaagcucauuuggugggaauagcccugaccccagcuaauuuuuugaaauaaucagcaaaaaagcuuucagaauagugacacuaauugaaacuaaaaaaagaaugaccaaaaauuucacaggaaagacuggauaaugagauguguuuagggggguuugaaaagcucugauagauuucugguaaucuagaaggccaugcacauauacagggcugugcacguucccagaaaagaccugagaagccccuauucucucaucucuaguugacuuugagguucugugcaagcuggaugugaaggcuaaggcagaguuguaaacugccugguagagcauugaagacacaccuuaauacacacacauaguccuuuggcaguggcugggagacuuacuggcucaaggcauuuaaggaaaucuguucaaucauuagguaauugguaagcuaacugagcacagacuucuguggaugcagugagagauaacacagaauuuacagaauuaguccaggaaagucacuaaacaaacagcagcugcaauaauaaagggcaucaacaacagaccuuagagaggagggaggaauaugaauuccagaauugccacacuauauuccuuaaaauguauagcauucaacaagaaguuaggagacauguaaauaaaaagcaaaguauggcccauacacaggaaaaaaggaagucaauagaaacuguccauggauguuggacuuccuagacgaagacuuuaaaccaucuaucauaaauauguucaaguuacuauaggagacaugucuaaagaauuaagggaaaguaugaaaauaacguuuuggcaaauagagaauguuaacaaaggauauaaaugauuuaaacguacaaaaucggaauuguggagcugagcaguguaauagcugugauaaaaauauaguggggcucaacagaagaaagaauaagcaaacuugaauaaaggccaauugagaugaauaaauagaagaacagaggaaaaaagaaugaagaaaaacaguaucaaagaccugugcagugccaucaaauguaacaacacaugcauagugagagucccagacagauaagagaaaaaaaggggaugaagaauauuugaagaaauaacagcugggaacucuccaaacuugaugaaaacuauuaauccacacaugcaagaagcccagugaacuccaaguagggcaaacucaaagagauccuuacuuuacuacauuacagccaaacuuucuacagcuaaagacaaaaagagaaucuugagaaugccaagagaaaagugacucauugaguucaagggauccuaaauaacauuaacagccagcuucucaacaaaaaccaugaaauccagaagaaaaaggaaugaccuauucaaagugccaagaauuuuacauccagcaaaaccaccaguuaaaaacaaaggagaaauuaagacauccucagauaaacugagggaaucuuaucacuagcagaucuugcuccacagcagauaguaaggggaaaccuuccgggggaaaugaaaggaugcuggacaguaacucaaauccacaugaaaaaauaaagaguaccaguacaaguaacugcauuuguaaauauaaaagacaauauaaacacauuuuugcuuguaacucuuucuaauuuaaaagacgaaugcaaagcaaugaugacaagcuguuugauaggcuuauaauuuauaaauauauacuuuuuuaauugaaauuuuuuucuuuuaucauccagcccaaaaugucauaaagauauaauuucuaugacaauaauaacacaaaggaggagaaagggaaugaagcuauauugaagcaguuuuacauauaauugacgguaaauugguauuaauccaaacuagauuauuuuaaguuaagauguuaauuguaaucucuaaggcaaccacuaagaaaauaaagauauaguaagagaaacaagaaaauuaaaauaguauacuagaaaauuuauauguuaaaaagaagaaaaccucaagucaauaacuaaaacacaccucaaggcacuggaaaaagaagagcaaauuaaaccuaaagcaagaagaagaaaggaaauaauaaaaauaagaguagaaauaaauaauuuagagaacaguaaaacaauagaggaaaucaacaaaaccaaaaguguauucuuugaaaagaucaagaaaguuaaauuaacaaaucuuuaccuagacugaccaagaaaaaaaaaagacucgaauuucaaauuauuaaaauuaggacuguaagaggggauauuggcugugcagaaauaaaacaaaagauuauaagggaaugccaugaacaacuguaugccaacaaauuaaauaaucuuggugaacugaacaaauaccuaaaaaaccacaaacuguugaaaccaacucaagaaaaauucaaaaaucuuaauauaacaaggauagagauuggauucguaauuaaaaaaaaaaaacuucccacaaagagaagucuaggccaaaauggccuuauuaaugaauucuaccaaauacuuaaagaauuaacaccaauuucauaaguucuaccaaaaaauagaaagggaaggaauacuucugaacugauucuaugaggccaguauacacugacaccauaaugagacaaugacaucacaagaaaauaaaauuaaagaucaauauaucuuaugcauauugaugcaacaauucucuagaaaauaucagcaaucugaauccagaaacauauuaaaagaauuauaaccaugaucaagugggaugcauccugggaaugcaagauguauuuaacauacaaacauaaaucauaaaucaaugcaauacuuuaaauuaauauauaaaaugacaaaaauuacguuaugagcacaauagaugcaggaaucuccuuuaacacagcccaauacucuuuuaugauaaaaaucauucaacaaaccaggaaaaaaacacagaacuuccucaaucugauaaagcccagccauauauagaacccauacggcuaaaauaauacuuaauggcgaaagaccagauguuuuucccuuucccaagacaaagcuagcuacucuggucacuucuauucaauauaguauugggggugcuagccaggcuaauuaggcaagaaaaagaaaucaaugcaucuagcuugaaaaggaagaagugaaacuaucucuauuugcagauuacgugaucguuauauagaaaacccuaauacacacacacacacacacacacacacacacaaguucagcgagguuuccugauacaagaucaauacacaagcauuaguuguauuucuguguauugacaaugaacaauuuggaagugaaauuaagacaaaaauuccuuauagaauaguaucaaaaagaaaaugccuaguaauagauuuaaaaaagaaaugcaauacuuucacacugaaaacuaaaauaucauugcaagaaguuaaagaaaaacuaaauaaauggaaagaaaacucauguucauguaucagaagacugaauacgugaagaugguaauacucccccaaauugaucuacagauucaauccaauaccuauuaguaucucagcugccuuauuuguagaaauuaaugagcugauccuaaaauucacauggaaaugcaaaggacccaagauagccacaaaaaucuugaguaagaagaacaaagaugaagaacucauacuuccugauuucaaaaccugauacaaagcuacaguuaucaagacaguauaaagcauaagaacaguauugguauaaggagagacauauaaaucaaugaaaauaauuuauauuuucaguaguucaguagcaggcuuuuacaggguuaacugauuuucaguaagagugccaagguaauccaauggaggggaaacaggcucuucaacaaaaguucuggacaacugaauauccacauucaaaggaaugaaguuguaccagcucacaugauucacaaaaauuaacucaaaaugaaucauaggccuaaaugaaaaugcuaacacuauaaaacucagaagaaaacauagaagaaaaucuucagaaucuuggaucaggcaugacuucuuagcaaugacacugaaagcacaagugacacaagaaaaaauauauaauggacaucaucaaaauuaaaaacuuuuugugauucaaaugauauuaugaagaaaguaaaaauacaauccacaaaaauggagaaaauauuuguaaaucaaauaucugauaaggguuuucuauuccagguauauaauuaauuguuauagcucaacaauaaaagauaagugacccaauuuuaaaaugggcaaaagauuugaauagacauuucuccaaaaaauauaugcaaauaaccaauaaacacaugaaaaguuacacagccucacuagucaucagggaaaugcaaauaaaaaccacaaugaaauaccacuucauuccuacuaagauggcuaaaauaaaaaagaccauaacaaaugcugacaaagguguggagaaauuguaacucucauauguuacuggugggauuauaaaauggugaagccacuuuggaaaacaguucagcaguuccucagaaaguuaaauuuagaguuaccauaugauccagcaauuccacuccuagguauacacccaagagaauugaaaacauauguggauacaaaauuuguacauaaauguuucuagcagcauuauuaaaaauagccccaaagucuaaacaauucaaauguccaugaaaugaugaauggauacauaacugugguguaucuauaugaugggauaaaaauuugucaauaaaaugaaguacuuauacauacuauaaucuggugaaccuugaaaacacucuaauugaaaaaaacuaaugaaaaaaagaccacauauuguacgauucuguuuauaugaaauguccaguguaggggcuggggaaagugggggcgggguagugacugcucaugguuauggggugucuuuuggggauggugagaauguucuaaaguuaagacaguugugauggucacacaacucugugaguacacgaaaaccacugaauuguacauauuaaaggagcaaauuuaauggugugugaauuauaucucaauaaaaaauaaugugguguaaaucuggccacucaugguuuucaccucccuuuuuuuuuucuccccuauugggacaauucauaaguuaccaugcugcuggcagcucuggcagaaaaugauggugacagaaaaugacauuucaggaauggcuuuuaaggcacgaggagcaauagccugaggauaaucagaguuguuaggcuacucuccuguccuggaaagugaaaucaaccugauucuguccaucauggacacuggugacuugaguuguugacgaauguucuguaaaguuuaauauccccugcuacacuuuaaauacagagcccaauccaccauaucuuucaaacucaggcuauuucaaacauaacugaaguagaacuucaaauuagagaaacuugaggccuucugaucacuggccagaggggaaaaauuguuuuuuaugaccugaaaauguauuuaguaugaaaagaaaaugacuucuuaagaugagaauaagaaaggggggaaauaaccaaauuugaaguucuagguaaauacaauaaggcaacugaauagacacuccuuucuccuguuuucuauuaggauuauaauuggggauucuaucuccauccaauaguguuucuguacacuucaaagguaggcuaacuauuuaaaccagagacagaacacucuguauuacucuuuuuauauugauguccuguuacaaccauguuuuguuucguuuuguacuagagaaaaaagaggacucaaacuuauguugucaaauauuuccuagacacuuuugugugugacaggaaggaaacuuguuaauacugcugucucagguaauacugcuuuuuuaguuaauacugcccuucaucccuguguuuacccccucgagcuuauccucccuguuaucugauugguuugucaacauucugaaccaaaacucuauuuuuuaauggaaagccuaaggaggcacuuuuuccugaaagagauuggugucccugauuauacuuacucagagccuucucuggauuacugggaaggaacacaccugugcauuugaucuuaacaagcucuaaaucuauauuguguugcucagggguugccugacagagcucagucccaugguggaagaaaccuaccaaccucggucuucucagcuuucaaaggcgacaccugccucuggccucucucugcauucuccccauuaugaugugguucuccagaccagggaagagaccagggggaaacacaaacuaacacaacaagcuccuucugguucuguguguagcucuuugcaauuucccugcucugguaggcagcacuuuccaaucagcccugcagcuccaccucugagaauucuucaugaggaacaagcuuucuuuagucauagucacuuguauaagaagagauguuuuccuucaugaguuguuugaaaugcaguacagucauuccuuguguucugaaaagcucccacuaaaugacaucauuuaauuccaggaugcucagaauacuuaauaauaccuuugguuuugucuuugcaaaacaaguuuuguguuuguggaagggaacaaaucugaggaguggcaagcggcgaagaccaaaagcuuaucuguguggaauugcugcuguagacaagaacaauauaauccucccuguucuguaccuacuaaaucuuacaaaggguuagaaaaauaguauuucaucugucuuuggguuuuugauaauaccaaauaacaucaaauggaagcagucucaugguuucuucauugcuaaacuaauuguuauuacauacuuguuccugugugauguuaauauauauuccuggaaccagaaaggucuacauggucaaauaaauuugaaacuugcauuaaauaagaauaaauugauuuuuuucuccuucaggguuucacagaaucuuuaauaccaaugugcuuuuuugaaccucuuaaugcagcucugguaggcugacuuucugugugugugugauuauuuuauuuacugccaaucuccuuaaaguuaguuuuuauuuaaaaauuauuuguauaaacaccugaacuauuugacuuuuuaaaaauuccauucuauuguguuaauagcacuuaacaugcgaucuaccucuguaaaccauuuuuaaguguacauuauuguugacuguaaggacaauguggcacaguagaccucuagagcauauuuaucuugguugacugaaacuuuauggcuguugauuaguaacuccccauuuaguaacuccccaauuaguaacucucccuagcccuggaaaccacaauugcacucuuugauucuaugaguuugacaauuucagaugccuuacacaaguagcauuauguaguauuugaauuucugcgacuaacuuacuucacuuagcauaauguccucaagguucaucuguguugucacauauugcagaguuuccuucuuuuuaaagacugaauaguauuccauuguaugcaacuguguaugcauacaccacauuuucuuuauccauuuguugauggauauuuagguuguuucuaugucuuggcuguagugaauagugcugcugugaauauaagagugcuaauaccucuuuagauccugauuucaauuuuggugggggauacauacccagaaguagauugcuggaucaugugguagacauauguuuguuuuuuuuaagaaacaucuauacugcuuuucauagcagcuauaccauuuuacguucccaccaacaguguggagcggucucaauuucuccacauucuugacauuuggugucuuuuuaaaaaaauaauacucauccagacaggugugaggugagcucucauagugcuuuugacuugcauuucccugaugauuagugauguuaaguauuuucucauauaccuguugucauuugcauguccucuuuggagaaaugucuauucaaguccuuagcccauuaaaaaaaaucauguuacuagguuuuuuuuucuuuuuuacuauugaguaguaggaauuccuuguauagguuggagaauaaccucguaucugauauaugguuugcaaauauuuugucccauucaguaaguugccuuuucacucaguugacuguuucuuuuguugugcaugaacuuuuuauuuugauguaguccuacuuauuuuuguuuuuguucccugugccuuuugugucauacccaugaaaucauggccaagacgacugucaagugguuuuucauguauguuuucuucuagcagguuuacaguuucagaucuuuaaauguaaaauaauaauauugaauugauauuuuguguaugccauaagguccaguuucauugcuuuguaugucacguccagucuucucaauaucauuaguugaagagacuauccuuucccauuguguauucuuggcaccguuugugaugaccaguugaccauguaugcauggauuuauuucugggcucuuuauucuacuccauuagccuauaugucuguuuuuaugccaguaucauacuauuuugauuacuguggcuuugugauauauauugaaauaggacgugugaggccuccagcuuuuuucuucuuucucaagauugacuuggcuaagaauuuuagcauuuugucuauuuauguaaaaaaaugccauuggaacuuugauaggaauugcauuuaaucuguagauugcuuugagaaguaugaacauuucaauaauauuagaucuuccaauccaugaacauuugauaucuuuucauuuguuuguuucuuguuuuauuucuuuuuacuauauuuuguaguuuucagucugcuuucaacuucuuaguugaguuuauuucuagauauuuuauuuuuuuggugcuauuguaaauagaauuuuuuuccuaauuucuuuuuucagauaguucauuguuaguguauagaaaugcaaguaauuuuuauauauugauuugguauauaucaauauauaccaacuuuacugaauucauuuuuuaguucuaacaguuuuuuuuuuaaauggagucuuuagaauuuucaaauauauaagaucaugucaucugcaaacaauguggacaauuucacuucuucccuuucaauuugggcaccuuuuuuccuugccugacugcucuggcuaggacucccaguauuauguugaauagaaguggcaagaguaggcauucuugccuugacucuaaucuuagagaaaaagcuuucaguuuuucaucauugaguaugagguuggcugugggcuaaccacauaucaccuuaauuauaauauguugaaguaauuucuuucuguuucuaguuuguugagaguuuuuaucaucaaaggauguugaauuuugucaauugauuuuucagcaucuauugagaugaucauaugauuuuuaucuuuuauucuguuaauguggugcuaauugguuuucauauguugagccauccuugaauucuacagauaaaucccacuugguuaugguguaugauccuuuuaaugugcuuuuagauucagcuuucuaguauuuuguugaagauuucugcaucuaugcauaucagggauauuggcugcaguuuucucuucuuuuguacugucuuuaucuggcuuugguaucagcauaaugcuggucucauaaaauaaauuuggaaguauucuucccucuucaaguuuuuggaagaguuugagaaagaucgacauuaauucuucuuuaaauguuugguagaacucaccagugaaguaauuugguccugggauuuucuuuguuaggagguuuuuaugauagacagucuugccucuugaaugaauauuuauaucucaagaagcuaguguucugugaaaguuugugaaugaaguuuuagauucauacccuuuaaccuaauguaauaauuaagagaggagacuuuggacaaaaaguacuggauucuauuugugggucucuaccaauuaacuucauuuacagaauuagcauaguaauacuugcuacaaaucgaguugugaaaauuuagugaaauauauguauacuaacaaacaaaaccccaggcacuuagguggccuuaaauaaaugguagcuauuauuguguauaaaaaaguuaguuuagucaacaccuuuuccagcaagaagcaagaauuucuuucguuuauaauaauaauuuaauaaaauuuccuaaaaugccuucugcaugaugcaagaaugaugaaauuauaugcaauguucaguucgauuuuagugguuagcacaauuuaugguauuuuauuguuuaggaaagggagaguaaagaacaucuauugagaguuuauuuaguacucauaccagucuuagggaguaaaaauuaucuaaccccacuucacugaugaguaugcuucaguaaauugcuaaaguucauggaaagcauauucuguggcaauguuagaauucaaacccagguccccugacuccaaagccaaugcugucuccauacugccauaccaccuucuuuaaaaaugaacaauuuggcugggcaugguggcucaugccuguaaucccagcacuuugggaggcugaggugggcggaucaugaggucaagagguugagaccauccuggccaacauguugaaaccucgucucuacuaaaaauacaaaaauuagccgggcgugguggcaguugccuguaaucccagcuacucaggaggcugaggcaggagaaucacuugaacccaggagguggagguugcagugagccgagaucgcaccacugcacuccagccuggugacagagugagacucuguuaaaaaaaaaaagaacaauuaauucuuguguguacauaauagcucucuguuaacuaaggcuauucuauucuucacuuguuucaaauaaauaucuccccuacuagaucucaauacaguggucuuaagucaauuuaaucccaguaauguuuuauagucauuuucucagaauuucucucauguucagguaaggauuacauaauugaacacaaaauuuuaucuugucuaaguacuucugacuucacagggaauugugauaaggaguauaacucaguggagaugaugugggaugguagguggaaugcuggccguggccuuaguagugaucuuaguccuuccccugcuuuaagucccugugugacccagugaguuacucuguaucuuuaggucuuaguuuucuuacuauuugcucuaucuaccucaugggaguucugugaagaguagauuaacucacuuuuccaacucucccuaucuguaguugucucaaaguggagaaugcauacuccagggaugagcaggaugguucauucggguagaggaggaugacaucaaggaacacuuauaggugcuuuaaaauuuguucuuuuaaaauuuacguuuuuagcauauguuuuauaauguauggacauagcauuacauuuaugaaaaccauaaacacacaaacauauauuggagauaugugcuuuuuuuuuaauuaauagggguaggugauaaaaaugucgagggccugguggccuccaggauaaaguccaaauucuuuaguauggcauuuauguccucuggggacccuccagcuucauuuccucccccauugcuucuccuucuacuuaaugaacugaacauacuaguauguuuuguagcuucacugucuuugcuuauacuacucuuuuugccagagacuccugaaaccucucucagccucccaccuuccacuugaaagacuaauuucucaagacucagcaaaggaguuaucuccugaauaagcccuuuccugaaccucucagguaugccagaucacuccuuccuugggcuuccacuguacuguacacaugccaccuauaagcuguguggaagugugcuuguuugauuucauuuacuagucuguagaucucuguauuacucuacacugcuauaaagauacuaucugaaacugggcaauuuaugaagaaaagagguuuaauugacucaaaguuccaaauggcuggggaggccucaggaaauguacaaucacaguggaaggugaagcagaagcaaggcacaucuuacauggcagcaggagagagagagagagagagugcaggggaaacuggcaauuuuaaaccaucagaucuugugagaacucccucacgaucacuagagcagcaugggggaaacugcccccaugauccaaucaccucuuaccagguucuucccuugacauguggggauuacaauucgagaugauauuuggguggggacacagagccaaaccauauuaagggcaacugccauggcuucuuaaaucuuuuuuguuuuagaaccuaaaauggucccugguauguauuucauaaauauugauuagcuaugcaaauagcaaauaagcucugagaguacuauagcauguuaaaaucuccaggcaaauguuaauaguuauuauuauuaaccuacguuaaauucucauagguuucaguggaauaucuuuauuaaaaaucuuaaucaagugacgugagcaaaacaauccuaauugacaccuguagacacugguuuucaaccccgggagcuuucaaaaauaucagugcccaggcucugcucauagggguuuugauucaauugguaugggauaugggucaggcaucugugguuuuuaaaagcuccccagaugauuuucaugugcaggcagggcugagaaccauuguuucaaaugucauggauaggaaaagaaaggugcuugggaaaaccuaaggcagagugcucuuccugaaaaugcaacugcaguugugaaagcuucugucuuuguaagguuaagauguguccuugggggaagacacacacacacaaauugcaguuauuuauugagaccagacuacuaagucacuucgaugaaaacuugagagcuuaagacucgccagcaugggcuaagaauagaucacauugcagaaaccagaacaguuucuuggaaggaauggcugaagacauugacaaaggcugagcagaggaugaaauugggaagucacccaucaacuauggggguugggcaacgugaaaaugugcuuaccauuugcaaugaaauggaaaaggccuuggugagaaggcaguggagauuaaugauaauaagucauguugaguuuuaacaagauaacauacaggauaacaaaaaggcaaaaguuuauuaagucagauccugauuuugcaacuaacaccuuuuuuccucccucucuuuuucaccuugagacuguuacagauagcugaguaaggugccaaauuagacucgaacugcaucucagggugaaaacugugagugagcaucagcuaauguuauccuaaaguguauggaauuacaaguuucuaugaagauguuuuugagaaaccuuauuaggauuagugcguauguugucaacauuggauuuucuagagaaucagagugaauauagcugguacauaagcauuguuaauuugcaucauggauaucaaagccuucuugauagaaauuaccuauuugcacugcauacuaauuugggcauugcugcucuggaauugauaaaaguuuagccuauaaauuggcugaaguuccuuuugugcuaagaaagaauuugcuaagcagaugcauaaugugccauuggccauugcgguuaauuuuuuuaagagaauaaauauuuccaagcacuuaagugccauguguuacaaaucacaccacucagggacuaguugaggcuucuuuuuuccuugaagucgggcaggcaggaccucuaguggcaauggcuaguuagcaguuagauuuagugcuaauguuuuagaaaguacaaacugcacuucuuuuaaauucugguugauagacuucagguugauauuccccccaauaauuuaagcuuugcacauucuaauucccugguguucaaauugucacaaguucuugcuguguacauauuucuuggaggaacacuuuuaaagaaaauggcuucaaagauucccaggcaaaguggacaccuggaccuguaaaaggaacgcugccccuaagauguggaaagaggccaacaaauguuuuaauugguucuugacuucaguacuacugacuuuuucucacauggcacacugaugccccuaaauacccauuuguccucugaauuuggucuuucaaacaagggugagagaugauuuugagagugagaagagagcuguucuacuggggaaaagggcacagggagggaguuuugacagguauuugugguggccacagccagugauaaagcaaacacugcagcugaguucaggccccacugugaacgggccugcaguuacaucucacuccucucuucugucaguugggucccaugggguccacuggcaggacccacuccaggcaggugucccugagccucuccuaaccaccucuuucuccuccaugucuuugcucucuauguggcgggggcaagaggggagcaaagggcaguaguggcuugugugcaggcagccagaugggagccugaccuugggucacaggcacacgaaaggcacagccuacugaugcacuauuuggccugugcugugaggaggggggugcagagggagagaggaagagagaagaaaacuccuuucuucuaucucuaaccuaggcaucuagugcauuucaguccugaauucuuucagggcucagcugaaacuguuacuucagaacccuucccugaucaaggucaggccuuccacgggcuuuuuguagcuuccugugcuugucucuaccagcacuuauuauuauuaccaugaauuacuuguguaaauauuuauuaucugugucaguggaugauaagcuucaugagagcagagauuggugucuguacuauuuauuuuuguauucuuaugcaggaggccugagacaaagugcuaaauaaauauuuguugaaugagugagugaggcaacaaaugaaucaaugagauacacaagaacauauguauaagaauguucuuuggaaauaaccuagagucuagcaagagggaaacaaaucauggagauccauuuguuugaauaugucauugaaaggcauaucucaaaaaauauuuacuaacauugaaaaauucucagaauguaagguuaagagaaaaaaguagggacacaaaaauugacauaugguaugauuccuuuuucuuuuuuugacauaaagaaaauacagagaauucuuacuauucaugguaguuauauucuauaaggucacuacaaacacugaauugcaaauacugaaugauugcaccuaggggaaauacagaguuaggcuccugcaagccucuggucacaauauuuuugucaacugaucaauuuauaaccuuguuuuauauguguuucuguuuaaagacaccuucuuuuaauauauauuauugauuacuuaacauugaaaucaugaccaacagcacugucacuuaugccugaaagaagcuuaucuaauaacacacguauuuucucaagacacaucacagucuugcuaugcuuuggacaccagacagugcuucagcuccaugcugcaggcgauuuuaaaccacaagaccacuaacaaaaagcauauaaauaugaaaaauauagcacuaaguagaucuuagaaaagauacuuguuuacaguaugagagcugaaacaagaaggagaggcaucaccuuguuugacuucgccugggcauguaugcaucagccaacucaaccuuuuugcugcucugagcaugugcaugcccacaaauaacugaaaugcacugugaguauugauuugcgguuacaauucaauuuuagcaaguaggggaauuugcaaauacaaaaucugugacuaaugaagauugacuguauguccuuaaaacaaaaaaaaucucagggcaaaucugccccucgugguagcgggacuauggugacauaaacauuuaaagauguauccuuuucuuuaauuccucaaauuucuaaaauuaacuuguauuauuguauaaguaggaaaauaaauauuauuuuucuuuuauuaggaaauggcaaaaugugaugggcagaauauauauagagaaaggguagcaaaaauuucuuuggccagcuguggcacaguaaguuuaaacguaaacagccaaaacugucaguagaguaguuucaaaaacauauugagccauaacuuugaaauauauuuugagccgggcacaguggcucacgccuguaaucccagaacuuugggaggcugaggcggguagauugcaaggucaagaguuugagacuagccuggccaacauggugaaaccucaccucuaucaaaaauacaaaaauuagccgggcauggugguaugugccuguaaucccagcuacucggaaggcugagacaggagaaucacuugaacccaggaggcagagguugcagugagcugagaucgcgccacuguacuccagccugggugacagagugagacccugucuuggugggaggugggggagcggggggagggggaagaaaaaaagaaagauauuuugaauucucucuuauaugacuuuugugaauggccaaaguaucauucuguagucaggaacaggcugacuuuuugagccagggcuucaagcugaacaggagaaagagacauaagcaugaacaagaccuaucucugcaagcagaggucagccacuugacaaaggcagugcaaaggggauggcuuucuccggaaaucccucgcuucagcuacucauccuccaccuccugccaagucuagguuagguuccccucagcagaauguccuucucuguucuagcacuccccacacuguguugucauuaccuguauaugucuguguucccaacuagacuuuaagcucuaugagggcaagggcugaauguagcuugcucacuauugaauuacauugccugacacauugcuuugcacgcagugagggugaaguaaauauuuguucaauauauaacggaaugauuaugcaucaaacaccccaacugauagcgacuccugugagaaucguccucuuuaaauauaagucggugucagaaacaacgccaaaccucaaaaaagaauauugaagaguucaaaugagaaaauucaaacaccccaacagacagugccuccugucagaaucguccucuuuaaauacgaagcucagugucggaaacaacaccaaauacaagaauagugaggaguucaaaugagaaaauuucagucuuaaaaaauagacaagauuucauauacucaggcaaaaagagauagaaauaagaaucugccuacgugugaaaggcaaauacaauuccuguuuccuuuaucuucuuacgauuguacacccuguucaaccaucuuugggcuugugauuacuggguaguacacugcuauuucuugaaguguccauaaacacagauagcagagcucaauuccugaaaugugcuccuguuugauaagguggauuggacuggaucuuguucagccuuuaaucuacuuccuuaagcaucugaggauguuccaaacucaaggcuauuucaguaccuuuguauuugcaauguaugaugcuuuaaaaugauaacuguauuaacuuucuauggccuuuauaacaaauugcugcaaaccuaauggcuuaaaacauuguaaauuuauuaucuuauaguucuauuuaucagauauuugcccagaucuuacuggacaaagauuaagguguuggcaggguacauucucuucuggaggcucuaggagagaguccauuuccuugcauguuucaucuguagaaggggggcugcuuucauugucuugugcccaccuuccuccaucuucaagaccaucaggcugaguucuucccaugcuaccaucucucugguucccucuuuucauucccccuuccacuuucaaagaccuuugugugauuaagcccagcaaaauaauccagaauaaaaaaucuuauuuuaaggccaaccguuuggcaaccuuaauuccaucugcaacuuuaacccaccuuugccgucuacccuaauauauucacaaauucuggggagugggauguagacaucuuugggaguugauauaguuuggauguuugacuacuccaaaucucauguugaaauguaaucuccagcguugcagguaggaccuccugggagguguuggguuauugggguggaucccucgugaauggcuuagcgccauccccuuggugaugaaugaguucucagucuauuaguucacacaaauggggguuguuuaaaagagccugggcugggcacgguggcucaugccuguaauuccagcacucugggaggccgaggcgguuggaacaacugaggucaggaauuugagaccagccuggccaacauggugaaacuccaucucuacuacaaauacaaaaacuagcugggugugggggcacgugccuguaaucccagcuacuggggaggcugaggcaggagaaucgcuugaacccgggaggcagagguugcagugagcugagaucacaccauugcacuccagccugggugacaagagcgaaacuccaccucacaaaaaaaaaaaaaaaaaaagccuagcaucucucuugccacaugacacgcuggcuccuuuucaccuucugccaugauugaaagcuuccugaggcccucaccagaagcagaugcuggcgccaugcuuccuguauagcuuuagaaccauaagccaaaauaaaucucuuuucuuaauaaguuacucagccucaggcauuccuuuagagcaaugcaaauggaagaacacaggggcaauugcucugccuaccaaaauaaauguacacacuauuauauaugcauacaaacuaggaaauauagucauuuauauuuaucaggauucaaaauaucaugucccuaucccaacugucuacugucuguccccucacugccccugaaaaaaagaaaaauauccuaagaugcaaacacucaaaccauggaaugaaauacucuuggagauaaaaaagucaaauacuucucuugcuaugcggauuuaagagaaacaucuccacaguaucaguugugugggaguuuauguguaggaaucuaacugcucaugaguuaucuccaugaagucccgcucacaguaugaauagaugggauccuguuauaaucugcuuacuguuugccuugcaguugugcauauaaauuaugucuaaacccuuuucuucuuaaucauucuucuuucagaaauuuuguuuaucuuucuaauuugauuagacaaggcucuccuaucccccacugcuuuuuuaacagcacagagauagcaggaggauugaucagugacuggagauccacaggggugauaagcuuuucuguauauuuauguagaaggcaaaacacagcagaaugagaaauaucagauuccagauuucaugucccauauguccccauccaacccuguaucaugcauuaaacaaauaaaaaguaacagaagggcccagcauguuggcuucugccuauaaucccaguacuuugggagaucgagaugggcagaucacuugagcucaggaguucgagaccagccucggcaacauggugaaaccccaucucuacaaaaauacaaaaauuaggcgggcguaguggugugcaccuguugccccagcuacuugggaggcugagguagaaggauugccugagcccggaagguggaguuugcagugagcugagauugugucaaugcacaccagccugggcagcagagccagacccugucucaacaaacaaacaaaaaaaaaaaaaaaaaaaaaaaaaaaaagggagagagagagaggaaauaaguaacagaacuagcagcauuucauauuccagcuaccuuuuccccauuuacaaacuccugagucugaaacauuuguuauauuugguuuugagugaaaccagaaucaauaacaaauuuguuuugcauucauuccucaauauauuuacugcgugaauauggaucagcagggauggugugagacugccacacucaagcugggcguuugugcaauccacaucaacacuuccaauacucucaagcaaggccaauaaaucauaaagcucaugugcuacugaauucagcacuucaccaucggcaaaaucaauggagaugcuuccagaauuuucaguuuuacagcuucuugaacaaaucuuuuccccuagucccucucuuugucugucuggcuaagguugaggcauggacacuggguuugccuccucuccauccaccuucuccauccccuuuugagaaaugaccacgugguugaggucgaucuuguagucaagccaauugugguuuuuccaucccuauucccagugaggcaacuuguugcaugucauuccccuggcaaccaagacugguucaguuuggguugauucgaugcuagcagaaguuuuuuggggcuucuagguaaagcguccucauccuuaagugaaagucucaaagagucaucuuuccccaucccaaacugauucuagaacuucugcaggcaucuuauuauagaucugaugaaguaacuguccuagaagaaucacagggagguggagcuccuucccuaucccugcacucaccucuccaguuaugcaggaauauaugcauuauucuuuuguuuguuuaauccuguuugaguuggaguuuuuuguuauauuuccucauucauucaacaaauaauuacaacugucugcuguguacaggcacugcuuuaagcaauguggauuaaaagaacaaaaaggguuccugccuuccaguaggaagaguuuaaaaagcaaauaauaaaucuaauaaaucaggaaacucaacaagaacaagauaaagaacuagagagugacaggagcuauugggggaaagaugagagcagcugacuaauuuuaaauaggguggucagguuucaccucauugaaaaaugugauuuggcucacacuuggaaucccagcacuuugggaggcugaggcaggaggauugcuugagccuaggaguucaagaccagccugggaaacauagcgauaccuuaucucuacugaaaaaagcaaaaaagaaaguacaggcaugguggcacacaccuguaguccuagcuacucaggaggcugaggcaggaggaccacuugagcccaggaguucgagacggcagugagcuaugauugagccacugcacuccagccugggugacaaagcaagaucuuuucucaaaaaaaaaaaaaaaaaaaaaaaaaaaaguguguuuugaguagacuuuugagugaaugagcauuuguggauauuuggagaagaguuuucuaggcagaggauacugccaacacaaauucccuaaguuggaagcuugcuugggaaugugagaggagaaaggaguggugggagugaagugagggagggcagggguuaacagggagcccugugggucuuuuagcccagugcagaagcauuuuguuuggcuuugacucugauucaaauggggaaccacagaaggcuuuugaguagagugaaaaagaucacucuagcuacuguguugggaaaggauuuuggagcaguaaaggaaggugcagggagcugacuuagaaggccacagucccaugccaggcuggagaugcugcagcagugguccaggguuguagugaugaagguggugagcagugguuuggauucuggauauguucugaaggcagagccaacaggauuuccugaguauaggggaaugugggagaaaagcaaggagucaaggaugacuccagcugaaagcaaccuaaaucauuaacucucaaauuuaccugacuugauuaucagcuauuuacaacucaugaauguuacauaccauggagaaguccaacccaaacacaggguucacacgcaaaccaguaauuugauauugagggcucuacauguuccauuaaucacaucccccuacuuaaaauauuuuccuuggcugccuuuuaagaauaaaguuauuuuccauagucuuugagaguuaacucagguaggaccgaagugaugaccguucuguccucugcagcaacgccauugcccuuuauccuuguugugaugugguuuuccugugucuucugcugcuagaugugaugacgauaucccuccuuuguugauggacucagcaucuguacaugggauauuuugacuccaauuuuccugaugcaucauccuaauugucugguaguuacugacugucacuuaccaaccggugugagauauucuucagcucuucaucaggaacagaauuacagccucuaucuuuagaaaugauauaugcugaggauuauucauguuuguaauuacaaaucuagcagaagugcaauuauuaaaaaaaaaacccuuggaaaggacauuuuguuguauaacgcagaaccugcuguuagccucuugugcugguauuacuuuuguugcuguaauugccaccugcauuucaguuguaauuuaacauuaucugucuucucuguaucuuucuaccugauuguaauuguuaggacuccugccauuuauucuuaaauacuuucuugucuuucugaauuacugggcuauuuucuaugauuauaaccuaagaaacagcugcagcaacccuuguugcauuguaaaaacuucagagggcugguuuaucucuaguuuaaaaccagugaagcaaacaguggggggaccuucggaggucauucacauaaaaccaucauuuuaagaaugaagaaacugaagcuuuugagugauuaacuaaguugcucaugaucauuuacauucuuauuguuaugcuguacucuggaguagcaaguauggauauauauucagagauaggaucuuuuaaguccuagcacuuugcaauuuaugcugauuaaccaacgaccugccaaacagagcucaagaugggaagggaagcgacacuaaauccuuuuuuugagccagauacugcuaggugcuuuguaucauggaccacauugauaugcacaauaaucugaugagguaggaauaauuaugccaauuucucucucucucucucucucucugucucucacacacccacacccccccccacacacacacaugcugggauuuuugggagauuaagcaacaggcucaagagcacacggguaguaacucucaaauaguaagaacugcuugacuuuccacccuuucucuuucuaccaaaucaggaacagaauaauggauaucuuccaaaggggugagauaugagcaugagcuacuuuuuuuuuuuuuuuuuuuuuuugagauggagucuugcucugucgcccaggcuggagugcaguggcgugaucucggcucacugcaaccucccucuccuggguucaagggauucuccugccucagccucccaaguagcugggacuacaggcacgugccaacacacccagcuaauuuuuuguauuuuuaguagagucaggguuucacuguguuagccaggacggucucgaucuccugaccucgugaucugcccgccuuggccucccaaagugcugggauuacaggcacgagccaccgcacacggccagguaugagcuacuuuuaaggcaguuggaagcccaaagagcuugggaaaccaugaagacuaggccucacaacugcaguuuucucaggccuaugcagcugccuccauccuuuugcucugagcaaaacuggaccuaguuaagcaauguugcccaacuguuaaaaaaggaagcucaaaacuaggagguaggaugccagauaauuuguuuaaauuuuugaucuuuaaaaucuugacucuuugagcuuguuuugagccucauugguccaaaguggcucaaucugacugaggaagggguuggaggaggaaggaauguaaaaaugaaagaucggugggaaaaggauacugccuuagguugucuguagguaaauaaagguuugacucuauaaaaacucucuuccugaaauaaucaagaaugcuucacaucagaagcaucaauuaaauggcugccuucuuuuuguuaauucuuuagucuuuagcuauuucugcuguugcugcagaggcagagagauggugaaagaaucaaccucaggaaauaguauggaggucaagggucagcuaagaggaucuacugauuuucugaucugcggagcuuucugagugagucucccuugaauugcaggagggcauccaauaggaaacccaguaugcaacaaucucaagagauagccucuagaacacugggauuagcauuaauccaugaaaaugaggugcuauaaugaugaugaugaugagacuagaaccuauaguuacaugcauugugggaaagguuugaauugaaaggcugaaggagggagugguugucuuccaagaggguaugauggucaugcugaaugaagaaugaagugaaagaagucagugaagaugcauuaagaccguaggucagguucaaguaguaacucccaaggguucaaccacauaaugacgcauugaaggaugucuauuacaaucauaagaaacagcaaagugguugaguauaguggcucaugccuguaaucccagcacuuugggaggccaaggugggcagaucacuugaggucaggaguucgagaccagccuggccaacauggugaaaccccaucucuaccaaaaauacaaaaacuagcagggcaugguggugcccgccuguaaucccagcuacuuaggaggcugaggcaggagaauaacuugaaccugggaggcggauguugcagugaguugagauugugucacugcacuccagccuggguaacagagugagacucugucucaaagaaaagaaagaagaaaagaaacagcagagugucccaucuguccugcgaguccuaaggaaacugauuaauggcuucaaaaguuuauuucucaucaaaaugaacuugauuaauuacaaauccagauuuuuuaguccugccccccaaaagucugauuuuaccaaugaaaauaacccccagguaauuccugcaagcagccucacuggaaacaucugggguaggugaccccaacuucugucauugugaguuucugugugcuaccuuucuuuuuugguuuuuguuuuuaauaaacaggguguugcucucuugcccaagcuacggugcaguggugcaauuauagcucacuucagccuuaaacuccuggguucaaggaauccuccugcauugcugggauuacagaugugagccacugugucaggcucucuguguguuccuucuaauaguacuucuagaacaucucuuauuuuuuucuuuuccagcucggagauucuuaauuugaguuucuggggcucaaugaauagggcccaggggaucuacaaccccccugaaauuacaugcagaauuucacauauauaugagcuaugugaagagucucaaaggaaucugugguuuccaaaggguuuagaacaauugcuccaacuguucuauuuaucuccuuucugcccugaccccuggagcugguucacagcuuuuuauccuggccagucuuccuggcuuuaguggacaguacauuugucuuugacuuugaaacuuuacauuaacuaugagacauagcgugaaacuuuggaaagagaggggaucacuucuauguuucuauuaaaauuaauuuccuuuggaagaauaugccugugacaguuuucauagaacacugcuguccccauuuuaaugagaaacaaaaaaauucauccacgucaccaauauucuauugugucucuuuucucccagaagccgaucucuuugcuaaaccaucuucagcacagcuccaguugaaguccuuugcuugucuggguccuuuguugcccucccgguguucugcuguccacagaauauagcccugacucgguagccuggcaucugugcccuuugcaaucugacuaccuccugcugcucuccuaauuguuccauguuccaagcuaacugugcuccucgccauugcccaagcccugucugugcccucuucccucugggccuacaggggaugcccucccucuccucuccaucugucaccguguacccuuguucaaggccuucaucccaucucuccgucagccagaaauuuccucuucugugaacaucaauuguacuugguucauacgggucuuauggcauuuguuacauauugauuuuuguuugauuaugcaugauuuguguuucucuuuuuucuuauuagauuccaagaccuuucaucacagggccuuuguugauuuaacuguguaucuggucaauugccugucacaguaccuagcauacaaaaagcccucaauaaaaucuggugaauguauuuaaaaaccuagauagggcuauuuuaauucagaaaaauaaaucuguuugccuuuuuuccugguaaucuaaguugggcaguugcacgagaacugcauauaaacugcauucaacucuugauaaauuagaaaagucaucugauggcuucauuaaaaugugggcuuuaaaauuauuuaugauuucauuuuucauaacaucuuugugagacuuguaguaguguaguauuccccccgucuuuuggauggugauuucacugaggugagagguuaaagugggucauucaaggccacagagcaggcagguaacaaaacuggcacuggaaccuuggccuccuggggccacguuagcagagcguagcauugacugcacuaaggauggaauacaaaugugcuuacacauugucaaauccugugggucaaaaaguuuguuuuagugaaagcaucacagauaaugaaguauuugaaauuuucucuuuucaccuuuuggcaugcaggcuccucucucucuguucccuaaauaaggacacgucuguaggucugauccucagcccugucugucugugaccuucuccaguauccaggacccucggcgaucaauaccugccucgugguuucaaugaucaucacucugcugacuuaccuaacgucuuugccuauggugaugaccccugccugcucuccaccucacaucucuugugguuuaccagaaguuuccacuuagaauucugccaucacuucaaaauccagauaucuaaauccaaacucaucaucugcucucugaacaaacuuacuccuuucucaaucuacauuuuucuaccauaauucuccuagucauccaaguucaaaaucauuguuaucuuuaacuuccuuuauuuuuuuaagagacagcuucucaucccacugcccaugcuggagugaaguggugcgaucauggcucacuauaguuucaaacuccggggcucaagugauccuccugccucagccucccaaguagcuaggacuacaagcacacaucucugcacucagcuauuuuuuuuuuuuuugagacagaaucucacucuguugcccaggcuggagugcagugcugugaucuuggcucacugcaaccucugccuccugaguucaaacgauucuccugccucagccuccugaguagcugggauuagagguaccugcuaccacacacaacuaauuuuuguauuuguaguagagaugggguuucaccauguuggccaggcuggucuugaacuccugaucucaagugauccacccaccuuggccucccaaagugcugggacuacaggugugagccacugcgcuaggccuaauuuuuaaauuuuuguagaaauggggucuuauguugaccaggcuggucuugaacuccuagcuucaagugauccuccugucuuggccucccaaaaugcugaaauuacagaaaugagccacuaugccuggccuguuauuuucagcuuuuuaauuggcuuugucuuauugauacuuccuucaaaauguuuaucauguccauuugagaaucuagagugguuuuuuuuuuuuuuuuuuuuuuuuuuuuugccaaggauuaccucuuucucuagagcccuccaccucaugcacauuccuuucuuucuauuuucauuaccacauugugaucuaggucuucucuuccucuuccuuaaauuucacugguguucauuuuguuacaggaugaaauccauagucuucaaccuggcauacaaaaccucccacaagcugacuccaguugaucuuuccaacuuucuagucuaauacuugccucugguaauuuuuuuuccaauucuucuguugacuguccuggaaugcaucuuacauggccuugcuuugguccucaguuuaguucuuuuauuuuccaguuuacuccuuuggauacuucucaucuucaagguccagcucaugucucaucuuuuugauaugaccauuccuaauuauuuaaauccauauucugaaguucuuggcccuuguugucuacaucuuugcugcucaaagugucauuaaaugagcagcagcauugucaccaccuggaagaugguuagaaaugaaucuuggggcucugccucagaccugcugaauucaaaucugcauuuuagcaugauccuugaagugaugcaugaaacacuugucugucccauuuagauacuuagauaauacucaauccaaacaccaacuuauguacuuaucugcacuccucaagauccuugaaaucugcgaaccuguuuuauuuuucuuuaguaucucugaaacacaauuucaugguaaaguaggugcuuacuaaauagauuuuaguguccuucucuuucuuuuucuauuuaaaggaggaaaaaacucccaagacuccuagaaagugagcaugagcugcuauaguuugaauguaaccucuucaaaauucagguauugccaaugagauacuguuaagaagugaagccuuuaggaugcgauugagccauuagggcuccucccuugcaaauggaacaaggucagcaaaccaauaggagugcuaagguaaaugacuguagaacaaaaugguguuuauguagcuugaugguacauguaauuucacaauugcauuuugugucugaaaaacauaugagguuuugcuaagcuuaguagagaaaugccugcuuuguggcaauguuguccauuaguuaaccagagagaaauaugagaacagaugaugucacuauauucuuccacuagccuagguucuuaaaagcucuaagacuacaaguguuauagaugacuccagcaugcacucauacugcuacuuaacuuucuucauggaaaugugucuuauucugucaacagacuaaaagaggggcaaggacauauauuauauaauuuuguauauacucgauaaugcucaggacauagagcuucaguuccuucccucccucccucccuccugcccacccuccauuucuuuauuccugccuuucauccuuuaaguguuuguugagugauugagaucaaauauugauauauuguaucuauagaauagaauauucuauucuagugcuauuauauaugcuggggauaaaucacgcauuaaaaugaauguccuucucuuuauggaacuugcauuccaguggagcaaaaagauaaacaaaaucauaagaggaauuuauacuuagaggacgauaaguacugcagaaaaagauuagagaagagggcuuggaauuggggagguauacuuuaaaauaaaaagccagagaagaccaccuuugagaacauaauuuaagaaaagacuugaaggagguaaauuauguagcuaucugagggaagaccuucccagagaguggaacagcagguacagggcugaggugggcaugaacagggaagaguaagaacggucuuuuggguuugaaguagaaggagcuugcaggagaaugacaggagagaugaggucagauauuacaucucaauaggaucucucuggcugcaauauugagaaaagccagaagggggacaagguggaggugggaagacgaauuagaaggccacugcaauaauacagacaggagauggugguggcuuagaccagggaggcagccguggaagaggugagaggcaguuacauucugcauauauuccgagaguacagccaacaggauuugcugaaagauugaauuuggcauaugagagacagagaggcauccaggauccaggcauuuaagauuuuuggccuaagcaacuagaaagaugcagcugccaucaagugagaugggggaaggcugcgguggagaagucuuuuuuagggaagauuaggaacuuagcuuuggcaauguugaguuugacauaucuuuuagacaaguggagauauugaggaggcaguugaauauugguggaaugaacgaauaaccaggaucuuaaucaaguguuuaacucccuuaaacauaaaucaacuuuuugucuacuuccucauaaugugaagcacuuugggaugugacauuggaaaucagacucuucugaccaaggcccaggucugccugaauuccaggccuagagaucugacaaugugcuggccaucuucccuuaaauguucucuagagccacaccaugucuaaaauggaacgcacucucuuuaucccaagccuggucucccucuuugugacuguggugagugggcaccacuaggcauguaagcuggcagucacacuucauuccuuccauuuccucaucuccauaucuaauuggucaccaaaucuuaccaaccccacuuccaaaccaucucuagaacccaucuccccccuccgucuucacugcugcuuuuuuggauuuaugcucucauugucucucaccuggauuauauguaaaucuucuccuaccugguuucccagucuccaaucgauccuucacauagcucccagagugauuuucuaaaauguaaauguggccauguuacucuucugcuuaaaacauuuccaaaggcuuucuucuguccauaaaacccaaaacuugaguuuggccugcaaggaucaucaagaucuggcuccugcuuaucucuuagauuuauuaucccccccaucccccccgucacuccuauccauuggccagauuauacuaccuguaguuaguuaacuuauucauucaauuuucagauauaaauaggaugcuucauauguuacaagcacuaugcuaagcugugggggauacaaagcuagacauugaaaaagccugaaauaaaccugguugucuuccuuccuacuuacuuacagucgucauacaguaagcuguggggauacaaugcugcauuguacgcagacuugguuccugcccucaugaaaguauacuuucucaauuuccaugccuuugcucucugaacccccugccuugaauuuaccaccaucugcuccucccuccaucucacugccauguccuccuucuccuaccagcuacuuaaagaauaccaucucaacuuuuaagaaucagcuuacaucauucccuuguauuaagcucuuuacucuaucuccuuuucucuucuaaaaauguuuccucccucaaaagguaucauugaaaaacuuaauagcucuagaagugaggauaucucuaaauacauuccagguucaguucagaauauuguuuuaucuuauacuagaagaucauagcucaaggaaugggauuuccuucuuuaucccaaaagggaaaaaagccuccuuuuccuggauuuuucccaugcuccuugggcuccacaagugggauaagcaauuguuaacuugcugcagagugagugaacccaauugcauuggauucacacacaguggaugcuccaggauuuuuuuuaaauauuuauuuauuuauuuauuuauuuauuuauuuauuuauuuauuuauuuauuuugagacggagucucucucuguugcccaggcuggagugcaguggcgugaucucgguucacugcaagcuccgccuccuggguucacgccaugcuccugccuuagccuucugaguagcugggacuacaggugcccaccaccacauccaguuaauuuuuguauuuuuaguagagacggguuuucaccauauuggccaggauggucucaaacuccugaccuugugauccaccugccugagccucccaaagugcugggauuacaggcgugagcugccaugcccggccuucaggauuuuuaaauaguaaagcguuagggguggugagcugauugguaggggugcuaggaaacuugucuuaaagcuaaguuugcauagcuagcuuacaauuuucacuuagauuaauauacauagauuuauaguagcuugugggggacugauaaagauguggguuaaagauuccuuuuaaagccaucccuuaaugcuaccacuguacagaaagauggcagagugacugccuuuauagacaccugcccacacuuccuaaucugcccucaguugcaacuccuagagaguaggcacacagcuuaggguggaaaauacaugaaaauucaguacuuguaaauagaugggagguggguaaugaggaugagcgacagaagaaaaaaccuucuauauuugucuguucucaccaccuaagggguucuucagaaaaccagugagcuuuacgcucagguugagaaauccuuguuacagucacuuuaauugcaaucucuauuucuucucucuuuuucuuucucucucugugucucuacaccucucccucaccacuuucuggauaugcacacauauuuacauucagaugauuuuagaaagcuccauuggggaauaacuauaaauuaugaauaugcaacagcacuaaaaccaacuauuauagucaaaaauccugaaauaaaccuccugguucucuuccuuccuacuuacuuacagucagcacacagcaauauaucuuagagugaggcuaaauggauaucugauacucacucgaaugugauaggcagucaacaacccaguuaucacuguugaagcauuuuaaggacuacuuccaugucacucuggcuaugauaaaaaccauagucuccaaauugguacaguaggaugaaccuuccaugacgacugguagcauguguuugauuacacauauguauacauacauguacacacaauacacauaccuaaacauuauaaccagauuaguauauuccuuuugcauuguacugaauacuuuaaaauaauguuucaucagugauugucagaguuauaaaaucauuugaauauauuaauaagcuauaaacauuuuaauuuuaaaggauaaaauaugcugcacaaaagagccaguacagccacugcuuauguguuuaauuuauuuaaagagaugccuguucuguuauuacuucaaauauaguuauaucuacauguaagugauuuuaauuugcuacaacauuuagauguaucaaugagacauuucauaaauuaaaauuguaucacguagggagacuaucuugauuaugaagcuuuauuaggugaugauuauaagugccuuguuuaauaauuauaacagcuuaauggcuccuguaguuauacuuuauaauaaaaauuucacauuuaauaauauggaaagggaugguacacagugaacugacaaaaaaguauugauucugaaccuuuaaauuggauuccuauugaucugauguaugaauauuuuauugguguaaauguuuucaggguugccaguuucuauuacugcauguuagcaauuuuacuggcuauguauaauggacaaauuaaaugccaggauaugggcauauccagcaccccacacugauuauuuugauucacuuaucacuauacacuacuagggccuucccuuucucugucccaucucuguucuggaaggugagccacagacuucuucuguacaugccucagauacaugacaagccagugauggguggucuggcuuguuaucugguagaggcugggugggcaugugucucuuccugcuaaggcccacagccccuuagcuaagacuuacacauuugcuccaaggccagucauuugggcccgaguaccuaauggauaauaacaggggcucugggauuagguagagcaagauggcugaacaaaagcuucaaccaauuguccuccccacaggaacaccaaacugaacaacuaugcacacaaaaaagcaccuucauaagaaccaaaaaucagcuuagguaccagcuuggccacaguggaguagagcaccaagcaggcucuuggggucccugauuccaggccuagcucuuagauggcauuucuggacuugcccugggccagaacggagcccauugcccuucugggagagucccaguccugccagcauucaucacaagcugacugaagagcucuugugccuugagugaacacuggugguacccaggaaguacucaccauggaccuaggguaguggugaucacagggagagacuccucuguuuguggaaaggggagggaagaguagaagaacuuuguguugagguauguguuccagcucagccacaaucgaguaaggcaccagguauauuccuaagguuucugacuguaggaccuggcuccuggauggcaccucuggacccacccaggguuuggggaauucacugcccugaagggaaggacacaagccuggcuggcuuugccaccugcugauuguagaacccuagggcuaugagcaaagauaagcaauagccaggcagugguuaccacagguguugggugagacccaaugcugugcugacuucaggucugaccuagcacagucccaagggcaauggccacaagggugcuugugugaucccacccacaguucuaggcagcucagcacagagagagagagagagagaugccauuuguuugggagaaaguaagggaagagaacaagagccuaugucuggaaauccaaagaauucuuccagaucuuauccaagaccaccaaguaccucuaagagaccgcaagagucacaguguuacuagacucgaggugcccccuaaugcaguuauggcuacagugaccaaaaacuuagaucacaacacucaagucccuuugaauaccuggaaggcccuucccaagaagaauggguacaaacgagcccagacuuagaagacuacaauaaauaucuagcucuucaaugcccagauacugacaaacauccauaagcaucaagaccauccaggaaaaauaaucuuaccaaacaaacuaaauaaaucaccagggaccaaucccagagagacagagauauguaaccuuucagacagagaauucaaaauaacuguuuugaggaaaugcaaugaaauucaagauaacauagagaaggaauucagaauucuaucagauacauuuaacaaagagauuggaauaauuaaaaagaaucaagcagaaauucuggaguugaaaaaugcaauuaacauacugaagaaugcaucagagucucuuagcagaauugaucaaguagaagaaagaauuagugagcuugaugacaggcuauuugaaaauacacagucggaggagacaaaagaaaaaaagaaugaauaagaaugaaggaugccuccaagauguggaaaauauccucaaaagggcaaguguaaguguuauuggcccuaaagaggaaguacaaagagaaauaggugcaggaaguuuauucaaaaagauaauaacagagaacuuaacaaaccuagagaaagguguaaauauucaaguguaaaaacaccaagcagauuuaacccaaauaagacuaccucaagacguuuaauaaucaaacucccaaagaucaaggauaaagaaagguucggaagaaauaauauaaauagaguuccaauaugccugguagcagacuuuucagcggaaaccuuacaggccaggagaaacuggcaugacauauuuaaugugcugaaggaaaaaaaccuuuuaucuuagaauaguauauccaacaaaaauauccuuuaaauaugaaggagaaauaauaacuuuccuggacaaacaaagguugagggauuucaucaacaccagaccuguccuacaaaaaaaugcuaaagggaguuuucaaucugaaagaaaaggacauuaaugagaaauaagaaaacaucugaaggugcaaaaaacucacagguaauagcacagagaaaaucacagaauauuauaacacuguaauuguaggguauaaacuauucauaucucaaguagaaagacuaaaagaucaaccaaucaaaaauaauaacuacagccacuucucaagaaauagacaguacaauaagauagaaauagaaacaacaaaaaguuaaaaaguaugcagugggggggaaugaaguuaaaguguacaguuuuuauuaguuuucucuuugcuuguuuguuagucuaugcaaucaguauuaaguugucauccauuuaaaauaauggguuauaagauaguauuuucaaaccucaugguaacuucaaaucaaaaaucauacaacagagaaaaaauaugcaaaaaauaaaaagcaagacauuaaaacauaccaccagagaaaaucaccuuuacuaaaaggaagaaagaaagaaaagaaagaaggaaggaaggaagagaagaccgcaaaacaaccaggaaacaaauaucaaaauggcaggaguaaguccuuacuuaucaguaauaacauugaauguaaaugaacuaaacucuccaaucaaaagacagagaguggcugaauggauaaaaaaaaaaaacaagauucaacaaucuguugccuacaagaaacccgcuucaccuauaaagacacacauagacugaaaauaaagggauggaaaaaauauacuaugcaaauguaaacugaaaaagagcaagaauagcuauacauauaucagacaaaauagauuucaagacaaaaacuauaagaagagacaaagaagguccauauaugaugauaaagggguuacuucagcaagaggauauaacaauuauauauauauauaauauauaauauauauuuucacccagugcuagagcacucagguauauaaagcaaaaauuacuagagcuaaagagaaagauagaccugaauacaauaauagcuggagacuucaacaguuucagcauugaacaaaugauccagacagaaaaucaacaaagaaauaucagauguaaucugcaauacagaccaaaugcccuuaauagauauuuacagaacauuucauccaacagccucagaguacgcauucuucucggcacauggauuauucucaaggauagacuguauguuaggccacaaaacaagucuaaaaaauucaacaaaauugaaauuauaucaguaucuucucugaccacaauggaauaaaacuauaauaaaucaguaucaagaggaauuuuggaaaauauaaaaacacacggaaauuaaauaguaugcuccugaaugaccagugggucaaugaagagauuaaaaaggaaauaaaaaaauuucuugaagcagguaauaauggaaacacaacauaccaaaaccuacgggauacagcgaagccaguacuaaagagaaguuuauagcuauaagugccuacaucaaaauagaagaaaaauuucaaauaaacaauguaacaaugcaucuuaaagaacuagagaagcaagagcaaaccaaacccaaaauuaguggaagaaaauaaauaaagaucagagaagaaauaaauaaaauuaaaauggagaaaacaauaugaaagaucaaugaaacaaaaaguuggguuuuucuuuuucuuuuuuuccuuucuuuuuuuuuuucugagacagaguuuggcucugucacccaggcuggagugcaguggcaugaucucagcucacuacaaccugaaccuccuggguucaagcaauucucaugucucagccuccuggguaacugggauuacaggugugccaacaugccuggcuaauuuuuguauuuuuuguagagaugggguuucaccauguaggcuaggcuggucccaaacuccuggucucaagugagccaccugcuauggccucccaaagugcugggauuacagggaugagcuacugugcccggccaaaaaaaugauuuucuuaaaaagauaaacaaaauuuuugucaguugacaagacuuaaaucuaagacuucaagcuaugaaacuauuaaaagcaaacauugggaaaacucuccaggcaagugauuucuugaguaauaccuuacaagcacaggcaaccaaagcaaaaauggacagaugggaucacaucaaguuaaaaagcuucugcauaguaaaagaaacaaucaauaaagugaagagacagcccauuuaaugggagaaaauauuugccaacgauccaccugacaaaggauuaauaaccagaacguauaaggaacccaagaaacucuauaggaaaaaaaucuaggccaggcgugguggcucaugccuguaauccuagcacuuugggaggccgaagcaggugaaucaccugaggucaggagauggagaccagccugaccaacauggagaaacccugucucuacuaaaaauacaaaauuagcuggguaugguggcccaugccuguaauccagaucuucgggaggcugaggcaagagaauugcuugaaccugggagguggagguugcggugagucgagaucgugccauugcacuccagccugggcaacaaaagcaaaacuccgccucaaaaaaaaaaaucuaauaaucccauuaaaaacugggugaaaugucugaauagacauuucucaaaagacauacaaaugaccaacaggcauaugaaaaggugcucaacaucacugaucaucagagaaaugcaaaucaaaacugcaaugagauaucauuucaucccaguuaaaaaggcuuuuauucaaaagacaggcaauaacaaaugcuggugaggauguggagaaaagggaacucucguacacuguuggugggaauguaaguugguacaaccacuauggagaacaguuuggagguuccuuaaaaaauuaaaauggaacuaucauguaauccaguaaucccacugcuagguauauacccaaaagaaaggaaaucaguauauugaagauaugucuuaucucuguacucccauauuuguugcagcacuauucacaauggccaagauuuggaagcaacccaaauguucaucaacagaugaauggauaaagaaaauaugguacauauaugcaauggagugcuauccagccauaaaaaggaauuagcucuugucauugucaacaacguggauggaacacgaggucauuauguuaagugaaauaaaccaggcacaaaaagacaaacuucacauguccucacuuauuugugaaagcuaaaaauuaaaacaauugaacacaugaagauagagaguagaaugaugguuaccagagguugggaaggguauugagggugcggggaagggacggugagacaguggggaugguaaauacguauaaaaauauaguuagauauuuagaauuaauaagaucuaguauuugauagcacaacagguuaacuauagucaacaauaauuuauuguacauuuaaaaauaaucauuuguaacacaaagaaaggauaaauacuugaggugaugcauacccauuugcccaugcaauaaugccuguaucaugccuguaucaaaacaucucauguaccccauaaauauauacaccuacuacauaccuacaaaaauaaaaaaaaaaccccuggacucuggagucagauucauucaauucaaauaauauuuauugagagccaaauagcagacauuguuccaggugcuaggaacagaaucgugauccuggcuucauggacuuccauucucaugauugccuagguucaaauccuaacucuaccucauaaccucaggaaauauguuuuacugucugaacuuaucucuuaauuuguaccagauucauguuuguugcaagaauuuacagaggcaauguauauaaagcauccaauaucaugccuagcucauugcaagugucacuuauuuuuauuuuugggugaaagucugaugcaagccauauuuaugccauaaauuuaauuggaugugaauaugaucuacuaguugaaaugacucugauuucuaugcuuuuuaaucuagucugagcagcauuuaugauacaguaauggccaaaagacaaugaaaacacuauuauuuaucuuaauaagacaauccuaagccaaaagaacaaagcuggaggcaucacgcuaccugacuucuaacuauacuacaaggcuacaguaaccaaaacagcauggugcugguaccaaaacagagauagagaccaauggaacagaacagagcccucagaaauaauaccacauaucuacaaccaucugaucuuugacaaaccugacaaaaacaagaaauggggaaaggauuccuuauuuaauaaauggugcugggaaaacuggcuagccauauguagaaagcugaaacuggaucccuuccuuacaccucauacgaaaauuaauucaagauggauuaaagacuuaaauguuagaccuaauaccauaaaaacccuagaagaaaaccuaggcaauacuauucaggacacaggcaugggcaaggacuucaugucuaaaacaccaaaagcaauggcaacaaaagccaaaauugacaaauaggaucuaauuagacuaaagagcuucugcauggcaaaagaaacuaccaucagagugaacaggcaaccuacagaaugggagaaaauuuuugcaaucuacucaucugacaaagggcuaauauccagaaucuacaaagaacucaaacaaacuuacaagaaaaaaacaaacaaccccaucaaaaagugggcaaaggaucugaacagacaauccucaaaagaagacauuuaugcagcccacagacacaugaaaaaaugcucaucaucacuggccaucagagaaaugcaaaucaaaaccauaaugagauaccaucucacaccaguuagaauggcaaucauuaaaaaaucaggaaacaacaggugccggagaggcuguggagaaauaggaacacuuuuacacuguuggugggacuguaaacuaguucaaccauuguggaagacaguguggcgauuccucaaggaucuagaacuagaaauaccauuugacccagccaucacauuacuggguauauacccaaaggauuauaaaucaugcugcuauaaagacacaugcacacauauguguauuguggcacuauucacaauagcaaagacuuggaaccaaccaaaauguccaacaaugauagauuggauuaagaaaauguggcacuuauacaccauggaauacuaugcagccaugaguucauguccuuuguagggacauagaugaagcuggaaaccaucauucucagcaaacuaucgcaaggauaaaaaaccaaacaccgcauguucucacucacaggugggaauugaacaaugaaaacacuuggacacaggaaggggaacaucacacaccggggccugucgugggguggggggaggggggagggauaacaguaggagauauaccuaauguaaaugacgaguaaauggguguagcacaccaacauggcacauguauacauauguaacaaaccugcacguugugcacauguacccuagaacuuaaaguauaagaauaaaaaaaaauguagucaauuguggugagucauaggagggaugccaaguguggaaucaccacagaugccagucaaggcucaacgugaccagcuguucagggugcuuugacaaucccaagccuugaaacuaccuaaaggcuccuucugagucaaauaucaaaaaaauggaucccaaaugacuccuaauaugauuucucccagaugcucuuucugauaacuuuguuuccgacguugauaucugaugcucuccuaauuacuuuggaccacuuucuuccuggaagacucuauauggcucuuaucauugagcagcucuuugcaaugaagaugggaaaagaccuccacuaucuucuguuaugaucuaaggcccucgaugagguacccauugccuccauguaucuuccugggaaggccuuucugaggcuuuggcugguaucuuaauuucuuguggaauauacauacugguguucuggugcugugaugucuggauauguugagguauugaccauacccuggccagugguuuuccuuuuguuuauauggagagagucccugcucuggcaagggaagagaugaagggaagagaggguagaagaggggaggggagggaagaggaggggagaggaggggaggggaggggagggaacaauuuacugugccuuuuuaaaaagagaucagccaauaaaaagguagauuuuggagacagacaaaucuaaaaaaaaaaaaaaaaaaaagaaaugaagguuccaaauugaucaccuaaaucauacaguccuuuaucaaaaugccuggaagccugucuaggcuggagguuggcuaacagcauacacucagcugacccggggaguacugauuuauuuuccuauguuagaaguuaggccucaucugaaaggcagagagaagggcaucaucacacucuaugcccuauggacugggauuggggugggcacuggagacuauucaagagggcauuuuugggaaaauaggaagagagcucaugguggaagacagggaaaguaccaguagaagccgcauucugacaacauuccacaaggagagaagcuaauuaaaaaugggaaccugacauaggccaacuaaaugaguaucucuggggcugggaucuggcagugaucuuucauaagaaaaacuccccuagauaauucuaacauagccagagguaaaaacaacaacaaaaaaccccacuacugcuccagacuaguaguucucaaaguguaauucgcagaccagcacacguggguauuuguagaagugcaaauuaacaggaccccccaccaccccagaucuacugaaacagaaacucugagggugggacucaggaaucugugucuuaacaagcucuccagugauucugaugcuugcucaaguuggagaacuacugcucuagauaagucauaccagaccaaaaaaacaaacaaacaaaaaaauuaggaaggucaggaaggcaggcaggguaaaauggaucaggguggaaguccacugugguuuccuuuuguacuuuagagaagaaugaaaaacgcacauugcucacuuccauacaacuuuggagaggggaagguaucuaacccuucaccuuucucucuccuaaagcuccuuccuaggagccauuaaaugacagaggccucuugguuccaaguggguuuuaggauuuuuaaauaaaaugcagagacuaauaaugaaauuuguuggaccaucagaaaggacagcagauggcccuugugccuaggagggagggagggaggguaaccgcuuuccagaccaggaaaaaauaaacuaagaauaaaaagaaaaccaaaugauuaaaacugaacuuugcuuuacuuuucccuuuuauuucaugaaagcaguguuugggcacaguagagauauguuaauaaaauugaauaaugucucuugcacuaaguuuucaguacaagaugaaaacugcauaagaacauguucuaaugaugcguugguuuucucacaguaacauccagcccccagaacauucucuggcagcacccacacucuccuguccuagugaauaaaccuggaacaaagcugaaaaucugaggagcugccgccuggauggggaaggauaugcuugugaaauguagcuuggcucuguugcugacuuagaugggaguacaggaaagucauuaguuucucuggcccucaauuuucucaaguaggaaaugacagaaaccacccaaaugaacugaaaugucaaagugaucuccacaggcccaggaagagggccaggugccauagccaaacaggauagcagaaaaucgcacaggcucauggugucacauucugguaaaugggcaugaugaaauuuaacuaagcugaaaaacugagaaguuuagugaucaaaugugggccaaacauucuaugggcauuuuuguuguugcuuauuuuaauggucuuuuccuccucauacucacaugcugugcaaaaauuauauaauuauauaaaaaauaugaauuauauaaguaaagaaccccaaccaaaucucaacugauuuugugaaaaagaaauaucuuuuuuuugcuuacucuuaaguucuuuuuaucagaaaacaaauaccacaugggauuauuauuuuaaacacaagcugcauuuaagagaaagugucuaguaaaccuucuggggcuguaaauuagcugcuaauuuuguuugacuaaaggcuguaaaaugcauuucugggaauuauugugcacagagaacauccuccuaauacuucagugggcuugaacagagaaauggaauccuauucaguauaccuguuacuaaacugaggcuacuccacgacccaggcucauucuaucuaacuacauagccagcuuuucuggauuugugaaagaugagauuuugggaaagaacaugagaaacaaugagucauucacagacacauaaguagagauuugaaauugguguucagaccaucuaaucuucacauuuccuccuuuguucaaucucauuccagucucugaaauuuuccaagggccuguuuauuacucuguucuauucaccuacugcuauguucaguuacugcccccuguuucucuaauggaguuuugcuuucaagacugggcacaacucuucucaauauguauuuacauuuuucauuuccuuauacaaguuccaucauuuuuucuuuaugauaguuuucuuuaaccuguuuauucauuuguuucauuuguuauauuuucauguuuuuuauccugguccuuauuuuccuccaugacaccucuucuuauacuugauguuguucucuagaaugcuguuaaauuugcuaccugucucuuucaaaauuuaccugggcaaugguagcacacaaagggccaugcagacuugccaauauuaggcugguuuggccuagcauaguaccuggcacacagcaggcauucaaucaauaucuguucagugacugccugaaugaaaauagaaaugauaucaguaguuuuuugcaauaaucuuaagcaaaauuauaaacuaauaacuuccacuccuuuaaaugugugucaacuuuucuguacuaauuggaaaaacaucuaguucauguggaucaaaauugagucuauaugcuacguagggcaaaggcaugccuggauuuuaacaucucauccucagugacucuaauggugccuggcacagaggagaugcccaauaaguuuauaugaaauggcuuagaauggacuaccuucuccaugcgacuaaugaucuguuacuacuuccugaaagguuagccauuauugauauaccacuucuagaugcugugacaaauggcacagcucagcagcaaaaguacuuuuuaaagucuaugggccuccacagguugaguuugaaaaggaucuguuaauccucugaaauuacaugugauuuauggggagaaaguuuacaaaauuauuaauacucuugaaggggaauaugaccuccccccaccccaaauuucagaaccacaguggauaaugaaaguuucuaugcuguaagagcaauuaggaaguccugaaaaacagggaauuuagucaggagacuugaguugaaauccuaacucugccccuugcuggcugggugaccuuggccaaguuuuaaacucuuucuuaucuucaguuuccuuauuaugacauggugauguuaaugacaagucucuagacauagugguuaaacuucaacuugaacccaaauuuuucuggcucuaaagcccaggcucuuaacaucuaucauccuacauuaauuaaaugagauaacugaugugaaaaugccugauguaaauauuuguuaaagcaacaacaaaaaaugucauuugucaaaguaacaaaguauuuuuuaaaguaacaacaaaagagacagauaaccacaaagaaaaggccacuuuagaaauuccucuuugaccuauuaaagaauguucaaguucaaaauauguuugucauuaugauuaaaaauccaaccccaaaacuugggugaagacggcauaaucuguuaguuuggauauauacagacuaaggggauucuuuggaauacccuuugucuagagugaucuuaugacaugguacggauaacuagacucaccuaacauucaaaugaagggcugugugucuucuauacuuuguagacagagguggcagaucaucugcuuuuaaauauagagggcucccauucugcuaggauccagagggaaugaggguccuauguuacagaugucccucugccugcacaaaaggcugaagaacaagccaucauggagugugggagauccagcuguuguccauuuccagaagaggagugaauaguggcuuaacagagaggacccuugccugguucucuuuggaaauuucacaguagugaggccaggugcgguggcucauaccuguaauucuggcacucugggaggcugaggcagguggaucacuugaggucaggaguucaagacuagccuggccaacauggucaaaccccgucucuacuaaaaauacaaaaauuagccgggcgugguggcgugcacuuguaagcccagcuacuagggaggcugaggcaagagaauugcuugaacccaggaggcagagguugcagugagccaagauugugccacugcacuccagccugggcaacacagcgagacucugucucaaacuaacaaacaaaaaauuucacagucguuaugaacagauaauaugcucagguauuagccauuucauugcauuguuuugacaagugacaggaauuagguuugcuaauguuggaagaaaaaucucacuuguugcuuuuaacuuaaaccuuuuaugguuuugagauagguuuauucacugggcuggagaaugaaggauuuaucuguauuagucggauuugaucaguuuucaaguagcuacucagugucaggccuauacauuaucucguuuaacucucuuaacaccaugguaagguugacuguaucauaaucuccauuuaucagauaaggaaacaaagauucagagaagucaccaaguugagaucauugcccagcugcacacagcuagugaguggugaagcugagacacaaaucagggcuuccgacgccacuuucuauuacacuuuacuaugcugugcauucguguaaaagcaugauauuuuuaaaguggcauuccagcugccagaaggauaucaaaucaaguacuaaagacaauauuauuagaaauggaaaucuggacucaccaagaaaugucuucaguucuauauaauaggaagacugguauuuugcuugauauggguguuucaauaucaucugcuccuaaaaugcagucuagacaccucuugugaccugcucaggugauacuaaugaaguuugggucauuuuuagcaucuacagagaacagaguaagagugcuguguguucaauacuauugcagacuuaugggauaaacuggauuuucuugcuuuacuuuauaaagcuaaugccugauuacaaauauaaguuuaaaacaaaccucaaaauuucuuggcacccacucuuugugguugguaacauggacaucuguauaaaauacccaagaccuucauagagcaaaagugagugggaaauuaauuuuuauuggguauauaaucaucacuagccauguucaaauacuuuuucucuaaauccuuuacaaagaucuuguaaguuggguauuauuacauucaguuuagacuaaacgaaaugcaaaaaaaaaaaauaauaaagaaaauagacucacaagguaaaguugcauacuugagacauaacaaaauuaaauuucauucuaugaugcugccacauagcagaugauacaagcaguauagaauacccauaaacauuauguuuuaagguauuuccaccuguaucuuucuuggggcagguaaaugaaacucacuauaaaccaguuacagguccuccuuuaucugagguuuugcuuucugaaguuucaguuaccugcagucaaccauggucuaaaaauauuaaaugaaaaauuccagaaauaaacaguuuauuacguuuuaaaauggauguccuucugaguugugugaugaaaucucaugccauccugcuccaucccuccagggaugugagucaucccuuugucuaguguauccaugcugucugcccuuagucagccuucuugguugucagauugauugguacaauggacacaagguauuaccgugcuugugucuaaguaaccuguguuuuacuauuauuacagucuauuguuauaguuucuauuuuaauauaaguuauuguugguaaucucuuacugugcuuagcugauaaauuaaacuuuauuauagauaucuaucuauaucuaucacagauauaucuauagauacguaccugcgauauguaucuauaugcgauauguauagauacauaucacagguauguaucuauagauacaucgguauauauaugaaaaaacaguacauauaggguuugguacuaaccacaguuucaggcauccacuggguggggaugcgggucuuaaaacacaacccuuguggauaagagaggacuacuauauggaaagucagaguuagagagcuuuuguagguuauguaguucaaucuuuuguuuugcugguaaggagaagaauacaccuuaauuuugacuucuuaacucgaaaaguuaagaaacuugucuaaggucacagagcuaguggcagagcaagccaagcaucagugucuccaaaauccagcucaguguuguuuguguuauaucagaaugaguaagaguuaagauaagaacaugagucuuacagcuccacuauccauguucaaauucuugcugaaugauuggggaaacuuacccaaccucucuggaccucagguuauucacaaguaauacgaauauaacaguauuugauagagccaauuaaaugaguuaauauuugcaaaaugcugaaaucagugcuugccccauaaugaauacucaauagguauuuagauauuuuuauucuuaucuuuccucccaagcccaaccuaguguagaaacuucuggaaugguugaauugaaggagaaauaguauaaacaguauaaaaagguaaacuuuuuaaaaagagaaucaugaaguagugcuucuacagagauugggggauggcaaacaacccauggaguaaauucacaagacuugacacuuaagaauccaagagggcugcaugagaugaguccagguaggccucguagacaaaucuuagauggaguuaacucaggaagccaaggaguaugagccaguagucauccugagcaaggauaauaauuuuucuuucugccugccuucuugccuucuugucuccuugccuaccuuccuuccuuucuuccagcuuucccucccucuuuuccuuccuucccuaucuccaucccucccuuccuuuccuaccucccucccuucuuucuucuucccuuuccuccuucuuuccuuccuucauuucuuccuucuuuccuuucuuccucccucucuccuacccuucuuccuugcuuccuuccucccucccuccccucccuuccuuccuuuuccuuccuuccuuuccuucccuccuucuuccucccucucucccuccuucccuacuucccucccuccuacuuucuucuguuuccucuuuccuuccucucuucuucuuuccucccucucuuccuucccucccucccaccuuccucccuuuccucuuccuuccucuuucuuccuucuuuccuuccucccucccaucuccuuccuuccuuccuucuuucuuuccuucauuccucccucccucccuuccuuuuuucucuaccucccucccuccuuccuucuuccuuuuccuccuucuuuccuuuccuuucuccuuccuucccucccucccuuccugccuuccacccuuccuaccuuccugccuuccugccugacuuccuuucuucccucccccuuccuucuuucuugccuuccugccuugcagucaccgaauguuuuuugagugacuaugaugugccaagacccgguauaagggugcacgaaauaaagucucuacccucaggagcuuacuuccuagugggggagacagauuauaaacaaagacacaaauagguaauauacuauuauguggugaaaaaugcuacgaagggaaagucacagggagcauuuuuguuugguuuuuuuuuguuguuuuauauagaauggucacaggugccucucugaggagcccuuggagcagacaccugaaugaagugaagccacaugccuggagaacaaauauucagacugagauaagagugaacacacaccugcagugagagagagagagaguugggugugauuugcagaccuguaggaaggccagugugguugggcagagggagcagggaauguaggcaggggccagaucacccaguauuuguaaacugaggcauggacugaaugauagggcggcuucauucauccaccaaaccacgugcugaguaaucuaccccaauuccaaagcaugaacuugacaacugcuucuucauaguaauagaugaaggauaaaaaaauuuaaaaagcauauagaugagccaacuuuuaugugcuuaaagugaaaacaaucaugucuauaagacaaaagaaggaaagacauuugacaugcuccauguaccugagauucaucucguguuaauaaaauguugaacauauuacacuauuggccgguguuuaguuucagcugaggaacuaauuccuaaagcugcagccugggggauggggagauaggguggacacugagacagggcauggaggaauucagaugguauuuaccccagaaauauuuacugaaauugggaaugcugagucaagccuagccaugcuagagggccuugggaaggcaguuacuagaaucuccuugauuuuuuuccaauuucagaagaagcaacaagaagaaagugucuugacuaauccuucuagugaaagauauucacuuuuauaauaaggugcuugucuacacagagguuucugagucaaaggaggagaacguacaaaauagaccgaaagaagagccugccuagcugcucuuuuucuuuuguaauuaccaagaucccgacgguuuauacccacucaacugcaggugcugggagaggagaggcuacugugacaaaaauuauauaaagaagagcccagcagaugcauuuccagauaaacaauguaaaacauagucuauguaagugccauaaaauuucacuaauaaaaaacacacauggcucagggaaacauuuauuaucaaaauggaagcaggaaagggcauaugcuaagucuuauucauuucaauaaauagcagaacgugaauugauaaaaguucuuaauugaaaaacaguugcucauuuguaguuugauauuuaaaagcuuucuaaacauguauuuauuuuguuuugccuugaaguaauuagcuauuagacuaacuauuuucuuuucaugucagguacacaguggcuccaaagucaaaacaagguuagauuggaaggaagcaaacaaugaaauugaagggaaauaucgacacuucucaaucaaugaaaaugcaucagcauguaugagcaucuuuagcuggcaauaauacaucagaaauaaauaauguuagcaaaagagacagcaucauuggcuauucauaguauguauucacgguuguacaauaaaauucuaaaggcugagguugaaagugaauaaaaauuauuaguucuaaacacuugaaaauuccagcagcuuagacauauuuuuguaugcuuucagugccccaaauguaaaacuuaaaucauuuuaugaaaaaaccuuguucaaucuuuuaagaaauuugcauuucauugcaaagauggaacauagcauccuuggcugaguuauuuucuauagaagucagugccauuuugugguauaugauuagcacauucuaaaggcaaagauuccagaacguuuaaauuuaguugugaaaaacugaaggcauuuauccauucauauauaagcaugaaaaugcaagcuucacuuucucaguauguuuaaaugccacauauuauaaugggaauucuagaagaugugaucaucaaacucugauuucacgcuuagaaaucaaauaaaaaagagacuggccuauaauuagaaaauuagucaagucagaucuaauaucaacacaugguugucacagaacaaaaaauuuuugcuuugagaaaaaugagauaucauucuggaugaauauucugggucaguagaaaauagggaaucaaaguauagaaauaaaguguuuaugucacuguaaaacuucuaguuuucuaaaauaaaauuuaaauaucugaaauagcaguuuauacuucauacucauacagucaauagacauugguagcuuaagaaagaacuugguaagugaugauuuaaagagugauauagauucaguaguauucaauauacaguuguaauugaugagcucaucaaacuauggaauuugggauauuuacauaauauuuacauuauauaauaugggagagauagcaaguaucuauaaagaguuuaaauucccauacuaggaaauguauaguuuguuuuaaucuaugucuacauuuaaaguagauuuuuuuuucagagacagcauauaguuggguauugcuuuuuaaauuuuuaaaucuaaucuuugucuuuuaaauuauauuuaacguaguuguugauaugguugaauuuaugucuauuaccuugcuacuuguuuucuauuuaucccauuuauucuuguuuuuuucccucaaugucugccuucuuuuggauuauuuguuuuaguauuccauuuuauuuccauuagugguuuauuaguuauaccuccuuuuaaauuuauuuaccuaauuuuaguuggugccacaaggcuuaaaguauaaaucuguaguuuauuuuuggaggaucuuugccccacagauuccagucuuaccaugcuauuuauuuuuuagcgauuugauuacgcucuggucaauaugugauuaugugcaaacugugugugugugcguguguguguuuaucuugcuugagguuuguugaauuucuuggaucugugggcuuagaguacucacauaaaacuuaaaauaaauuucuauauucuuuuuucugguauacugucuaugcacucuuaauucauauagucauguuuuuaugucagauauuccauuuuuugucuuuaaauaauauaccaauuaauguauaacgugauccuuacaauaguuauacuucuauuuccccauuuuuccugcuauugugauaauacauuuuacuucuauauaugacaaaaaaccccaugauauacauaacaguguauauaauaauaacauauuuuugcuuuaaauagcuaagucuuuuaaauaaauuuuuaaaacgagggccgggcgcgguggcucacaccuguaaucccagcauuuugggaggccgagacaggcagaucaugaggucaggagauugagaacauccuggcuaacacggugaaacccaucucuacuaaaaaugcaaaaaauuagccaggcgugguggcgggcgccuguagucccagcuacucgggaggcugaggcaggagaauggcgugaacccgggaggcggagcuugcagugagcugagauugcgccacugcacucuagccugggcaacagagcgagacucugucucaaaaaaaagaaauuuuuuuuuaaaugagaaaaaguauuuuauauuuauccauaaauuuaccacuuacaucacuucauuucuuuguguagaccugaguuuuuaugugguaucauuuucuauuuuuuaauuaauuaauuuuuuuuugagauggagucucgcucugucgcccaggcuggagugcaguggcgcaaucuuggcucacugcaacccccgccucccggguucaagcaauucuccugccucagccucccaagaagcugggacuacaggugcaugccaccaugcccagcuaauuuuuuuuuuguauuuuuaguagagacgggguuucaccauguuagccaggauggucucgaucuccugaacucgugauccacccgccucggccucccaaagugcugggauuacaggcgugagccacugcgcccagcuaucuuucucugguuuucauaguuuauggcaagaaaccugcagaauuucuuaccuuuguuacuuugugaagugucuuuuuucucuggaugcuuuuagauuuuuuuuuuuuagcaauuuaauuaugcugugguuaauauguguaauuauguguaagcugcauauguguguaugugugugcgugcgcuuaucuugcuugagguuuguugaauuucuuggaucuguggguuuguagucacaccaaauuuacauaauuugguagccauuauuucuugagauauuaucccccauccauuuuuuaauguguccuuuuuucccccaaauauacauguuagacugcuugauauuauuccacaggucacuuaggcucugcuaauuuuuucacuacucuuuuuuucuacauacuucauuuuggaugauucucuuacuaugucuucaaguucaugggcuuuuucuuuuaauccaaauggucacauuuucaugucagauauucuuaauccaaauagucacguuuucaugucagauauucuguuuuauuuuugucuguagaaaucacauuugggcuuuaaaaaauauccucaauuucucuccucauuucauguuuuccuuuaaauacuugcaaauagguuuuuuuguuuguuuguuuguuuugagacggagucucgcucugucccccaggcuggagugcaguggcgcaaucucggcucacugcaagcuccgccucccagguacccgccauucuccuaccucagccucccgaguagcugggacuacaggcacccgccaccacgcccagcuaauuuuucauuuucguauuuuuaguagagacgggguuucaccguguuagccaggauggucuagaucuccugaccucgugaucugcccgccucggccucccgaagugcugggauuacaggugugagccaccgcgcccggccgcacauagguauuuuaacauucuuguaugcuaguuccauuaucucugucauuucugaaucuauuucuauuuaaugcuuuuuuccuccucauaauaugucacauuuucuuguaucuugucuaguaauuuuugauagaaugcugaagauuauaaaugccaggucaucuggauuuugacuuccuuaaaaaauauuaauuuugguuuuggcaggaagccaaacaaaaauccagaucuaaaguccaaguuucuagauauuugccccucagcuucuagccugagccucuccaaacuccagucucugucuucugagucagccaggaaguaaauccaagcuguuuuggguuacccuucccucugcuuauggaccauaaauugccuccuggaagaaaccuggggcaauuguagaaaucacuuuuuuugucuucuuccucucagagaucacagcccuaagcugccuacaaucugauguuugaaaacagcugcaccauauauuuuguucaguuaaauuuuuuuuuuuuaggccaggcaugguggcucauaucuguaaucccagcacuuugggaggcugaggagggaggacugcuugagcucaggaguuugagaccagccuaggcaacauagugagacucugucucuacuaaaaauaaaaaaaauuagcugggcaugguggcacaugccuguggucccagcuacucaggagccaucucaccgcagccucgaauuccuggccucaagcgauccucccaccucagccuccuaaagugcugggauuacaggcaaacaccacuaugcccggcuauuguucaguuuuuuuuucuuuuguuuuuuguuguuugcuuuugcuuuuuugaggcagagucucacucugucgcccaggcuggagugcaauggcacgaugucagcucacugcaacauccgccuccuggguucaagggauucugcugccucagccucccgaguagcugcaacuacaggcgcauaccaccacgccuggcucauuuuuguauuuuuaguggagacgggguuucaccauguuggccaggcuggucucaaacuccugaccucaggugacccacccgccuuggccucccaaagugcugggauuacaggcgugagccacugugcccagcauauuguucaguuuuuaaugggagguuagggacaaauuuugauacuccauuaacagcccaaagccuauuucccaaaucuguuuuagauacccuuagaugaaauaauucuuacagaaaccaugagaccuuaaaugauuaaucauaauuaucaaagaaaacuccugagcaguuaaugucaaauguaauaugauguaaguaaguugauugauaauauucgugucuuguuaaaagaggcuacuuuagucugcugagauacugaacggauuuuccuaagggaaggaguaucugauaugaaauaccaguuaaucaucagucaccaaccauuaauuaaauggcuacuuuauaaaggacauuaaacugagcgcuagauggaguauguuguugcagucauuucauagaaaagucuacagggguaauuauaagaaaaagaaauuggguauuucaaagaucuagucacugauauaaguggaaugugauaucaaaugugaaucaauacuuuaaaauaauuuuuauuaaaugcuuauuagauacagaagaaugcuauaaaaauauauguaaacuuaaaaguagugcuucugaaacuuuaaugugcaaacaaaucaccugagaucuuguuaagaugcagauucugauucaggagucugggguggggccuaccucuguaguucuaaaaaaaaaaaauccaggugaggacaauguuucugcucugcagacuaucuuuggaguagcaagaguaagagaagugaaacuacaaugaucaucugugugcccaccacugguguaagaaaaauaacuuuauuuuuaucucuaaugucuucuggguacccccuccugaucccuucccucccucuuagaaaugacuacuucccucccucuuagaaaugacuacucucuugaauuuuguuuuuaucauccuuuugcuuuucuuaaaaguuuuaacacauuugcuugucacuucaauauauauuguuaggguuugcauauuuuugaaugcaugaaccuaauauaaauggaaucauuugcauauauccuucuucaauuuuucauaccacauuauguuccugagguuaauucauaucauuguaaucauaguuuguauaaacuuaauuuauuuucaucacuguauggaauucuauuguaugaauauacauaauucauuuuaccguuguugaauuuugaaauuuagguuuuauacugccaugaaaauucuugcauaaguuccuggugcacacaugcaacacuuagucagauuauauacauaggugaugaauugcuggcucauaagguauacacauuuuaaacuuuaguagauuaugccaaauuguuuucuagagugguuauauugacuuguucugccaccaacuguguguacaaauguucugguuguuccucaucuguauuaguuuuauauugcugcacagcaaauugucacaaauuuacuggcuuaaaacaauauccacauauuagaucauagcucuauaggucagaaauccaggugggccuggauggguucucuacuuggggucucaccagucuaaaaucaaaguuucagcugggcugacucuuaucuagaggcgcuguggaaaaaucugcuuccaggcuuuuucaggcuguuggaaacauucaguuauuggcaguuacagacugaagccccuuuuccugcugucuguuagcugcuaaggaccacucucagcuccuggaggccacucucagauccuugucccauagcccccuccacuuaucaauggagacccuccuuugcaucaaauuccucucaugcuuaaaaucucucugaguuggauaaaagucaauauauaaagagcuaaugugauuagauuaagcauauccaggcaaucucccuuuugucauauaaugcaccauagucacaagaauaauuccagcgauuaaaguuaugagggucaucuauagaauucugccuacucuaguuuacugauagccagacuggccccaugauucacuacuguuucauagguaaaauauauucaccacuucccaagguuccuagugcuuugauuccauuacagcaucaguucaaagucuaaaaucucaauaaaucaucugaauaaucuaaaccagauggaauauaaaaaggagucagcaauccaaagcaguguugaaauccaguggagcaaaacugguugggaaaacuccacugaguuucaaggccugggaauaauucucuuuagcucucagcuccucccucuccacuuuugguuucacccucugagucaacuuucuuuuuucauaaagaguagaugaauaguuuuaucucccugcuucucgcaguagaauuugagcagauguaagagucucuuuucauuuuauacucucucugucccuuuugguccagcugguaguauuucugcugauacaauuuucucaagaacuuucuggaucuccuguggauaucacagugauucacugcaucauacagaacacaugcugacaagucuuuugagauaaucccuucucuauuuuuggcuucuacugaaaugguugagggacagaacccuuaagcccagagguccucugguuuaacugagaagaucugugagaaacacccuuaaucuccuggaaggguaguuugugugguaaaauacucuggccuuuugauauuucugaguuuucaacaaagaacuguauaguauacacucagacuuuucuuuaugccacuguuuuagcagccauuuaugacuuuuagcauccuuuugccaucuggagaggcugugaauuuucuaaauuaucuacucugguuucuguuuaaaaguucuucccucaauuuaucucucuccuuucacaauuuacuauaagcaacaaggagaaaucaggcuguagcuuuaacaccuuucuuggaaaucuccuuagcuauauauuaaaguucauuguuuacaaauucugcuuuccacauaacugcaagaugcaacuuugcuagcuauuuggccacuacauaacaagacucucccuuccugcauuucuaauaauauguuucucacuucuuucuuaguccgcacugacagcauucucaaagcccagauuuuuuuaaccuauuuccuuauauuuuaauggguuuucuguggcucaugguggcucaugccuguaauaccagcacuuuaggaggcugagucaggaggacugcuugaacccaggaguuuaagaccagccugggcaacauagugagaccccaacacugcaaaaaauuaaaaaaauuagcugggcaugguggugugugccuauagucucagcuaccugggaggcugagguagaaggauugcuugagcuugggaggucaaggcugcagugaacuaugauugugccacuguacuucaaccugggugacaaagugagacugucucaaucaaucaaugaauagauaaacaaaaaaugaauggaaguucuuguagacaaauauaugugguuuggcuuuuauuuauccaauaugacaagcccuaaauuuuauuuuauuuauuauuuuauuuugagacagucucacucuguugcccagguuggaaugcaguggugacaucguggcucacugcagccucaaccucuugggcucaaguggucuucccaccucagcuuccuaaauagcuggaacuacaguuauguaccacugcuccuggcuaauuaaaaaauuuuuuuuugcagagaagagaucuugcuauauugaccauacugaagccuugcuuuuuaagaugauauuuagaucauuuacauuuaauguaauuaucaauauuuuuaguuuaguuucccaacuuucuaugucuuuuuauccaauuuauuuucucuucuuuuccuuauuccugcguuuuuugauaaguauuuuuaugauuacauuuuauuuuucaggauuggauuauuaguuacacauuuuuguuuuauuauuuuuagugguugcucuaggguuuacauuauucaucuuaacaaauaacacccuacuucaaauaauauaauaauauauauuauuucacauauaguauaaaacucauaacuuccauuuuccucuuuuauccuuugaaugauacuauugucuuucauuuuacuucuaagauguuguaaaccucucaacaaauuguuuacauauuuucuuuagacauucaauuaucuuuuaaaaucuuuaaaaauaaguaagaaaacaugucucauauuuaucuacacuuuuaacauuuccagugcuccucauuucuuuguguaaaucccaauuucuauguagugucauuuguacugccugaagaauucccucuaauguuucauuuagcacagaucugccaucaauucauguucucugcuuuuguuugucugaaaaagccuuuuuuccuucagcucugagauauuuuuugcugguuauagaauucagaguugacaguucuuuuuucuuuuagcacuuuaaaaugcuauuccauuguuuuuuggcuuacuuauuuuuaacaagaaguuuguaauaauucuuuuguuguucuguguauaauauuucuauuuuuuuggcuguaugaaagauuuucucuuuaucuuugguuuuaagcaauuugucuaugauaugucaaacaguguuuuuaaaauauuaauucugcuugguguucucuguggucuguuaucuuuauuaauuuuagaaauucucagucauuaccuguucaggcauuucuucugugcauuucucucucuuuccuuuuucuacauguuaaaccaggugauauuuuaccacagcuuguggaugcucugcucuuguuuuucucauuuuuugucucuuuguauuuuaguuuagauaauuuuuauugucuuaucuucaaguccucugacauauucuucuucuguguucaagcugauaaugagcccaucaaaggaauucuucaucucugauauauucuuccuucauagcauucccauuggacuuuuaaugacuuucucucuacugaaauuucccaacuuuuaauguuuguuguguaucucuucuacuggaucuuuuguuuuguuuuguuuuuggagacagggucuugcucugucacccagccuggagugcagugauauaaucaugggucacugcagccuugaccuaccaggcucaagcuauccuuccacuucagccucuugaauagcugggacuacagguguguaucaccacaccuggauuuuuauuuuauuuuauuuuuguagagacagggccuuguuauguugcacagacuguucuugaucuccugggcucaagugauccuccugccuuggccuccgaaagugcuuagauuauaggcaugagccaccauggcuggcugaccuuuuaagacuagagucauaguuauuuugaagcccaugucuaauauuuuuaccugggccauucuuaaguauaauuuuuuugauguuuuuauccuuugaaaugaguaauuuuguucuugcuuuuugggcuguaucauauuuuuuauugaauuccagaauugguauaaaaguauaguagaaugcgauuuaaauaguauuuucauuaaaaauggauacacauguuuuugugucaaguaaacauucagaaucuuaaagaaaaauugauuaauuuauucucagaaaugugauauauagcauacaagauaagaaguuugagcaauaaauaggucaaaauugugcugaugaacuucauuaaaauuuuaacuucauuaaaaauuaaaauuuuaacuuccuuaaaaauuaaaaauaaaauauguaauucaggaacauauauuucuaaaguaucccauuauacugaauauuuuagaguaacaguuacaaugguauguacauggcaaguaaaacagauuuugaccuuuucuugcaauaguagcaaaauaauaacaacaacaacauaaaaaaucauaaugguaaaguagcuuauuuacaaagugaccaggaguaacauuuuauacccacucucacauguaaagugauaagugguacagaaaauguauucagugggaaaugugggagaggguacuccagagauagcagggaguuauaauggucuaggucuggacaaucacagcaucauaucccuggauuauaaugauugauuugggaccggucacagaacucaaacaaagacuauuagcucuaacaagagcuguuuugggacccuuugcaguuagaacuaaaguuguaaaaagauaagacuagauugacuuggugccauuaugucaccccaaagggugagccugaauuaaaacagccaaaacacagaaaaauggagugauggacagcaauaaguuucugauaauauuauuuaagucuuuggauugagcuaugccuaaagaucuuuuucaguuauaagaaccagcaaaugauuuuuuccuauuuuuaaauguaauuuaauuauuuaucuauguuuaaaucaacagauaaaauuguauguauuuauugcaugcaacaugauguuuugaagcauguauacauugugaaaugacuaaguauaauuaacaugugcauuaucucacaguuauuuuuguggugagaacacuuuacuuauacuuucagcauuuuauaagaauacaauauauuaacuauagucaccacguuguacaagggaucucuuaaacuuauuccuccuaucuaacugaaaauuuguuaucuuuugaucaacaucuccccaauucccuccuugcaaucaccuuauccccuaguaaucaccauucuacucucuacuucuaugagaucaacuuuuuuagauuccauauggugagaucaugcaguauuuaucuuucugugccuuucuuaauucacuuaacauaauguccuugagguuuauccaugcuguugcaaaugacaggauuucccuuauuuuuuuauggacaaauaguacuccauuguguauauguaacauuuuucuuauccauucauccaugaugaacacuuagguugauuccauaucuuggugauugugaauacugcugcaaugaacaccaaagugcagauaucuguuuuagaugcugauuuuauuuccuuuggauauuaucucaguggugggauuauuagaucacaugguacuuauauuuuuaauuuuuugagaaaccuccauacuguuuuccauggcuguauuaauuuacauucucuccaacaguguacaggguucucuuuucuccaaauccucacuaacacuugcuaucuuuugucuuuuugauaauagccauucuaacagguaugaagugauaucuccuuaugguuuugauuugaauuucccugaugauuagugauguugagcaccuuuucauauacuucuuggccauuuuguauauguucuuuggagaaaugucaauucagauccuuugccuauuuuuaaauuggggcuuugcuguguuuuuguuuugcuauugaguuaacugaauuccuuauauguuuuggaauauuaacuccuuaucagauguauaguuugcaaauauuuucucacacucuguagguugucuuuucacucuguugauuuuuuccuuugauuugcagcugcuuuguaguuugauauaaucccaguuaucuaucuugccuuuguugccugggcuuuugguucauguuaaaaaaaauaauugccuagaccaaugucauggagcuuucuccuauguuuucuucuagaaguuucauaguuuugggucuaacauuuauggcuuucauccauuuugaguugauuuuuauauaugguaggagauaaggauccaauuucauucuucugcauuuggauauccaguuuucccaacaccauuuauugaagagacuguccuuuccucagugugccuucuugguaccuuugugaaaaaucagcugacuguaaauguguuaauuuauuucuguguacuuuauuuuguuccauugguuuacgugucuauuuuuaugccaguaccaggcuguuuugguuacuguuauuuuguaguauauuuugaaaucagguaguaugauggcuccaaauuuguuugcuuguuuguuuugcucaugauugcuuugucuauuugggaccuuuuuugauuucauaucaauuuuaggauuguuuuuucuguuucugugaagaaugagccaggcacgguggcuugcuccuguagucccagcacuuugggaggccaaggugggaggaucauuugaacccaggauuuugaaaaauuagcugggugcaauggcauguagcugucauucaggcugcucgggaggcugaggcaggaggauccuuugagcccaggaguucaagacagcagugagcuaugauugugccacugcauugcagccuaggugacaaaacaagaccccaucucuuaagaaaggaagaaggaaagaaagaaagaaagagaaagaaagagaaagaaggaaaagaaggaaagaaaauaaaaaaaagaaaggagggagggaggaaggagacagagaaaggaagaaagaaagaaagaaaaagaaagaaaaacagaaagaaaaagaaagaaagucauugguauuuugguagagauugcauugaauguauagauugcuuuggauaauguggacauuuuaacaauauuaauucuuccaauccaugugcaugagaucucuuucuauuugugucuucuucaauuucuuucaucaguguuuuaugguuuuuggugcagagaucuuuuaccuccuugguuaaauuuauuucuaaauauuuuuuguagcuauuguaauuaggauuauuuuccuaauuuccucuucagauagcuugcuuuuuggguacggaaacgcuacugauuuuuuuuuucccaacaaaugauuuuuaacuuagacaaauuuacacuggguuuuaucuccuuucaaaaaaaugaggcugauggaaaauucaagagucaauguuuuuuuucuaagagagaaacagaaaaauaaauaaccuggcauuaggguguaguauggccuggagaaaagagaugcuggagaucagcacagcagcaagagucaggaugauaaagagagagagagagagaaaaaaaaaaaaacacuaaguaaccaaagauaaaguacugagugggaaaauauuacuuccaauaagggaaucugauccagcacaaagucugggcucuggaggaaagaggcaugagaaagaaaaauauaggauagcucuuuuuaagucaaagacaugaacuguuuacuccaaauuagggcagugaagaccugaguugcagacugucuggugauaucuugccuuucuguuagguaagcacuaggguggcugagcugagcugcugcaaaugugacauaaccgguuugggacuauggugugcaccugcuugcgcuauaugcauggcaugacccaauugagauuauggugucuuuaguuggcuuguccuaguggcagcaggugagguauccagaucugcaccugaaccgagguauuugaauaagugauagaggagcaauucaaaaggcuuuucugaaaguaagucagugagacugguugugugauggaugagggaccucaggaagagagaggaguaaauacugaugccaaggaugcuagcuuggacucuggaugaacacugacaugugugacuuugaguuuaacaauugcuaaacugugaucaaaauuaugggaggcauuacacugaaaggcaaaacucaaagaaaacucuaauauaguauuaguugaaaaguaaauggggguaccaugaagauaacuaaagccauauuugguauacauuuaaaaugcuagaauauguccuuuggaugugcuguuugcauauaggguacacagaaggggacuuuuaucuuguuagguuuuauuucagauauauaauggcucuuuuuguucccagugaauuugggauguucuauguguugcuuaauaguaaaauauuuaaauguuaaauuauuaguaugcaauauguguuaguauaaaucaaguacuuucauugaaucucugaagauaaauacaaccauguaauguuuaauuuugacugucuugcaaacgaccugaacaucaauuaacaaucuaauaauaauaguaacuaacaguuuuucaugcucaggcacuauucuaagugcuacacaaucugguaaccuauuuaauguucacaacuacccuacgaagcagguacaauuaguucucccauuuacugaugaggaaaccaaaucacugggaaguuaacuugcugaagucgcauagcuaguaaauaguagaaaccaauauuagauucuaggcagucugauuccagcgcuuaaacucaaacacucaucuuuacuggcuacauguuguauauucacauacacacacacaaaauuuaacaaaacacuuauaaacaaaguacugugagaucuauagauaagaacauccagucuugcuguuaggaaauguggcugggaaaauagaauauuuauaugaaaaagauaauaauagaagacaguguguaggaagugacagauggauggcacagacaaaucacucugcagagguuguagagaauggggcagggguagguuacaggacagauggucuuaaacugauggauaggaccuaccuguaccaucugguuccugcccaccucucuaaacuuaucuuccugacauucaccaaauucuagccacacggaccuucuuuguguuccucaaaaugccacacucuuuucugucccacggcuuuuacaauuguugugucuucugccuggaagacucuuucuuuaaaucuuggcaaggcugccuccuuuauuauucagaagucagaucauugugcccucugauaugguuuggcucucuguucccaugcaaaucucaucucaaauuuuaaucccacauguccagggagggaccuguaauccccaugugucaagggagggaggugauuggauccugggggugauuucccucaugcuguucuugugauagugaguucuccugagaucugaugguuuuauaaguguuuggaaguucuuucuucacucuucucugugcugcugccuugugaggaaggugccugcuuccccuucgccuucugcuaugauuguaaguuuccugagguuuccccagccaugcagaacugugagucaauuaaacgucuuuccuuuauaaauuacccagucucagguaguaucuuuuagcagugugagaauggacuacuacacccuccuuaaugagaacuuccuuggugacccaaacugaaauacugcuucacuccuaccccaguccacuagccuguuugauuucauucaugacacuuuccuuaccugaaauuaucuacuugcuaaccugcuuauggucuguuucucuucacuagaaugaaagcuccacgagcaaggaucuaugaugccugucuuguucucaucuuuuuuauuuuuucccucaaguaguuucugaaguuucuaccucaucuacacaaucuuucugggcuuuaaaggcuaugagggaaugucccucuuugacuuguuuugaagccuugggccuacuuauuuguauauaagagaauauuuuuaaaugguucucuucuuuauauauuuaaagcaugaaaugcucugaauaucaaugaacccaaucacauuuggguaauagaaaaggcuguuuucuucauaguugauucuuuuuuuaaaaauuuaauuucuuauuuauuuauuuugagagagagucucauuccauugcccaggcugaagugcaguggcaugaucucagcucacugaaaccuccaccucccagguuccagcgauucauacaccucagccuccugaguagcugguauuacagcugcacgccaccaugccuggcuaauuuuuuguauuuuuaguagugaugggguuucgcuauguuggccaggcuggucuccaauuccuggccucaagugauccgcccgccuuggccucccaaagugcugggauuacaggccugagccacugugcccagccuguaguugguucuuuugaaauguuccucuccuuuaugggccaagcugauagcauuugcuuuacccucuccauuucguauauuuaucagccaucaaaggcuuuucuuauugcuuggaacuuaauugaaugauguuuuuguuucuuuaccaacaaaugaacacaagcggcuuucgaaaauacuccaaaaaacagugagcuguaggcaagauuuuauucuucaugugugauauauuuugguaauuaaggagucaauucuuuggcuaaaugcugaaagaaaaaugaugauuauuguguaggauaaagcugugaauuauagaauacuuucaacucuguuuaaaaucuaauuaacauuaauuguuacauuaauuuucccugugaaauuuacuaacuguauacaaaaugauauuuaaucuuccuaauggaggucuaguguauucguuucaguccuauucguaggaauaugaguugaaauggcaaaguuauaguuauguugaaaguaaugaaguaauuuuuauauaaaacuaauuuauuaacuaucacauuguaauuaauuaaaacacucuuacuuuuacacaauguuccuguuuuuaaaguacuuuugugugugugugauauacauaucuauauguacauauauguggauucccacagcgucguaugauacaagcagaaccauuaauuauuauuuauccccauacuuauguauaauggaguuuccaugagguuuaaaaacuuccccuguaacauaaggauaguggaucaugaaguucauaauuugugaccuuauuaaguucuaauuacuagggauacuucuuguuuuaguuugcuagggcugccauaacaaagcaucaagauuuagugguuaggccaggugcgguggcucaugccuguaauuccagcacuuugggaggcugaggcagguggaucaccugaggucaagagcucaauaccagccuggcccaacauggugaaaccccgucucuacuaaaaauacaaaaauuaguugggcaugguggugcgugccuguaaucucagcuacucggaaggcugaggcaggagagaaucgcuugaacccaggaggcggagguugcagugagccaagaucguaccacugcacuccauccuggguaaaagauugaguggcuuaagugauagaaguuucuuuucucacaguuuuggggguuagaagucuaaggucaaggugucggcagggcugacugcuucuaaagccucucuccuugguuugcagacggcugccuucucccuguguuuucacacggacuucccucugagcauguuuaugucccaauuuccucuuucuuauaaggacaccagucguguuggauuagggccuacccuaaugaccucgcuuuugcuuaaucaccucuuugaagaucccaucuccaaauacagucacauucugagguacuggagauuaggacuucaauuuauguauuguuggaggauaaaauucaaccauaacgcuuguguaaauugugaagaaaacaguaauuaauguauagcuuguuuuaaauuuucugagugaaugaguuaaagaggcuauaugaaauaguaagugcuauuuuagccaagaaaauuaugucucagcacaugugguuuguguuucaaaaauauuucuugaguaaaaugucugauuuaucuaauauuuuuaauaaugcuauaaccuuuacuauuuugauaaugguaguacuacccgacauauauugagucuuaccauguaccagacuguuuuaaacauaugcccuguauuaacauauuuaauuauuacaagcaaccuauggaauacuauuauugcccuaauuuuaaaaauauggaagcuggccaggcauggugguucacgccuguaaucccagcacuuugggaggccaaggcagauggaucaccugaggucaggaguucaagaccagccuagccaacauggugaaaccccaucucuacuaaaaaaaauuuaaaaaauuaaaaaaaagagaguaaacucuguguaagaacgcuaaaugacuugucaaagguucuacggcaauuaaguagcagaauuggaaugaaacccagguucucaggcucuggaacuuuugauuagcaggccagugguucucaauggguggacucuaguuucuggcuaagauggaguaagaggaaaagauuuaccauccaauguagaacaacuaaaaaauguaucuaaauauguaaaacaauggauuguaagacauuggacuucauggaaugaaaggcagugaucccugcgaggaaccauauaguugccccacuuuauaaucgagagaaagaguucccaggcuugaugcucaggaaggugauaccugaccccugcagccugcaguuggaacacagcacugagaguccagggagaccaaugcaaucagaguacagggaagaggacaagaguacucugcacagggagcgagaaagagcuucacagacagucagaggguucccuugaaucaucagaggaaaacagauuaguauauacaugugcagaaacuagccauggcuggggaaagaacuaccgaaggacuagagggaacaauugcuggaacucaucuggggcuggaauaguuccuguccccaaaucauaacucaugggacauuggguagaauauucagaagaauuuugacucgguggggaaaaauuagcccuacacuaaauuaugcuaguuccaccuuaccaagcuuaaaagaaagaccugaaagggucaaacuguuuccaaguugaagaggaaagggaauaaacauucacgaauuacugucaucaucgugaagggacucuggaugugaaucaguagcuacacaagaaccuucagugucucugagcaugggaagaugaaaagauuugcuuuucaugcaaggaauuuaaauuuccaaugucauauauaugaggacaaaauacauuagugucugaguguucccagcacuucuccucuucaccccacugaaaagagucuauccacccagauucuuccccuccacagcucuucagagaggguucugcuggccagauugguucagaaagaagguauuaagaauuaccagcugggugugguggcucacaccuguaaucccagcacuuugggaggucgaggcagguggaucacgaggucaggagauccagaccauccugguuaacauggugaaaccccaucucuacuagaaauacaaaaauuagcugggcaugguggugggcgccuguagucccagcuacuugggaggcugaggcaggagaauggcaugaacccgggaggcggagcuugcagugagccaagaucccaccacugcacuccagccugggugacagagcgagacucuaucucaaaaaaaaaaaaaaaaaaaaaaaaaaaaagaauuaccaugugaaugaugaacacuucccaguguuuguugauaacugaaguaaagaccuugagauaguguuggaauuacuguuugguugcuggguaguauuuguuuaccucucacacuacuuucagaugggcuauguuagucauagcuuuaaccagauuauagauuuacugauuggauagauguuuacuaaaaauuaagugagcaaaugcaaggacuagaacaacauagacaauauauucugauuuuuauuuaaaagaaauaugcaaaaaacacuauaaaauuuuaccccaaauauacccaucaguauaccaaaaguguaccauguaugcuaacagccauauaaaauuacuaaaaggauauauaccaagcuauugguaaaagguuaucucuuucacuggggaccaggauugggcagguagaaggcaguaggaacauagcaaggagauccuuucacuuuguauuccguauauugaugaguugcuugaguuaaauaaaacaagaauuauaauuugucauuaaaaaacuaaauauuaaaaauuaccaucuucccaguguuugcaauuuuuuuuuuuuuuuuuuugagacaagucuugcugucaccaggcuggagugcaguggcgugaucuuggcucacugcacucucugccuccuggguucaagcgguucuccugccucagcuucccaaguagcugggacuacaggugugcccaguuaauuuuuuguauuuuuaguagagaugggguuucaccauguuggccaggauggucucgaucucuugaccucgugaucugccugccucggccucucaaagugcuggaauuacaggcaugagccaccgcgccuggcccaggcuucaaaauuuuuaaacauuuaacuggaauaguaaguaaccaacaagcacuuagaaagugccuaguguuuaugauuccugccaccucagagagcuacauuuguguucaaucuucggacacuuaaauguuuucaauguauguaaauaauuauuguuaagauuuuccuaauuucuuuguuaaaaugguucauuucaagguucuuuagagcuugcauuuauuucauuuuuugucauguuucuuuucucuuagaauaaaaaccagcagucauuuuaauuaccccugauaauguucaugaauacugccuuggccugucuucugguuuggaaccuuuucaagggcgaauggauauuugucugguguuccauguauaaccuguccuugugccacuuuuccaauguggcaggaagggaacaacugucaucuguucugagaauucagcacugugucuggcacugugggaauuuacccagacugcuuugggggaagacaucugacacuucaugauaauuguaauuaaccagaaagacacuggaauuggaggauuugaagggaaauaugacaagggauuaagacuuugagauuacuuuuggagccagggugacuuaagcacauuuaaaaaguuagguuuacuuauauauuauuauuauauucuaaaccauaagacauuuucuaauaagguuucuaagaggaacauguaaaccuggaucaaauuuaaauaagguuacugaaaauauuaaugaaaccaaugacugagcauuuuauaaaugagaacuguauugcuuuaaguuggagaaaagcugcaaguaagacaacauauuucuucauuugaaagcuuguguccuuauaugagggacauugacaaaugaguggugauaaaaugguggucuaugugccauaagggcuuagguacauaaauuaauguuuuauuaaccauaaaaauaagguuaaaagguugaaauguagccuucaugugucuauguaaaaaagaggcagaaaaaaauccucagcacucuagagaagcuuagucucugagcaaucacugcauauacuaauauauucacauauaaucuagaaugaauguuaaauaacaaaaaucauguucguuuuuauauuuugcuuugccuuugggauacgaagugauggaacgagcucguuaacacugcucauuucugguuagaagaacacuagaaccaccuaguggauuuuucauuuauugcaugaucccuacacuuuacuauugcuaaauuguuaauugcugagauaggccuuaaaguaaaaucagugguuauaaucucuuugugggucauaauagaaauaguaauuguuaaucuucagcagacaaagcugucccuaaguccuugaagggaagucccugcccaccaaauacuuaccaacuagcacacugcugcaucuagaaaagcacaggcagaguuaaacauuuggcugcugagauacaccgugcaacuggagcuuuaaauuuccugugaaagucagugagcaagguaaacugcagcaauucaucugcauucauggcagagucaacuuucggugagcaagacuagggaacucugcagagcacagccaaggggcuacauuagcagcuugaccuuuguauucaauauaaaucugugggcacacaaacuggcguuucuaaucaauuuuguuuuuggagcaaaguagcuuaugugguuacagcgugcccuggucauucuguuucccauugcugaaccaacugggucuccgcaucuugguggugaugacagauguuacguauauuacauugggauuugggucagauaaauagcaaauauucugggaaaggauacuuuauguuuuugcaaaagguuauaaaauaccaaacuuuaguaaacccugauucuaggccaaagguuaacucuuuauaucuaugauuuauuagguaucaaaagaaaaaagucaggaucuaaggggaauggaaaaguuucugcuauucuaaccuaagagcugguugucuucuccuaguaaacuaacuguucagcagaugggaugcaucgggcuacaagguuggugcuuuccagccggcaccgcgugugaagggcaugugguugggcugggcucuccaagucugcauggcuuggguugacuauaaccaggggaaacacgcaguggcuacaacugcuucuccuaacaauucucguuucauucucuucucccacagugugaaggaggcuagguggauauucucuggggcuugaaauuucacacugcaaauuuuacgagagugaugaucucuuccuaacucuuuagaagccaagauaggaaaaauuucaguuuacaagaauaaagcccaaucccucuucuuauguuggaauguccaguaaaaugcuaagaaacggguggguagaagaagaggaaaggaagaagagaaacagagaggagaguaaggaaaaaauagaaaaggcagaaaaaaauaauguacaugaacaacaacaaaaauagugacaaacagaauggacuauagagauaggggaggguagugaagggcuucagagaagucaggugaagggccuucuuuucuuuucuuuuucuuuuuccuuuuuuuuuuuuuuuuuuugagauggaguuuugcucugucauccaggcuggagugcaguggcauaaucucagcucacugcaaccucucccuccggguucaagcaauucucuugccucagccuccugaguagcugggauuacaggugcccaccaccaugccuggcuaauuuuuguacuuuuaguagagacgggguuucaccauguuggccaggcuggucuagaacuccuggccucaagugauccuccugccuuggccucccaaagugcugggauuacaggcaugagccaccgugcucggccagggccuucuuuuuuaaagaaaauuuuauuaugcugugauaagaacacaacaugaggucuacccucuuaaaaauugugugcauaauacaauacuguuaacuagaggcacagguuguacagcagaucccuagaauuuauucaucuugcauaacugaaacuucaccccuguugauuagcaauuucccauccuugcaccccaguccuugguaaccaccauuuauucuacucucgcauuaugugaaauggacuauucuagauaccuccucaaagugcaaucuugcaguauuuguucuucugugacuggcuuauuucacuuagcauaaugucaucaaguuucauuccuauuauauaugucaacauuuucuucuuuuuaaaggcugaggcugaguaauauuccgcugugugugugugugugugcgcgcgugcauguguguguguauauaauauuccaauuuacguauucauccauugaugaacauuuugguuauuuccacaucuuguuuuuuuugaauagugcugcagugaacagugggauacuaauauuucugagauccugauuuuaguuuuuuguguuuauuuuuuuugagacagggucucgcucuguugcccgggcuggagugguggcgccaucucggcucacugcugccucaaucuccugggcucaagugaucuucccacgucagucuccugaguagcugggaguauagaccaccaugcucagcuaauuuuuguuuauuuuuuguagagacgaggucucacuauguugcccaggaugaucucaaacucuuagacugaagcgauccuccugucucagccuccuaaagugcugggaauauaggcaugagccaccaugccaggccccaguuucaguuauuuuagauaaauaccgaaaagugggauuguuggaucaucugguaguucuauguuuucaauauuuuuaauuuuucccagcuuuuuugagguauaauugacaaaaauuguauauauuugagguauacuaugugauaauuuaaguugugaaaugauuaccacaauccaguuaauugacacaucugucaucucacauaauuaccauuuguguguguguggugagaacauacaauaucuacuuucugagcaaauuucaagcaugcaguaugguauuauuaaccguaauuaucaugcuguacuaauauuggaucccuagaacuuaauucaucuuacaacagaaaguuuacauccuuugcucaacaucuauuucuccuaccucuggaucucugguaaccaauuucuacucucuguuucuaagaguucaacuuuuuuagauuucacauauaaguagaaucagacaguauuuaucuuucuucauuuggcuuauuucuuuuagcaugauguccuucagauucauccauguuguugcaaauggcaggauuuucuucuuuuuuuaaagacugaauaagauuuucuuuuuaugcauacauauugucuuuauccauucaccugugauggacacuuagguuguuuccauaccuugacuauuacgaauaaugcugcaaugaccauggggauacagauauuucuucaagauacuuauuuacuuuccuuuggauauagacccagaagugggauugauuuuauuauauagcaguguuguucuucacuuuuugaagaacugccauacuauuuuccauagcaacagcaccauuuugcauucccacaaacaguaugcaaggguuccaaugucuccacaacuucaccaacacuuuucucuuuuccucggagcuuuuugucuguuaaaccccagcuucccccagccugaagcauaguugacaaagauuguauauauuuacagcguacaacaugguguuuugauauaugcauacauuguaaaaugauucaaucaagcuaauuaacauagccgacacuucauguacuuaucucucuuuuuuuuuuugugaugagaacauuggcuuuuugauagccauccuaauagaugugaggugauaucucauugugguuuugauuuacaguuuccugauuaggugauguugagcaucuuuucacauucauguuggccauuuguaugucuucuuuggaaaaaugucuuuucaggucuugagccccgauuuaauuagguuauuaguauuuuugcucuugaguuuuaagaguuccuuguauauuucagaaauuaaccccuucuccauuacauaguuugcaaauguuuucucccauucuaugguaguuuuuuucauucuguuguuuccuuugcucacagaagcguuuuagucugauguagucccauuugcguauuuaugcuuuugucgcugugcucuuggugucauaucuaugaaauccuugccaagaucaaugucaugaagauuuucccuuaugcuuucucccagugguuucacaguuucaagucuuacauuuaaguuuuuaaucuacuuggcauugauuuuuguguacaguguaagauauggauccaaauucauucuuuugcaguuggagagccaguuuucucaacacuauuuguuaaagaaaccaucuuuugcccauuguauauucuuggcacccuugucaaagaucaauugaucauauauacgugggucuauuucugggcuccugauucuguucuauuggucuauagucugucuuuaugccaauaccaaagugauuuaauuaugguugcucuguaaugcauuuugaaaucaggaagugugaugccucuagcuuuguucuuucucaaaauuauuccggcuacucaggggcuuuuguauuuccauauaaauuuuagaauuguuuugccuauuucuauaaaaaaugccaucgagauuuuaauaggaauugcacugaaucuauagauuacuuucgguaguguggauacuuccacaauaauaagucuugcaauccaugaaccaggaugaagggcuucuauauauagggcaucaguucucaagauuggcugcugggcuucucagagcccaugaagauaauaaugagacacuguuaguuaauuuuaauauuuuaaaguuugauauucuaucuuuuaacguuuacaggaauuugaaauuguauauuuauguguguaccuauuuguuucauggcucuaugaaggcaggaccaugucucuuuuacucaccacagaacaacuagcaccacuguugugcaguagagccugaugguuagagcugcacgcaugggcagaccucccgguuugccauccugcugcgaccacugacuaccaauggcacauauaccaccaauuggcuaggcuaacaaacauuccaagccccauuuugccuuguugccuuccauuauagaggcuuguacaagaaaaaaaacccuacauuuuacuuucccacucucaugcugcugggggauggucaaaggacacagacuuggccaaugagggguuagcagaaagcuggcgaaggauucuggaaaggcuuugaauuccugcugaaaaggaaaaaugcaguugacagaugacacuacccucucucuucuuaacuuaaacguggaugugaugcuuggauauagguccgccauucugugcuucugagggaaagagucagucaauucucagagggagcagcucuaacaccguggagccauggaaugaacacuaggaacaaaugaccucccagcugauuguuauaugagagaaauaaauguccauuuguuucagccacuguacauagggcuuucuguucuuuuucagcaaaacgcuccuauuacagcaguuuugugacuucaagcaaguuacuuuacucuguuuuaauguucccauuuaaaaacagggauuauaccaauaucguccucauaggguuguuugaaagacuaaaugagauaauauacguaaagagcacagaguaagcacuagauagggauaaauuacuauuuuuauuacuauuuugaugaugggcucuuaauaagucuuagaugaauaaguggaguaggucaaacccaaaggguauggcuucaacccaaggcaacccaaggcaacccaagauaacucauuuuuuucuguuugagaaaaaugagaaaggguggagaaaugagaggaagguggggugcggggaaggaggcagggcuaaaguggagccaggugggugcugggugggggggaaaaugcccuaugaaaaucucccauggugaauggucaauguguuggggccaacauauuggccaugugugguccaggcaugccaguaucaacagacacuaaauaaacauuuuuuuuuuuuggcucauugaauaaaugaaugcauugugaggguguucauuaacaaagaaauugccaucucauccuuaaaacugaagagauagaagugagagggcagaagguuuuucuccagugucacucgcacaccuauuauaauauuugccuggaauuaugugggugaagaugcauugcucaauaauugccugugcccucgcaaggagcagaggagaacauccggugggagcagaagcagaggcagaaagaacagauuucccacggaguaaaauauucuguucucauaaaaagucccuugcuguaacaaacgagaaaaugaaaaggagagccuguagaagagaggcagacaccucuuaauaggcacaucucuccaaaguuucccaccaggggccaacuguucauuaaacagggaacaaaugcgggagcguagcugugaugggcuccauuccacagcccagugcugggacugcagugcgcuaggaagggcgucgcuguuguugcuguggcccggugugacagcaggucuggcaugucagaaucgcccugcacaaauagcuccugugcagcugcucucacccaaaccugcucugaggaggcucagugcauucuaauccuuccuaaaaacauggacagaaagcaauggaaaguugacauguauaaaagguuuagucaugggguuuuuaaguggaugccuccaugaaaggaucaacucagauggccacguuucugaacauuauuuacaucaaaaccugacauaaaugccucagaucuagcuauuuucuuccucuauccucuuuuuacaugucuccuuuucccucucgauugcuuuagcuuguaaccugcaugcgcuuucaaaugugguaagcaaauagaaagcaagacgccauuugaauagugaauggacuuguauuccuguuuaggaauguguaguugcccuugggcuuucucaguuauaagacucauaaaauaaaaccuuaacacagauggaacacacacacacacacgcacaugcaccacuuaaagcagaugugagucaaaaacauaugcugaugaacucaauuugcugauggcauucugagcagugagcccacucaguagggcugaaggguuggcauagcaacucuuccugggaaaaaauagacagcuggaauaaaccaugacgaugaaagucuucuuccaaugacugaagaaguagagagaaauugccaucucuucuaaccccuucaagcaaagcaccuugguugagguuuauagacuaggaucuuacaaauuagaaguucauguauuuuccuaggucagauucuauaccuuggguuauauuccagcuaagaaacacuuucagauaggcugcauggggcuguggggaaagagagagcacaaaccuccaaaaagcauggagcuuugaccaaaguuuauuucuguaacuuauccuaaggcuaugccgagugaagacuuguuuacucuagcuguaacuuacuccaucacauagcaccauuacuuugagaaauuaacauauucauucucaauuauuuaucaaguauccagcacuagcaauagggacacagucccugcuuuugagggauucaugacuaggcagacagcacccugaguauauuaauuaagaucugaucccauauuagaauaauaugcacaagagacuuauuaccucugucuccucauuccuauaaacauuuaucugggaccuaucuuauguggacugugcuaggugcaaugccaagggauaaagcaaguuaaauggcaacaguccuauucgacaggccagggacucaggaucagacucaggacccuuucccucuuguugcaaauccugcuaugugugggcucagccccaaacugucucugaaaucucagaaaugagcaaaggcuaaggaugucaaauuggcuuugagauaugccuguagacugauaacaauagugaugaugacgaugauauuaguuaauacaauaaagcuaauacugugcuauuauuaccaggcacuguucuaaguacuuuaaauaacuuauuucauauacucuucugucauuuaguaugcauaccauuauucuccuucccauuauccauaugaggaaagcaaggcacugaguuaaaacgacucaccuuuaacuguucaucuaucagguaagcuaaccccggagccuacauaaauucuuaacuauuaaauaagcuaugccacuucucaaccacucugcugaaaacuauacaaacugacagguccuacaauuaaaacccaaaauagauauaauaaagcauaaaaaaucaguuaggaauuuucucuugcuuuugcucugcuguuauuguuguucuccagauaagucccauuuuaaaauccacagucaccuuaaggaugugaugugggagcuggagcugucugccuacccaccagcuauuuuuaaaggaagaugaucaggaacuaguuaugaaagaaucagauuguuuaaucugguaccacagaacuugagaaacuauagacuugguaaguuggaaaauauguaggcagaagugaugucucuauggaaacagaugugaagauucaaguaaauacuaggccuguuggacuuuuuaugaagauagcagaagcuuuuuuccccacuucuucuucuauaaccuguuuauugaggaaucugaccauggugaggaacaagcuagagacauauuuuuaucucuagucacugcuuccaacucugcuaugucgaaucucccaacucuucuagacaucucucaaugacaucuuggacaggaaccauagucacuuacagucuaguccagccuuauagcauaugcaacugcauauccaguucaagauuuuccauugcuccauugauggcuacacuuauuacucaaggaucuacugugggugugcuuagggguaacucuuucaccuuggagaguggugugggaauguucuuguucuaguauacuucaucccaaagacccaauuccuccuguuuuggggacugggagagaagaugagauggcuuaaugucucuuggcuuucucuauugcuuuugcugucucucuagcauacccuagcgaccacugagacucuuguggggcagagauccacacguuaucuaucuuagggacaugauggguucuucgaagucccucaugagaggcgugacucuggcucaaacauguucagcccccuucagcuguccaagcccccccacccucuaucagcucuaacuacacugcuugcauuuuucuuuccuggugggcugcuuuacuggcauguggaggagugcugauauagcaggaagaguuuugcuacuucuuauuaaguccugaaaagguaucuggugggugcuguguuuguaauaagauacuuagcaccuguuuccccucgagcuuugggccuagguaucaguucucagacaaaaggaaaagucaauuuuuauacccuauuauaaugauaaacuuugauugaaacuuuggggauaagaaagcaucgagauguuucucucuccuucuauuccucuuuucuccucccucccucucucccuccuuccuuugcucccuucuuuccuuccuuucuuucuuccaaauagcaaccauguaaucuaaauuaugaaugauaaaaaagccuggcaaaucaaugagagaacuuagagcaaaggaauuuggaauauuauaagauagggaacaauuuuaguuuccugagcauuuugguuguauuaccaccugcuccaaucauagacuguacuuuuucaugcccagaaaagacuucuacaacccagccuucauagcaaucagccacucgggacuuucuugcagucugagcucaaccugucuuauuuugcucugaguuuuccaguucugaaggcuugauuacugguccaagagugucauuuagguagauaugcugaacucacaucauccucguuacaaauuguuauggaaaaucccaaaaauauaaaagaaaaaaauuuuaaaaacuagcuaagggcacuguucacaugcugcaagaucucacggaggagaagauggaaugaguggaggauacacuugcuguguguucaucauugaagaagggaaagagcuugugaaaugaccccuagcagaaacucacuggugcuuucaaguucaggguggcaggguugaaggugagaguuagcuucagggaagaugguggagaagaauguuugcuaguaucuggaccccaaaggauuacacaggaugcuggagccugcaugggcuaggaauaccauuaguucaaucauggucuacacuuggcaaggaagaugcauugagaauaggugaagggcauagucaagaccaaugcuaacugucauuccuuauggaggaauuauggaaucuacuucaggcugccaugaaaagcaaagcagagaaucuguugggacaacucguucagcagccucagacuacagcugcaucuuuacuuaucuaggccucuagaucacucagaaguaaaggaaaauuuaaacaaaucuaaacauucucauucuuucacuggggucuucaaaguuuugaacacaaucucucagaagaaucaauuucugauaccugaaucuuuguaagcacgaacagagagaagggacuggacagaugaaaaggauuuguaguucaaagaagagggccauuguggggaacugaugcugagcucucgguucuaugccccccagacuuccuucuucaguuacggucccugcagaaucagcauccaucugcgacucuccuuuauucauugaacuccuuguuuuggagaggagaggcauauuuucuacuuuauguagcucuccagcccaugaucuccuguggucaggggcuaaggauuccuuucccuguuuccuaguaaugcauaacucuaucucuccauaaggcagggugggccaggcauucagaaaguuggggaagcuaggcagaaugugaaauaagugaagggaauugaagggugcuggaaaaccucccaucaaaauuuccucccccauguuauuccaccauuagguaauuagcucccugguucuuaaaggauuacaucacuuuucuuuguuaagaguugagucaucuaugcaaaaaaaaaaaaacaaacaaaaaacccaaaaacugagugaauuaaaaccagaauccuuauuaguuauuaccucaggagcuuuaacagugucccacuucaauuagagcaaagcucacugggaauguguguaggauaaagaagauguuggagguaauagacauuaaggaaggggccaggagcguggagggaacccaagagacgugggaggaucucaaaagugaucuuugccuauugccaacugugacugaggcccuggcccaucauuugauguucucugucauucuugggagaggcagaggagugugaugauuaagagcauggacucuaaagcuagacuucuggguucauaaaggguaacagcuuagcucugccccuuccuaccuuggggacuuugagcaaauaauuuaaccgcucugugcuuuuuucuucauuuauaaaacaggaguaauauuggucccugccucaaaggguuguugugaggauuaaaggaguuaacacacauaaaauacuuagaagagcacauggcauagaguaaaugcuaguuguuauuaguaugcuuucaauuucacaaagggacuuaaaaggucagaacccuuacuuacuccuaggaaccacuggggaaggagugaggaccaacauauauugcauauguaugccccagauacuguauauaaaauaucucauugaaaccucacauauugaugaaauagguauuacaauaucccuauuuugcaggugagaaaacugugucucagagggugagaaucuggcccaagguaauacagcuaaaaagugguaaaguuaucuaugauaucccacaauguuacuuacacaguucucuuuggaaauaaaaauauaaacaaaugguacaggcagauuaagaacaacuccagcauuauuauuauuauuauuauuauuauuuuuuuuugagacagggucucacucuguugcccagauuggagugcaguagugcgaucauggcucacuguagccuuagccucccugggaucaggugacccucccacuuucaaguagcuaggacuacaggugugagcuuuuguuuuuuuuuuuuuuuuuuuuuaauagaaacaggguuucaccauauugcccaggcuggucuugaaguccuggccucaagugauccacccaccucggccucucaaagagcugggauuacaggcuccagcaucaaauguuuacaguaguuguccucacagaaaaugcauacauaacucuuaucuuccugacucaaugcucaccuucaccucccacccugacugcagccuauuaucccugcagucaguggacuuuuaauccagauaccuuggcugagcaggcucauagaggaaacuggcccacagaaacugugagaaauaaauguauguuguuugaagcugcuaaauuugugguaauuuguuauacagccauaaaaacgaaaagaccaaacagucauauccugaaugauuaaaaauugguugcauaaguaaaagaauguauuugaguuggaagauuugggguuuucacaugaaaaaccaagugugaguaaaauaaccgcagaauagcuauuuuggaauucugauacucaaacacuugcuaguugaaggagugcuaagauuauggauauaacaauugauucuaggguuucaaaacuuauuucccauaacauaggaaagcugaaacucuggcuauaaagaaaaggcuauuuuucuuucucuugaaauaauuuguacuauucauugcacugucaauagccaagaacaugcuagaaauuacaacgugcucgcacauauggguauuucugcuaugaugcaacauauauguuucuaaaauucauuuuguuuugcaaaaucaaccaauagaaaaacaaaggacuuauaagaaaaauaggguuggggcacaauagucacaaacugucaguaacacaaaacaaaaagauaaaaucuaaucaaauugugguagcacagucuuacacaagucaaauggguaagaaauauguaaauacuacaaaaauaagacacuuuccuuugacaaagacuuuacauuugcuuguggaagugggagucagagcauugcagcuugugaguuuuugugaaauuguggaaggaaggugauuugaaaucaagggaaaguuguaucacugauguggauggauauggcccauguugagggugguggacugagguagcugacauguuucagguacgugcaugucuguuuuguacaucuuaccuggcuggguucaggugugugcaauuuucuguguuucccuaguguuuuucauagacuaaacagugcauaagcaaccccaaauucguguuaugcucaaaauguucucuaauaaaaucuugugucuugaaaacaaguguuaaaaaguaaaacugaccagauguuauuucauuugaaucuuacgauaaaagcaauaaauagacaugaggaaacagcuuuagacauagagcuaguaaacagucaaggcagauugaacugaggucuuccuccucugugcuuuucccauuaggccacuccaggaaugucucagucuagcauauuuuaaaucugugugaugcuauaguuucacuacugcaauuucuaagacuuuauauuuucaauuagacauuuauuuuacuaccaagaaguauccugauccagagguacuauucucccagccauggagaguuccuccaaaagacaaaauucuaucuuugcuaaugaaaaugcaaauaaaacuguaucaagaguuucaugauuuuacuagguauuucccaucauauguuuaucauacagcucaaaauugaugucaaguuuuuuacucuacucuuuucucaaguucauucacuauaaauugaauuucauuuuucugcacuuggguuguauuuuuugaaccacugacuuugcuuauauuaguuuuacuaugauauucaucaauuuguuuaaaaaaauucagaagauaccucuugcacaaauucauuuuauaauuuaagaacucacuucagaauguugagacucuguuaaguaucaauucuaggauuaugaagauccugucuaccacaaagagccccacaaaggucuuuucucccucauucccaagcaguuuaacuuaaugaauucuucugguagaacuuuguuuagacggacuuaaagcagguaagaguucuuuuuaaaauacuuguggagugcaugagugugcaaacaaacuuaaaagcacauauuggcucaggaaagcugaggggaaaugauaauuuucaacaguccaaaauagccauccuggggcuuacagaaaguaagguagcaauuagccuaacucuaagccuaacaauaacacagucauuaauccugggugcccagacacauuccauuagaggauuuuggcaacaaaauuuugcuuuucuaauucugaguagauauaaacaauaaucccuuaauuuauuagucuguuuaucacacuuauuaagcauuuccuaugucuuaagaacugugccacaagacaaggaugcccucucuuaccacuccuauucaacauaauaugggaaguagacauaaacaauaauuccuuaauuuauuagucuguuuaucacauuuauuaagcauuuccuauguccuaagaacugugccacaagacaaggaugcccucucuuaccacuccuauucaacauaauauuggaaguucuggacagggcaaucaggcaagaggaagaaauaaagcgcauccaaacaggaagagaggaagucaaacuaccuuuguuugcagaugacaugacuguauaucuagaaaaccucauaaucucaguccaaaagcuucuuaagcugauaaacaacuucagcaaagucucaggauacgaaaucaaugugcaaaaaucacuagcauuccuauacaccaacaacagucaagcugagagccaaaucaugaacucucauucacgacugccacaaaaagaauaaaauaccuaggaauacagcuauguaggguggugaaagaugucuauaaggagaacuacagacuuacaaaucacugcccaaagaaaucagagaugauacaaacaaagggaaaaacaauccaugcucauggauaggaagaaucaauauuguuaaaguggccauacuguccaaagcaauuuauagacucaauacuauuccuaucaaacuaccauugacacucacagaacuagaaaaaaacuauuuuaaaauucauauggagccaaaaaaagaaaaaaauccagaauagccaacacaaucuuaggcaaaaagaacaaagcuggaggcaccaugcuacccaauuucaaacuauacuacagggcuacaguaaccaaaacagcaugguagugacacaaaaacagacacagagaccaauggaacagaacagagaauccagaaauaagacugcacaccuacaacuaucugaucuucgacaaaccugacaaaaacaaacaauggggaaaggauucccuauucaauaaauggugcugggauaacuggcuagucauauguagaauauugaaacuggaucccuuccuuacacgauauacaaaaacuaacucaagaugaauuaaauacuuaaaugugaaaucaaaaacuacaaaaacccuggaagacaaccuaggcaauaccauucaggacauaggcaugggcaaagauuucaugaugaagaugucaaaagcaauugcaacaaaagcaaaaauugacaaauggggacaauuuaagcuaaagagcuuaugcacagcaaaagaaacuaucaacagaguaaacagauaauuuacauaaugguagaaaauugugcaaaguaugcaucugacaaacgucuaauauccagcaucuauaaggaacuuaaacaaauuuacaagaaaaauacaaacaacuccauaaaaagugggcaaaggacaugaacagauacuuuucaaaagaagacauauauguggccaacaaucacaugaaaaaagcucaacaucacugaucauuaaagaaauucaaaucaaagccacaauaagauaccaucuuacaccagucugacucuuacuauaaaguuaaaaaauaacagaugcuggugagguuguggagaaaaaggaacacuuauacaccguuggugugaguauaaacuaguucagccauuguggaagacacuguggccauuccucaaagaccuaaagacagaaauaccacucaacccagcaaucccacuacugguuauauacccaaaggaauauaaaucauucuauuauaaagacacgugcacguugcauguguauguucauugcagcacuauucauaauagcaaagacauggaaucaaccuaaaugcccaugaaugacagacuggauaaagaaaaugugguacauauacaccauggaauauuaugcagccauauaaaagaaugagaucauguccuuugcagggacauggauggagcuggaggccauuaucauuagaaaacuaacacaggaacggaaaagcaaauaccucauguucucauuuauaagugggaacugaacgaugagaacacauggacacaacacacacuggggccuuucggagggcagaggaugggaggagggagaagaucaugaaaaauaacuuaauggguauuaggcuuaauacuugggugaugaaauaaucuguaugauaacccccaugacagagguuuaccuauguaacaaacucgcacuuguaccccugaguguaaaauaaaauaaaauaaaaagaacugggugccagauguugaaggaaaauaguaagaucuuaagaaaauggcuuuggccgggagcaguggcucaugccuguaaucccagcacuuugagaggccgaggugggcggaucaggaggucaggcgaucuagaccauccuggcuaacacgaugaaacaccgucucuauuaaaaauacaaaaaauuagccuggcgugguggcaggcaccuguaguuccagcuacucgggaggcugaggcaggagaauggugugaaccugggagguagagcuugcagugagcugagaucacgccacugcacucuagccugggugacagagcaagacuccaucucaaaccaaaaaacaaaaaacaaacaaaaaaacacagcuucaaguuuguagaucuauggucauucagucuaugacacugaacacuuccuuuaguagcucacuuguugaauaacaucuagaauuaaauaggagaaaaaauuuuccuaauagaacuauaccaggcuuuacaugauugguagucuucguucuucacaaaccaguuuauuuuaauagauaucucagguagaguuuuaugaaggccucaaagcaauuaaaacuucauuugcaggaaggacaaucuuauacuuaccagaaaacuacagcuaacaugaauuucuuuguuagacauuugcuaugaaggaucuuugagaaaauucuguguuagaacccaugacaccccuaacauagcuaugccauuauuuuuuucuucuuaaaugaacagaugaguuuuguaagcaaaguaggauaccaugauugauagaccuuuuuguaaaguauacucagauuugcugaaagagccuacauaauucagucugggugcaguggcucaugccuguaaucccagcacuuugggagacugagguggguggaucacuugagaucagaaguucgagaccagccuagccagcauggcgaaacccugccucuacuaaaaauacaaaaauuaaccaggcgugguggcacaugccuguaauuucagcuacuugggaggcugagguaggagacuugcuugaagccgggagguggagguugcagugagccgagaucaugccacugcacuccagccugggugacagagugaggcuuucccucucucaaacaaacaaacaaacaaaaaaaacaaaaaagaaggagauuacauaacucaagaaaaccauacucgaagccucucuuuuuaaauaauuuuuaucucaaauaagggaaaaaucaaaauggaaagagguuaugaucaguuucaccauuggccuacaguauugcuucagagaacaaaauaaaaggguucuugccucuccccuugcuggaacugggccugccccagggacuuggcuguaggguugcagguacuuucccuguccuuugaucuuaaucaccaagggagcaauuaaaguuccauguccaggaaucacuuaguaaagagucuugcuuuuaguuagagaguugaagggguugugggcaauaucuaaauaugcuuuggacauuguauuugaugggguugagaaauaaaaaaaaaauucuaggcuccuaacuaacugaauggauuccccucuuggccaagggugaaacugccuuugcaaaauuauuacacaaagagaaaucuaacauaguugacuccaucuugcuucugacuuccaagcuguccuuggucauuccuggguguaggccaagcucacuuugggaggaauuuaguuuauaguuuuaccuuaaaacaaagaugauaauagcccuucucaaaacuaaaucaccuuuguaaaacuaauggaaaggcacaagguuaaaauuaugagagaggcccgaauucugauaggauaggcauaguuuuuaucagcccuuacagaucaggaaucaugugaccagaggucacaagauuugugaccuucccauuuacuccuauaguuaacauugcuauguuagaacccaagauuguauuuugugggggauguuuuccagacugauccuaccugaacuugugauucaugacucaauugauccuauggccucacccagagguagacucagcauacgaagacuguuuuccauaccaguaugauuccaucccuaaccaaucaguggcacccauucccuagcccccugcccaccaaauuguccacaaaaacccuaagcuccaagccuucagggagacugauuugaaugauaacuccaguucucccacgugaguuagcuuuauaucaaaugaacucuuucuccacugcaauacuguggucucagaggauugaucuggucugugcaguguacagugcugggugauuaccagagaaacucgggaagcugaguucauggccuuggcgggaugggagguugaacuagucucacuaguauguaaucacuugucucacugcuguccccuccccaccuuuuuuaaaggaaaauguacaaauaguaaacuuccugagacccucuuuggaaaaaacagccauagaugcaucugugacuuauguuuuuccuggacaugcccucaagcuggcucgauaaaccuugaugacugagauuuaugacucagucacucauuuugauugucacaguauaaagggccugcuauggucugcauguuugugucucuccaaaauucacauguugaaaucuaaucucaaaugugugggcauucagagguggggcauuuacaaagugaugaggucaugaggguggagcccuugugaauggaauuaauauccuucuaaaagaggcccaagggagcuuguuugccccuucugucauguggggacacauaguaggcaccaucuacaaggaaggguccucccccagacacggaaacuacuguuggugcccugaccuuauuaauuaugauugagacaaucaaauauggucuggcuaagagaagaauaguccauaacauuuugaugcugacucccuaaagucuauguuuugaaauauugaauauuuaacaugaagagcaaauuacaauuaggacgucuuagguccauacaaaguaauauucuauggacugccuuuggaauuacuagguuuggucuugggaucagauugaaugaacucaguauagauucugugucacuucuacucaugaaacacauuuacugaugguuaaucuaagaguaucuuuaggcuagguacagugccucacaccuguaaucccagcacuuugggaggccaagacaggcagagcaccugaggucaggaguucaaaccagccuggccaacauggugaaaccccaucucuacuaaaaauacagaaauuagcuggauguaguagagggcaccuguaaucccagcuacucaggaggcugaggcaggagaaucauuugaacccgggaggcagagguugcagugaacugagauugcgccacugcaguccagccuggguaacagagugagacuccaucucaaaacaaaaaaaguauuuuuauauauggcaacauguugcuauauaguuaugaaauaaaguguugacaaaacuugacugaauguaaucauagugaagccaacguuaugugucauaugucaccugugccuguuuugucacaagugcucuuuacaaaccacuuagcaucuucacuuugagguuguaugcucuuauuuaaugcuccauagaguuuugagauuguugugaguuuucuauucaacauuggcuucuccaaagauuugaucauuuuuuaaaacagcuguaaaccuauucaaaauuuauauaacauauauuuaaaauauaaggacgcuuucugauuucaaaugcaucucaugcaguuaauaaaauugguaauugguaauuuagagucacagauaacucuaaguaagucaauuaaaacuguguaagaauuugaaaagaggauacagggcauugaggggauugacauuugguggccaagucauuauagcuauuguuuggaagaaucugaugauauucaaaugaucaaagcaaguauuuugaagaaauaaaugaugugaaauaacugauaaagagauacuuuaaacugacauuauccuacacuuaaauauaauaaaaauacacaguaauaaagcaaaauaacagauuuguuguuuggcuacaacaucaagucauucucaacuacauauuuugacaauagugacucuaaauauuuucucaaacuaagcuuuccuaaauauuuucccaaaccaagcuguuucuuuacggacuuuauaugcauuaauuuuauaugaaugacuauuuuucuaacauaaaaacaaucuuuacaaauauuuugagaauucaggaauaaaacuaaagcauucaaaugaccacugcucaguuguacuugagagauuuugcccaaaauuauuuaaaaguguugaacuguagaaggccuuaaaauagaacuuguagaauuucaauauucagaaaguaaaguuuguuacuaugggucauacuguugugaaaaagcagaaaaagaauucagaauaaucaaauugaaacuauuuugcugauauaaucaaauaugccugauguuuguugugguuuuaaagacuguauuuucucuuuggacauuucuccaucuuucuuuuuuuuuuugguguaaaauauacacaacauaaacuuucccuuuuuaacuacuuuuaagugcacaguucuguggcauuaaguacaucuacacuguuaugcaaccaucaccaucauccaucucuggcacuuuuucacuauucccaguugaaacuguacccauuaaacaccaacuuccuauuuuucccuuccucagcagucaccauucuacuuucugucucuguagauugacuacucuagguaccuuguacaaauggaaucauauaauauuuguccuuuugugacuggccuauuucucuauuguuuuacuaacauaaaaguauuuuaucuguuauuaauuuuaucuagucagaaacuggaaacacugacagaaucuuuggcugauuaauuacacuacaauugacaaaauacugcccaaacauaagugauuuacuaaaauaugggacaugauguuuaaaauuaaaaaccugaugaaacuguagugucagucucaauugcaguuguaauauuuuuccuauagccaaugauuaaaaugugcauuuguuagugauuuuaaauuaauuuauauuaaauuuacuauuuucccaucuaaagcagaauuaauuggucauuuuuuuggcacaugaauuaaaacauauauacacugucuuugguuugcuaaaagaaugaaugaaugauauaaaggcaucucauguagaaagauuuguucuuguuaauuagcagguuuauuagaauaugguuucuuucaucugaauuuuggagauuggaaaaacaaucuccaaaauauaaagaaugcagagaagugcaggagaagagagaaugguaagcuaaaaauuaccaucaaaugcuaagugucagaccuacacaaacacaaaauuuaacauacuuaacaguggcauguucagugaauaugagcaggagacaugagcucaaaucuaaugauaucuaugaugccagaaacuuuguauaugcugaauuuaauccuuaugacaacucucugagucauauaauuuccccauuuuugcagaugucaaaacugaagguaagaaacgguaagaaauuugccuagucucaacacuagucagugucagagccagaauuccaauucaugucuacauuuccaaagcccauguuguucccaugacacaaaauuguagcaugccuuacacuuauugacuugggagaguuuuuuuucuuaaaaauauaguaucaauauaauuuuagcaaaucuuacugccauuagaaauugguaacauuuauuugaggauagacuucaaaaucuuuaugagacauaagaaaaugaaguuccagaauaacaggaauuugaaugguaguuuucaccuuucagaggaugguuuuuugggggugguaagaaacaucuaaguauugguucucauuugggggcaugcuuagaggcaucaguaguuucugguaaaguaagggucuuucaaaagaaagacaaaugaaugauacuguauaggugcaguuacaucauaggcaccacaauaagguauaaaaguaaagcauuaugacuuucaccuugggaaagaacuuugaaaugaggaaaacaaaauugcccaauaaaggugauauuuuauaaccaaccaguguggacuaguggagcauaaaguuucuuuaaagacacaaaauagcuguagcuuggauugcacauguggauacaucaaaauaaauaugugucaaucaaaaguaauauaugagaguuucugcuuuggcacauucuaacuugguguuaucaaccauuuacauuuuucauaagcuaaauaguacgaaauaaucucauacagugguuuuaauuuacaguuuucuaaugacuagugauguggagcaucuuuuuauauguuuauuuaucauuugaguuuucucuucugugaacugacagugcauauguuaugcaaauauccaaccuucaauguccaauuuugaagucuucuaauagaugugaaauuuguguauagauucuuuugaacucuaccuagacaacaugggagagacggagaugcuuaccaaacccauucucuucuucccaggcacacaguuacagcguguuuccccaucucucaguuguuuugccaugugacggacugaauucuagaaaauguaauguggacagaaauauugcuauaccuauuccauaaaacuucccacaacugaaccuucauuguguuuuaccauuuaccagcugguuggagaggaucaggaucuaaagggggucacaggugagacgaguaaucaugugaaaggcugcacaacagagaacucccacauuggacuauaauuugaaugggaaauuaaucuauuggguuaagccacugaaaauuugaaguuuaucugccauagcagcuaauauugucauuaacuaauauacacuauguaucguugugaauaaugacuauuuuguuucuuccuuuacaaucucuauacuguuuauuucccaggaguugacauuuuauuauguuuuguuucuuucuuuucacuuccccgccgugucaccuaggaacucuaguucaauguugaauaaaaaauuuugaaaguggccaucuguguuuuguuacugaauuucgaggguauguugaaguuucucuuuuaagugggguuuucuuuucuuuuuuuuagagucaggggucucucucuguuguccaggcuggagugcagugguguaguuauaguucauugcagccucaaacuccugggcucaagggaucuuccugccucagccuccugagucacugggaguacaggcauaagccaccauuccuuaaguagguuuuucauacauaaacuuaauuaggcuaagaaauuuuccuuaaauuccuaguuuacuaagaaaauuuuacuguaaaucuguauugaauuuugucagauguucauaggcuuguauuaacauaguaauacauauuuuuuggccuuuaaucuguuaauguaaugaauuacauaacagacuuuuccaauguuaaacuaucguacauuccugggauaaauccccuucuguuuuuacauauuauuguugucuaauauuuuauauaauaguuggccaauauaccaauguuugcuauacugcuuuuauaucacuguuauugguuauuuuuuucauucuugauuuacauggccaauguucauuugguuuuacuuacauauuuaccaguuucuuuacucacuacugucucuuucuucucacuuuuuccuuugaguucagcuuucuuauuucugaauuacagucuucacaguucuucagcuaauagcaaaguuuuaaagucuuuuucugacaaugcccuuuuucauucuuauucuugaauuuuagauagcuggguauaaauccuuugaagacacugaauucuauucugaauuguauuguuguuauugaaagguucuucuucuuccuccuccuccugcucuuccuccuccuccugcucuuccuccuucucuuagguaauaucuuugucuuuguuucuucuuuagauauucucuuugucuuugauguucuguguuucaccaaggaugcacuguguaauggcucuaguugugaguuucuuuuuauuuacccuauuuaggauucuugacuuuaaucaaaucaauuaaaguguacuuuucucccauucuuuuaauauucucuauguggaauucuuaugagacauagauuaaacauuacuucuaugucucuuuuuaacauaucuauauaccucucugugaauaugcacacacauacacacauauauaauauauauauuuguauaugaauauuacauauauuuuguguauauauuauagauaaaaguauauauacauguguauuuauaugcauauugccuguguauauaaaauuaaucauauguaaguuuaauuucuauauaaauuauauauaacuuuaauuuauaguuaauuuaauuauauaaagauuacauauauauauuuguuguguuuuguuuuuacuugcagugccgagaauugagguaaucauguugcucaguucauggcacacuauuguuaucaguggguguacuauuucucccuugguuguuuguuuaaucauuccucuuuauucucauuucccacuuauauuuuccuucucccauaggaaucuaauguauuuguuagaauaagcaacagcacaguaccacaguuguauaaauuaaaauauauacccacuaaagaacauuauguauuuuuaaaguaccuauuucucacuuucuauauucagcauucuguuuuaaagaucuauauauguugcuguauauuuaucuaguucacugcuucuaacugcugcaucuuaauauauaaugugcugucauugcauuucccugauucacucuucagugcuggaaacucagggaacuuccaacuuccugcugugcaaacaaugaucaaauaaacauucuuuuacauggguuuuauagacccuuuugagaauuucucugggauguauuccuaggaauuagauugauuggucauuggauagacauauuugagccuuauccucuuauauuuugcaucuuuugcugaauuugggauaguuucauuaaauugaucuuccaguuuguauuuuauauguuuuaaauuuucuguauauuaugauguuuugacaucuuaaaaaacccuuucuugcuguaaagagaccgcccuuccuggcucuagccaauucuuagagauagcaaaggacucaguuaggagcguacuuuagauuugcaaauuaaccaaguuguguaucuucuguguggccuguacacccccagggaaaaauaugcuugugucuuaaucaucccagggccauguaccaggcaauuagggacuaucucuauaguuuagagccugcaguuauuauucaaacuaaccaauucuaagaaguuuauccugcccucccucacgcuuccugucccacggaagcuccaauaaaauucuaguuuugguuuuccucuuacuucugucuucugccaccugaccaaaaccuggugauuccccgguaacucuguauggcaugugguaccccccucucuagaaccugugaaaguaauaauaaacuuuguuuucuuguggcuuuccuguguccccugugcugcaccugauuaaccaucaccuaaaagaacucagaauacgauucauacauuuucucuucaucugccucuaauaugauauuuuuaaaauguaaaugauuagaagcucuauuugaggauaauagauugagaaaaugauugagcagaaaaaguaaaucaaaugagaauacuaagacccuucaaaaaagauauggcagaaauucuucauguguuuuacaauuuuagaauguaaacucauaauuuguuuugaguucauuugaaagaaucacauuuguaccagucaugaguugaucagaaaaacggaucgucaugaaugaaauagaauaguggauuuaauuagaccuuguacaauuggggaacugguuaagaaguccaugucaggcuguugcuuuuucaugugguauuuacuggaccuggggucacuguagauaagcuggaaggcaaucaggaaugagaguuggauuugaaauaggaaagggcaaggacaaacuggaacccacaaggucagacgggaaccccagaagacaaaauggagcccaccaggacaaacuggaauuugacucugucucucaugaucucuaacuucaauaauguuagugaccugcagagaaguuugaacccuucauccugaaguugcacauacacuuggcccaggacugaaggaagucaaagaaggaaauccacuggaagcuggagaacugugggucuaggugcuucucagugucaauaagguggguuaauagauuagugacaacaugugcaaauugccaaugccuggugucauauauugaguuucagaguauaaaaugguggcuucuucauuugugcccuucaguucccagaccaaugugcuuuauggccuacuccaaauugagaaacacacaaagaaauaaauucugagaauguaauuccaguuuagcuagguugacauaguauaaaaccauauuacacuaguuuaguugaagguauguaucuacggauauauuuuguguuuauuucuuuuaccacccuugaaguaucuccagcuuuggauuaauuuuaauguaaauuuuucauuuuggagcuuucuagaccaauagccaaacuuaaaaugaguuacuugacagugguucuggguucucaaggaagagucucuauuucgccauucugaacagaggcugagaagacaacuuacccaguuauuucccuauaccuaugggcauauuaguucacacuuacgcuguuauuuagaguggaguuucucuagguucuagacucugguggucucuguuccaacucccuauaggaguagggacagacgaccuuaucuccugccucacaguggauauuaagacaucagccucuagauuaccuaagacagcccuuccccagaguagacaaagagucagaucugggcuuuacugcugugaguuucaguucucuauuauucucuguccccugaagagcuauuuauuuuccuucuaguucagaaaugcauuaaaaauuaaaaaaaaaaaaucuagauuuuucagauguuuuuaguugacauuuucaggcuaacuacucugccauguuaccugaacagggaguccauugcauuugcaaccaagaacuuaaaugcagagaccucuuuuacaaggauagggugcuuuagcaaauucagauuuacaggaaagaaaauuacaaauauacaaaacagaucaauuagagggaugaauuugcauaacaaaaggacucgccauaggacuaguuaaaauagcuaggaucuaacagugaauuuagagcaucuaggaaaaugugcauuguauaaaucuaucaggccuguaguuaaagaaaugcggggaugaauccuuuuguaaagcagaaaguccuuuuuguaaugugaaugaguacucucuaauuuacaagucuguaaguuugagaaguuugagucuuuguguaucuggcuucucaaauaauagagauccagaauaaguuauuuauacagagaguucagguuuaacucuccugaguaugauuuuucuauguuaauauaaaauaaucaaaacaaucugcauauuuaaagaauggaaucaugagguccuucagacguuuaauaugugcauuucuacauaauuucccaugggucuuguuacuggaaauauguugaagacaaauguuuccacaaaaugaccgauuucuuuugauagaucuauuuaagcacacaguaaaaaacaucuugaccagaaacauaauugcuaauucacuguguuggacauuagcuauugaguuauuaaccaguuaucugagggccuaccaugugcugaucagagagucagaguuccuuagauaucagguacccaaacucuucauuuuccagaugaagaaacuagugaugucaaaugacuugauaaacaguuucauggcuacucagaggacugcaugaaacuuccagcauauuauacugcuuucuuuaauagagugaaagaguccacuaaauuaaagagguugucaacuccauggaugagaaauuuauguuaaggaaccaugacucaccccgaagggugccagacugagucuguggcccagugcaaagggcacagagacaugccaucagacaggcuugugccugcaugucuugcauugacguugggcaauuuauuaacuucucugaacugcaguuuccccauaugcaaagcagaaaauuaauacucauccugccauccugaaaauguauuguuagaaaagaacauuauuauaugggagauauacuuuacuguauaaacuccaagguacuuuaaaaaugucauuuguuaugauuauugccauagcuacucuagagaaugcauauaucaaaagaucuaugaacuuucacaaauauuuuugcagaauaaucaaggaacaaguuguuaaccuuuuucucagaagcaauaaacaagaaaaaucuagacuagauguuuauacaaaaaguuauuuacaauucagagcuguguccaaugucauuuguuaucauuauucuuauaugagugaauuaaauauuuuuuaaaaaauuaauacauggaaagcaaucagaagaaugauuugcacacaacaaaauguauaugaacauugguuauuguuaauuauauccucauacuuuucuauuccuccugcaauugugcaagccaaacucucucaacucugaauuuuauuuucuauuguuugaaaugacaaagaucauggguagcugauaauucaagcauuguuuuugcucaaugggaagacuaagauguugcuuuagggaguaaaaguauggggagacauuguaacaacagcuauagugucaaaggacaguguguuuuuaaauguauguauacauuauacauuuauucccacuuagcuucuguuauaaaaguccugagacaucuucugggcuuugaucuguuuauggauccagauggcagagaggugaugagaccacagguuagagagaaaauuuagucacaagauuggaaauuauaagccuuuuacugcuuaauuauucccuuccugaauuucaggauauggucaccuaugaagguuauuuuacuucaaucaauccuuggaugaagaagacaauaaccauagcuguacaaaagaauaaugagauuuaaguauugcaccgauuuuuaccuacauucucuaauugcucauuaccuaaggcagcucagaaaugacgaacuggcuccuuuuucauggucaggacagcugcuuuuauauguuacauacuuguuuaauaugaacuucaaugguuuuuagaagaaggaauaauuagaacagguacagccaggggauuuuuauaacuccuuuaaugaauacuaaauaguauuuuaucuuuaaaagggaccauggcugcccuuaacugcaaccaaguucauuaauaaaaaguuuucaugcagcagacacaaaacaauauaaagaaaccagagaaaaaucuaaacugagagcuguaguuacuaucugugcuaagugaaucaagccuacuugcaaagaugcauaauuauuuuuuaauaaaaaagaaauaaaagauuuugcuggcuuaaccaacgauagguaaugauacuaaaaaugacaugagaguaggaugcuguauacugauuccagcugcuucucuuucgaguugggauuaucugaauuggaaaagaaaauccccauuuccccagcaagguacagauuuuacaaaacagagauccauccuugacaugguaaauaucuaaugaaaccaccucuucuuuccauuuuuuucccacccugagccacaugcuguauauuaaauaaaggacucaacuuuguucguacuggagaaguugucugggcugcugcaggauggagguuuaccugagguuaccuguaugaagggugaauugcucacgcuuuagagcacuguuaucuuucuccccauguacuccuucaacagcacaaucuacagugaaguacuugucaggguaagcggugaggaaagugagagcagguugaucaauaaaacauagacuggaggaagccucuuccacaggaaacuaacaaugcauaagaagcauauucuuaacaauguuuggcaggaaacucagcagcaugaaauguacuuaauguuuaacagaaguucuggaagaaggcagcuuuacacgugacguaaagaagauugacugaaggcaugcuggggucucuauggaaagagauuuggaugugaauagaccugggcuugagcccuggcuccaccauguucucaaugugggaaugugugugaguuccugcuccuccccuuccucugcuguaaaaugggaaugguaacaccugccuuaccagacuauaagcaaacagugaucugagaugugugaaagcuuugucaacucuaaagcacuauuaaaaugcuucaggaaaguagagggaauuuauccuggucaccugccuugggaacagucacgaaaccauaauguguucccaguccugacacuggcuucccucuggcucaaaaacugggucuugcaaugacuggcuuucuucugauuuucaagguugagugacuggcagucugccugggcacacgucaaagagcaccaccacaucaacugcauggcugcagucccugugcaggcagcuuccuuugcuccccagcaagugcaggggcuggcagaggcugcuucagccuuguauuguagggggaaauaggugccacaugcuguuaugaccauggugauggugggggcgacuggugcuucuacauacccugguucuaagcuccuuuucuggaucuuuguaguuacacaugggagucaacagcccacugccuucccuuuauccucuaucuaccccauugccuucuuccagcuuccccccaacccccacccccgucuaaugaaaaagaaguuaaauuccuaucuuagcaucaaauccagcuguaguuuuuucucccaacuaagcacaugcaguacgguaccuccuccuguaccauauaccuccuccaguaagauacuccugaucucuuucuccuccucuaggcucacuuuaagguccuuguuguaugugacccuauguauacccugaaugugguucuuauugaacuguacuauaacuguuaacuugcuuucaauuagaaugcgaacucuucaaaggaaauucuuacucaccaguugucucuccaucaucuagcauagugcuuggcauacaguaaguagauguaaaugauuaucgaacugaauugaucagacccuaccacucccauugauuuaaaauuauacauaugcaaagaagggucauuuugagaccacagugcaaucaagaugaacaugucucuaacuucugacuucucucuuucugaauccgucuacccuagcucacccaucugucucugcaagaagggccaagaagagcacagacucagucaaacaaagauggaacaaaauuggucacaacuugaacuauuccuucuuuauuuuccauuucuguuuugacccuuuaaaaggaauuucaaaauuuuacuuucuucuggugcuacuaacguaaaaugccuaauaaucucuacauggauacacgauuugaauaauuauacacuugaugggguuauaaggaaaguuuggaaaucaucuuacaccuucuagacauauuccaagucaaauugauuaaagaaauuaguucuuucuccuuaguucuaaaucauaugccaggaauuccagguuuguggauuugucauuuaauugcauauuauugauaaauaguauuaaagaccuuuccugaggacucacuguucugagugguuucuauagcucugugacagauguuaccaguuggccaguaaaauccauuccaauuuccucucucuugcuuguuuucuccugcagagccuggaaaaagcuaagacacacuuucccagucuccugcaaguuggacgguggcugugugacauggucuggccaaugagguguaaaccugagucugcuggaaagauacuggaagaacuuuugauauccugauaaaaggaacacacaucucuaucauugcucccuuuccccuuccuccaucugggaaugcagaugugaugacagaagcugccauagccacucugcagucaugaggcaaaaaacacaaaagcaugaggacaaagugccaucaugcuaaggagagcacagcaaaaagacagaaaggcucugguccuaaauggcacagcuaacaagugcccauuuccaugccucuugccaaccaacacaauucauguccuuaugauuucaaucccugguggucagguuuuggucacuugaagcuaaaagcauuccuaacugauucaaaccccaaauaaaaacauugcccuaaugaugaaacagaaauugguuacuuuggccucaauuaaaaaaugaaauguagcuaaucuuuaacaaauucaauccuaaauaguucucuuuaugccuacugucaggcaggcccuucuucuguggcuggaucugauuuccuaaagccuuaauuucuaacucaacauagcaaagagguggagggaagccaucgugcccaaacccucaugggggucaugacuuacaguugacugaggauggccuccauuuaucacauagucuauugcaacuugagguuccuuuaacaaauacuagguuauaacauuuaaagcugauaucacagcuucuguuacaagaauauuauuguacuaguuuccuaagguuguuguauaaauuaccauaaacuggguggcuugaaacagaaauuuauucucuuauaguucugggggccagaauucugaaaucagugugucagcagggcauucucccucugaaggcucaaggggagaauccuuccuugcuucuuugagcuucugguggcuccagguguuccuuggcuuguggcagcaucacgccaaucuucgucuugucuuuacauggccuucucugcuuccucuucucuuuugucugucuucuuuucuuauaaaaacacuuguuugacuuagggccuauccuguuaauccaagaugaucugaucuuggauccuaaaugaauuagauuuauaaacacuccuuuuccaaauaaggucacauucacagguucuacguggacauaucuuuuggaaugccaccauucaaucuacuacaacucuagaaaauuuauuccacuuuccuuauuuauuuuuguugggucucaugaacuuugauuuuuuuaagcugugugaggaaacauuuauggcaauuuaaguuuuguguugcaucagaauuuaagguuguuucaggaaacacguguuuuauuucacauuuuaaaguaaagaauuauuucucugauuacauuuuagucuuuauuucucauguuaaaguaaaaaauaggugacuucagaucaguaaguauaucaugguagugauauuaaagaguauuuacuaggcuuaguauaacucaggcaaaacauuucuugcaaauuauucaccauaaucuuugacauaggcuggauuauuaguuuuaaggcaugaauuacuuucuacccaggucaaugguuuuuaacccuguuacacauuauagucaccuggugaaccuuuaaaaaugcaugcccaggacccauuucaaccaaugaaugcaaauauguggggaugagcuugugcauaaaagucuccuaaguuauucuuauguauagugaggauuaaaaacugaccuugacucuuauuagcaguugccuuauucaacaccauuuauuuauucaaucaaguaaucauuaugcacuuuuaaguguguaaguaguugcaguacauauaaggacauauaagaaaugcagguuuauaauuuaguagucaugguguauaauauuuuguguaaugugccauuuauacuccagggugguagagccaaaugcuuauagagaccuucucugcuggucacucuuaaaaauucaaaucaauuuauagaaguaacuuguaucacaaaaaauuagccaggcauggugaagcaugccuguaaucccagcuacucaggaggcugaggcaggagaaucacuugaacccaggaggcagagguugcagugagccaagaucgcaccacugcacuccagccugggugacagagugagacuccaucucaaaaaaaaaaaaaguaacuuguaucauuauugcuuuaacuccucugcacucaggugcgugugugaacacacacacacauugcugguaauaaucagagcaaaauaagacuccuaugguugacuaucuucagauuacacccuuuacaaggucaggagccuuuuaauuauuuuagaucccccuuccgcagaguagaaaccaauauaugcuuguaaaaacucacgacugguagugaucccuauuaguagaaaaagcuugagcaguaaaguugccugugcccuggagaagugcugaggacuagaaauuccucuagcuuccagcuauuugggaagacccuuggguguugagccaacauuggcaggugcgaaagggaaugacacuggggcugaggagaggaucuggcagccaauuagcagcgcuuguuagagcucaccccagacugcugugugacugcucauucagacauucauagacaccccugucacaaauaagccacccagagcucuguagucguacaaagcagcaauaggaguggagaagaaccauguuugucaggaaggcccugcaugcaagagagcggcagggcagagagcagaguagagcuuggaggcuauaguuguaauaagcuuucaggaaaagagaacugagcaccuuaauuauuuuauuuuuuuuuuugacauggucuuggucugucacccaggcuggagugcaauggcacaaucacugcucauuugcagccugaucuccugggcuuaagcaauccuuccaccucagccuccugaguagcugggaccauaggcgugugcaaccaugcucagcuaguuuuugcauuuuuuguagagacgggguuucgccauguugcccaggcuggucucaaacucauggacucaagcaauccaccugccuuggccucccaaagugcugggauuacaggcaugagccacugcaccugacaagcaauuuaauccgaggagucauggagucuuauacaugugaagucuuguugaugaaagauaggaagauggagaggagcuggaggagaacaugauauuaagccaaguauuuaaaaacuacugaugagcuaggaaucaagcugagugcauucauucauauguuaaucaaauacuuuuugaacaucuucuauguguuucagguguugacagugcagaggugagcacguguucuccagggugaaggacacuggaggagauuuaggguuauaaaaacaaacagauaacaaaugcacauauauucagaguaacaugauagaaauagauggucaggagauaccaccucaguuugggcgaugaggaaggccuugacccaaggaggugacaugaugugagcugagaugauguggaagguguuggggcuuagaaaacaacaccccaaaaugaaggccucagaagcagccucagaagcaaaaguuuuucucugaccuucuccugcccuccuguuucucagucccauucucuccugaggcuagcuauagaaacuaggaucccucuuccccagggugggucauagaaaccagaccccuucuuccccaaagccagccauaaaaucuaaaaauauuacucuaacuuucccuccaccuuucuaugugaaaacuggccacagagaaauuaucugacuuaccuuguuugacuguaggucguaauacccccauuccagagagggucuugcccaacacagagaaggaaggaaugcaugcucaggggggccaagaagaaucuagacagacaggccuuccuggcuuucuucacucagucuauuagcauuagaucagacccuuuuuuugguccaauaauauuucggcacagcuguccauacuuuguugaaacgaaguguaaaaauggacaaucuccccaguauuuuugggucuucauccugaaggcucccauguuuacaugcuaaauaaauuuguaugccuuuucucuuaguaaucugcuugaaugugaauugauuuuucagcaaaccuuuagagggccaagggcaacuuucuucuuggccccaacaaaggagaaggacggagaugcauguaaagcgguccaggcagagggaagagcaacuguaauggcccugaggcaggaauauacuuggaguuugcaaagaaucagaugauauccaggcuagaaucagaguaagggcaugucuggaaaaaguggaaaaggcagcagggguuaaugauaagcacguggccauggcugggcuucgggaagggugaggcuucaggucuuugugguuuggucugaaagcgacugagguuccacugggugagcugcucagggcacauccugaugcagacagccuguuggcucugacagcagcucucccauccucccagcugcaaugacugccgaguuggcuuugcuuugaguauuccaaucacacagggccugcaccucucugcauucccugggggugauuuugauaguuucucugugugcacagugauuuugaggcaggagauacaugagcgacugcagcagcauaagaagucaguggugucaaugccugacaacuaccaugacugaaaaaguuagauuccugaagugacuucauuuauauugccauauccugacagaaucugaggccacucuugguauaugaacacaguaucaucuuauauauauggaaauaaaaaagaaugggagguuuuuuuuuuucuuaagcaaaaggaaaauauuaacucaagacccaaacuguuuuauucauuuguggacucccacaauaccuuccuuacacaguuauuucacugauucuagaacacacacuuuuccucauuuaccaucugugaaaugauaaugcaucuuacaauccacagugccucacaauugccaucacaugguugucauagcccauacccacaugcuuggucauagcuguucauguguugaguauaauuggcauuuaaacuguguucaaaaugauuacauuauaauuuggcaucaguacuuggaaagauacaaauacaguagggagaggauaauuugauauuugugaagcaaauaacuucacuggagaagagacugcaaugacauauuuccuuuaaaagcaguaaccaugugcauugugggucugaaggaaggaagauauccacaaaugcaugaggccuuauuaugcuuuguuacugcaauauaugaaaaagauuacauguuacaugccaaggaacucaacaaaggcaggaguaauugacaaagcccucuauaugaaggaaauguucaaucugugugaggcugugauggguuuauguguuggacagaaucaccauaaggcucugugucacagauuaauuggcagcacuuguuuuucuuuuguaggaaugcauaacauaaugaugcaucuuauaauagaugguauuucuagguuccaugaaauagaguggaacaaaguagauguuuuugucguuagacuagggcuaugcaaauacuagaccucacuuaucccaucacguucaaaaugucucugcaguuuauuuacauauuaccaaagagcuguccacuugaaaacuuauagucagcauugugucucaagccaagguaaaccaaacuaaacauucuuauggcaacauggccaggcgcuguggcucacgucuguaaucccagcacuuugggaggccguggugggcagaucacgaggucaggaguucgagaccagccuggccaaaauagugaaaccccaucuugacuaaaaauacagaaaacuagcugggugugguggcgggucccuguaauccuagcuacucgggaggcugaggcuugaaccugggaggcagagguugcagugagccgagauagcgcugcugcacaccagcuggggcgacagagcucugucucaaaaaaaaaaaaaauucuuacagaaacuugauacucuugguuggugaacugaauuuuaucaaaagcaucuauggcacacaggcagaugauuguagaauacauggccuuaaugaaaaauaagcuaacugcuuaggcgauuauuucaaauucaguuuaaggaagucacuguguuuuagcgucugauuuugaacaucaggacuaaagacccugaggcuuuuuuccuuuaagguacuaucaggucagugugaaaaagcuguuugccaggggagccaguuggaaaugaaugaaauaauuuacauuccugcugugggcaaguugucaaucauuaugugugaagccuguaccaucauuuuucuccuauaucuacacaaggaugcugucuuaaggauguagucaagugccgugacaaauagcaggucaauagcugaggacacguugccugguguguggugguagagaaagggcacaccucuauuccccaaacuccaggccggcugcuugauguaauagcagguuguaaagugaaaaagcuucugcaugaaaggauagccuuuacaugggguacagagcgcagaaacguuuuuuggccacacauugguuuuucucagccauggaucauaaugauuaucaguagaaucauuuguuuuaaaugcagagaagagcugaaaugcuucuauguaucauugcuucuggagauuucuagaaaugugugcuagguaguucaauuuaccauguccaaauggaacucuugauuucucccuccaaauuuucccuaacaaauauucccaaucucaagaaaccucaggccaaaaacauuuccaccgauccuuaauuccuuugauuuaucuacaaucaauaucacauucaucaucucuauuuuccuuguaaauccugacucagauauucucaccuucuucaccacaccacuuuaguacaaggcaccaccaucucuugccccgacuacuaggugaaugccucaguagguuuucaaugaccuccauccccauucccacagcagccaaagugagccuuucaagcauaaaccaaaccauaucucucuccuguuuaacaccccucugaugcucaugcucacauuuagauuacuaugcaaccccucuccacagcucacaauaccugauccugggccaccacugugacaucuuuucuaucagccuuuucccuggcucaugcuacuacagccacacuggcuuccuugcugguccucaaacaggcacgguccugccgcaggggaucugcacuugccgcucccucagccuggagugcugaucucugcauggcuucuucccacacuugguucagaucucugccuaaaugaaaccuccuuaaagaagucuuuccugaucacccuccugaagaucuggucacugucuauccucuuacccugcucuauguuuccuuauaguaugugccacuagcugauaucauauuacagacuuaucuguuaccugcuuauugucuuuguccagcucuagaauguaaguuccauaagagcaggagcucuguugguuuuguuuccaaugcauuucuagagacuagaacagugcuuggcauauaguagguguucaguaaauauuuucauucaauauaaauacuacauauacuucuucauaugucgucuucccaguuggacacuuucuaggcauacugggcccucacaaagauauauagaguguggacuaccuuucaacugaagcauuuuaccggacaugccaacugauggcagcacccagggauggcaaugagauggugugugcaucacccaaguggcccuccacagucaaguaggucgcugaagucugucucugaugacuuugccucccacgucuuccucugugucuuucuuucccauuccuccccuggcagcaauucauucaguggguauuuuuaagcaccugcuuuguaaagggcauugugugaacauacagcugagcccuccgaagucaggucuucaaggaguuuggugucugguggagaggcgcgaugaacccacacaaauacaagggcugguaaaaggugaagugucuugccccaguggaauaaggaacuagaaacugaaauuggcucaucugacucugaguccagccucucauccacucugcugccuugcagcccacccaagccugccuucccucuggcgcuccucugcaguuuguuuguuuguuuguuuguuuauuuauuuauuauuauacuuuaaguuuuaggguauaugugcacaaugcgcagguuaguuacauauguauacaugugccaugcuggugcgcugcacccacuaacucguccucugcaguuuuaaucuuuguucuaaauccuccuuuuccccuucucuauauucaaagcaccaaauccugcccuucuaggugaaguuauacaucagcugaugaucagaucagacuaguucacaguaagugagaaugacucauagauuuaguucucucagguggcguuuguauuguaguuugucucugcugcagccagucacaaggagauacaugugugggaguaucuguuucucuauuuuuggggggacugcgggaaaaaggaugccaccuggggucugcuuauuuacuguaagucuuucuaccuuacccugccucuugggcuuccauaaugaaguaggucuggccaugggucuuucuccuuccuuaguacaauuucuaaagggaaggcaauauuccauuuuuggcauuugggagguggugaaacaggcacccucucuguucucucucacucuuucucucucucuaugugcgugugcguguguguguguguguguguguauagugguacuacagggucauuuauaccagcacgccucauaaguugcaccccuguucgucuugugcaccaugugcccuccaguggcugccacgaagaagaaauggaacuuccuaagucagccauccugacagacacuguuggaaacuuucucugcaaggcugagaacaugagggaaagacugcggauguucauucuguuguuaaacguaucucuguugcaagaccagccuaguguaccgccuuucaugacacaauacaucugugaauauaaaauaacaggaacugguggcuuuucucaucaaaauccaaccaguucucuucagacacuucuuaaccuguaaaaugggaauggcaacagugugcaucucauaggguucaggugaggggaaauauaucaggauauaugauguauauaugacauauaugucagacuuagaacacucucacacaaaagugucuuuaggucaaucaacagguauuuauuugccaccuccggugugcuagaaacuguucuaggagcuggggauacaggagucaacaaaauaaucuaugcccugauggggcugauugugguuaauaaucaugauagcaaaggcauagccaggauccaaauccccgcagucuagcuccgaguccccagucuccuccaugacuccauagcaccucuuguucacugagcaagagaaugcgaauaauacacuugagaugacguugugaguugagagccuggaccucagggauaaagaccuguacuuggcagccaucuacuuugagucugcuagcugaaaccuguccaagaacauaacacuggggaaaggagguuugagaaaaaauucuugagcaagauugacaauuaacgaaggggaagauaaaggaagaguuacuaaaacaaauucccauuauuguuacuacuauuauucccugugcucaucuagaggagucaaguaaccuaaggaaucaaauucaaugaaaaaauauugguugcacacccacucugagcgaagaguggaugugcaacaaauauuugagcaaggcacgaaaaugauuuuucauuagacagauacuuugcaauuuaauuuucuaaaauagcugaguuugauggucaaugaguucaauaaacaauuuuccagcuuuuuauauaucuagcaauuccaugaucacacaguguguuuaucaucuaucauucuccaauuacugaauauugguugggguuccugucccccaguuuuccauacauuuaggccuccuugcaugguacccuauccaggucauuuuuuuccccccggugagcccccauugaucaucuuagauuuucugagaugguuuugauuucacauauuuugagugggggcuuacaaacaauaauaagaucauccauaauucuaaaaucucucuucuuuucucuaauuaaaaccuuugugggccaggcacauugacucaugccuguaaucccagcacuuugggaugccuacauaggaggaucacuugagcccaggaguucacaacaagccuagguaacauaaggaaacaccgucucuacaaauaauaaaaauaaauuagucaggugugguggugugcgccuagucccagcuacuugggaggcugagaagggagcacugccugagccuggaagguugaggaugcagugaaacuugauugcaccacugcacucuagccugggugacaagugagacccugucucgaaacaacaacaacaaaacaaaacaaaacaaaauaaaacaaaaaaacccauaaaacaccaaaauaaaacaacccccccaaaaucucuggggugcacugauugcaguaauggucccauuucuucacccuucccuacucucaagcuauuuaccgugugauuuugcaguugcuccuauugagaggugaacuauauccuccccucccaagcugauuuugaguuuuccauauagcuuccuuuggccaaguguuggcagaugugauguaaguagagguguaaaaaagcgcuugcucauuuuuguuuguuuguuucuuucuuuguuaugaagacaugucugcgauagcauacuagagaguggggcacagggagucccagcuguuucagcugagaccaccccaggucagucaacucucauaugccagaagacuagagccaacugccagaugugagggagccagaugagaucagaagaaauuugcagccaagcccagccuaaaucgcugacccacaaacuguaagcucagcuaaacaaaugucuaucgcuuuaagccacuucauuuucagacagcuuguuccauagcauuguugaggcaauggauaacugauaaugcuucccauaaaucuuaggaacuuggaagcugccccuccauuugcccuccuuuaagcaaaaaauugaaugcuauuugcaaagcauuguauaaaaugcuuuauuagauuaucuuauugaauccugacaacaauaucuagcagacagauauaaugcuauuauccaaauuucagaggcaaggaaauugaagcuuagagaaguuuaagugacuugaccaaagugcuuuuagaaaagcagagauucuacaaccagucuucuaaaucuuggaagacugcuuuuagccacggcugccugccauuuacucuuuggauucuccauucuaccuguucugcugccuacuucuaccaccuaauuaggagaagaccuuguguucccauuugggauauagauacccacuuucauacuggguuuaccccuaauauuucucuccauaccacucauguagaugguugucuuccgcauuaaucuggaaauuuuuugaggguaaagacuaaaauacuuauauuuuuauccccacaacucuaugcaguauuuuuuuaaaaaagaucauagucauguuuuaagguagcuauuccauaaaacauauaaaaagguaaaaaauacucuccuagagaauauaugcauauuuaaaaggacacuguuauucaaauuaaucuaauuuguggaauacacaguagaggguuuuccccauuuuguuaaauaguuuuaguuauauguuauuugaauguaguguuugccugaauaucuacaaaaauaaaacucucuugacucauuuauagauuaauuccagaagcagggauuaauacaaaacuggcagugaauaauuucuguuuugcaguuaguuucugcauuuaagaaauugcuuuaggguucaguaacuugcccuggacuucagguaugcugccaccagauggcagcagggugccaggcauaaggcuuguaagcaaagaauuugugugcuuucugaggcucaagguaauagcucuuuccuuaaguucaaaaagauuuucagaccacugauuuccaauuuagcauaauacauuucuuuacaaaaauagguaaacuaaaacucuaagccacccuaagacaucuuuagaacagauauaaaucccaagcuauaaaaucaccuaacucauuauuacuucucuucucuagcaucuaauuauuucuguaauggcuuauacaccaugauggcuuauacgaaucuuauacaccuaccucagugauaguguuaaccauuauaauuuacuuugaaucuuuaugaucaaucucugccauggcaccguguauguuaguuuucaaaauucucaauaguuuuucuccagguaaaaaaaaucuaucuggcuuuccuuucaucugucuuaagagagcagagguuuaucuuuucaguauuaucugagaucuucucuuaagaccaaaaguauuucuccacuacaguggcaugaacaguguuuauuugcauuucguguauguauuugugaauauggaguacuuuugcuuuuguauuuucuauacuauauaauaaucuacuagaauauuuccccucucaaagcucuuggaagcacagaggcaguuuaccauacuuuaacagaaauauagcuggauuaaaauuuuuuuuuuuuagcaacaggcucugcccuaaauaucucaagaaaauacuuuaaagaacaaaaaucuucaugccaaauuagcaagauacaggaaaaaagguaagugggcaaaauacagggaaaaaaagcuaauucacccugacaguuguuacacaaagcugagagagucuuucccucucacauuuacaaaguccaggagcggaaagacuuucagcaggaguaagccaugaggguuuggacaaggcugguaggggaaaauguuaucuccugggcauacugggaagcugagaguccagggcaggugaaugggguuggagaugggaaugagggaggacagcaucugagcaguaaauccuggaacuagaguuagcauaucaagcagggcuaucuaugcacccaagguaaguucuggcugggagaagcagauggcaacuaagcugugaaaauaggcuccaagggaccagcucccagcguaacucugggggagggaucuggggaaguacaaaaaacauagagaggcaaaagacaaauaaaauaggaggagaagagaaagggauggaucauagaaagcucuuauuugauuuugagucucacaggaaacccaugaagccagcagggcagguauuuuuuauccucuauuuacaaaugagaaacugagucccagaggggguaagugacuuuuuuuaaggucaacauaccgaggggcggauauaagauucaaagucaagugaccugauuccaagcuaaagaugaaagaagagagggcacauuugaaacccugacacacacacuguauguccuacucuuugcuuuauaaacaguaaguaaaauuuucaaauaauggaagcuuagucuuuuaagggucaaacggaagcagcuuuagccacuguugaaaagcauuucugaaauguauuauauuugcccuugccuccuuugaaaacugacuguaaucuacucucuucuugauacauggguuauaauuacaaaaauuuacuauauuuaugaacuucuaauucaguagauacccucagguucuauggaggcacauguguuuuuuaaaaaauuaauuuuuuuugcugccccaccuaauacauucauggcuagaaauagcuguguagcagaacuggcugagucagcuccuucuucccucacagccagcucuuccuucuuaagugugucugcugcuggucccuaucuacugcuucugaucaggucauuccgcuuauuaaaauccuuuagugacucccucuaaccacugguugcaguaguuugcaaaacaggcugcacaugaaaaucacuugaggagcuuuuaagaccuccugauacccaggugccaacacgaaagauuucaauucaauuguuuuagauauggggcccucaccuacagggauuaacauaaguagcaugaacucuugcuucuggccaagauggaauaacgggggcuagauuuaucuuuccaauggacacaacuaaaaguccagaugaauauauuaaacaaugguuuucaaggcaacgggcaugaggcauugaaggacagugaucccugagagauggaaaacaaacaaaaugaguugcauuugccugcaauugccccugagagaauuucuaggccaugcagcagaaaggaagaauucagaaggagucugcaagacuccuuaaauagaaaagaugaagcagagaauccagguagacuagcguggcuagaguuugccaggcagaguauuagagagcagggaguucugaucaguacaugcaugugaggaaaugguauaaaaucaaaugaaaaaccagcugaaaagaugaguaggaauagucuuuaaaguucaaacuggacugguaaaacugagauuugaaaacuauucaaauugggaagcccugaaauucaaagagcauuggucaaguacucagaaggguauugcccucgugguggggaaguauugucaauagacuaaacaauacucugccuugccuaaccuuaaaagcaagaccugaaagaucaaagacuauucaaagaauuuuccuguaucccagagcaauacccaaaaauaucuguaggaauaaaaaaaaaauccagcauccaacaagguaaaauucauaaugucuggcguguaauaaaaauuaccagacaugcaaaaaaacagcaaggagaaaaaucaauaaaacccaaaccuaaacugacacagguguuacaauuagaagacaaagauauuaaaccaguaacuguaacuguauuccauauguuccacaaguuggaggaaacagcauguuuaauagagacagaaaauauaagaaagacccaagucuggccgggugcgguggcucaugccuguaaucccagcacuuugggaggccgaggcaggcggaucacaaggucaggagauggagaccauccuggcuaacacgcugaaaccccgucucuacuaaaaauacaaaaaauuagcugaguaagguggugggcaccuguagucccagcuacuuggaaggcugaggcagaagaauggugugaacccaggagguggagcuugcagugagcagagauugcagagauugugccacugcacuccagccugggcaacagagcgagacucugucuuaaaaaaaaagaaaaaaaaaagaaaaagaaagacccaagucuaacuugugaagaugaaaacuauaauguccgagauaaaaaauacacugcauaguaacagugacagauuagcuauucuaagaagaaaagaugagugaacuuaaagacauagcaauagaaacaauccaaaugugucacagagagaaaaaagacugaaaaaaaaugaauaggacauuggugaacuguaguacaacuuuaaaugaccuaauacugauguauuugggguuuccaaaugagaggagaaauaaggugaguaauagaaaauauucugaggccagauaugguggcuuacaacuguaaucccagcacuuugggaggccaaggcagguggaucacuugaggucaggaguucaagaccagccuggccaacauggugaaacccuaucuccacuaaaaauacaaaaauuagccagauguggugucgcaugccugcagucccagcuacuugagaggcugaggcaggagaaucgcuugaaccugggaggcggagguugcagugagcugagauugugccacugcacuccagccuggaugagagaauaagacucugucucagaaaaacaaaaaaauuuaagagauaaugacuaaaaaauuuccaaaguugaugacaaugauaagucucauauuuaagaagcucaaaaaacuucgcacauagaaaacaugcaaaaaaugauaccaauguguguaauaaucaaauugcuguaaaccagugaaaaagacaacaccuucagugcagccagggggaaaaaaacugacccauuauguauagaggaacaacaaaauggcggcagguuucuuguuagaaauaaagcagaagagaggcugguggagcaauaucuuuaaaguacuguucguuagaauucuauacccagcaaaacuauguuucaugaaugaaggcaaaaugaaguauuuuucagacauacaaaagcugugaaaauuuaucacuagcagccucacacuauagaauaaugucaaagacaguccuucagguagaaggaaaaugacaccagauggaacuaagggucuacauaaaggaaugaagagcuugguuggcuucaagggugugugaccuguaugguuacacaagguccugcagauagaagggccuugugcuagcuuuaauguuuugauguuacuggcuaaaaauuuuuaauaauuuuugaacaaggggcccuauauuuucauuuugcacugguagcugguccugaugaagaauacuuaguaguccauagagguggaggcagaggcuggaaugccgagcuuggcucugaagauccaggccauauguucaggcauggaauagggaagagauggagguggcuucuucagaggaaauuuggaauguuuuaauuuuaaucacgagaagggugaaugaacagauguccacuaaaauaaaaauuuuaagguagcaauuucuggguaauuagaacacaauuuuccuuucugcacagagauagaucauaaauggcuauaauuagagaguuucaguuuuuucugaaguucauuuguugcggaguguucaaaacugucucuucaggccaaaaugccuuguuuauuguguguguguuuuacuauuucugauaucaaugcuuuaauaaugccuguucuguaauauuggcccagagguacugcaagaguguaaauucacuuuacaugaaaaagaaaagcuauauuacuuccaaugacauuuuagugauuaaaugcauuuuauuuguaguauaauucuaucccaguuuaggucaaagcuccgaaguugagaguaguauaauaaguguggacaugcaaaagaugcugaaagguaguagaaauaauaaugucagaucuagcccaucaccacccuccagaacauauaugaaaggauuagaaaucaauguuaaguguguauuuauuugggagacuguccauccuaaaugaggacaaaugucagggugcuuuucccaaaacuugggcuggcugagggaagcuucaagagaaucccuggaacagcuugaaaucuggaugcaggggguggaguugguagaguccagaagcuuuaccugauauaugccuggaaaagucuaaagcucagaggugguaucuagcuguccugaaggcuuguggggagccagcuguacuguauauagguauaaaugcaaugcuuaaauccacagauaauuuauaaaguucacucuacacuugaauacucacauccagucauuuaguugaagccuucggcuuugauuaaaguuguuaauauuugaagugcugacugauguaaccucccugguauggaaauaugaauauuucucauuuauuaugucccguggugaaagcauaaccuuuuacuuaaaauaauugguuugaaaauggaauuagaauauucauccuccccauuccuccccugcaauuugugaauuuaguaauuauucuucuugguuaugagcauaaguuaccauuuaccuuuauucaauauguacacacgcacacacacacacacacccacacacucucacagaaugcaaaaaaaaaauuaggaaauaaaguuaucgcaacuuuagcaaugagagcgggguagacagaagugugaguuuauaaugcugaucaugaaauaaaaacuucaaagcaagccuaaaucugauacucauaggaugauagcucuacugcauuuaaagcaaauaaaguuacauuucucaagaauuaaugcaaaauuagaaaguuuccuuugaaaaucucuuagcacaucuccaagugguuagcuuuccugggaaagcuggaaauuaaaucaacaacauugaaagaaaaaaaaccucacaguccuaaauuaaacagucauguaaauauaguuuccaaagcuauuaggcaagaagcaaaugauuuucuaaucaauuuacuguugcaaaaauaaugccagauuauuuucauggggcaugugaaauaauuuacaugggacacacguggauauugcuaccuuagcaaucuuaucuaguucuacccaaagguauuuaaaaaacaaccacugacgcugaaguuauuuguaaucauaucagcagccuaucuccucauccuccauucucuuccccuccaccagcugacuuuuguaucaaaggcaggcuacccuugcacuucucuuuucacuuaacauagaacaacaguuacuggagcaaucugguucccuuaaaacuagcgacucauuacaaugguucaggaugugaacuucccuaaaaggcuuugcucuaaaucaaggugacuguacauucccuuuuaggcuagaaaacaacaaacuaugcauucuuaguauaggauuauucagcccauauauuauaugagacuaccucauauuuggguaccucucucauuaguugggauaaacaagucuugaauuugagauaauucaaaaucuuuguaagccaaaggcaugcacacauuuugccuuuuucucauuuuaaaacccaguaacccaaaaccaucacaugaacuacccaauucuauugggcauacaaauuuuguuuucugauuuccaagucugaagguucaggucaauauuuguccguaauuaacauggacauaauuaaucugcugaguuaaaugacauacaaauccucaccaccaagagugugaacuugcccauaaaguugucacacagaaaauugaauucaaucagcuuacuuuaaggaaaauauacugaguuagugguagacacagauggcaugcuucagaggauuuuggccuuaaggucuaagagacagugacuauguuuucaaauuuugacacaaugcuugugacaggcacuucucccuguauugaagccagaaaacuguuaagagccaacauggguggaaaagaccaguuuucuuuuuuucuuuuucuuuuuuuuuuuuuuuuuuugagacagagucuugcucagucacccaggcuggagugcaguggcgcgaucucugcucacugcaagcucugccuccuggguucaugccauucuccugccucagccucccgaguagcugggacuacaggugcccgccaccacgcccggcuaauuuuuuuuuuuuuguauuuuucauagaggcaggguuucaccauguuagccaggauggucugaucuccugauguugugauccgcccgccucgaccucccaaagugcugggauuaccggcgugaaccaccacgccugacuagaaaagacuaauuuucugucucaagucaaggcugauuggccucauggguggugguggaucagucccuaagccccggcaguaaagccaggggccgugauccccauagucacugcagcugucuacaaggucuggcugcagucacuaaacaaggaucucuaggccacagguacccccggcacuggggaaagugagugcccaagcuuacaucuuaaacacuaguucaggccuuuggauuuugagagacauagagccucacauuguaagugauccuuacuucagugaaaacauauaauagaguccuauugaaauccauucuuuacaaugggagauuacugcuaaugcuagcuaggugagugauucaugugcuaccuauuguaaguauuaauucuucauuagguagcagugugauucagaaaauguuacauagggauauuuuucaagcuauuccauuaacuaauuaacugggaugcaacuuaaguuggaagauuguuugguugauguauggaagguaccccuuuaaaaaauaucuaugaguagccaugugaugagugucaaguucuugacagagaauugaaaucuuagccugcugcgaccaaaaagcaauacuguuucaguuaguuccguugccacacagacugaaugaaauuaaccaaaggcuuuauguuagacaaugagucucuucugaaauaaugauagcuuuugugagggcauaagaagcagaaaguuaagaaagaguuacuuauggccauacaaucacauuaauuugucuauuuaaugugacuuuuagauucaagaacaauuucuauacgauguucuagaaaagacauuauuuuuucagaaagacuuuuaaaagcaaggaauuaauuaguuacuaauaauaaccaucauuuaaaauaagcaauggcauguaauguguagaaccgggacuuuuggcgagaaagugacauaaagaguagaacagagcacuuuugaaccagcagaaacuuauuugcuuuaucucuuaguucauaaaugccauuuuccucaaucauuuacuauaaaacuaaaacuauucuuuaaaaaccuaagugauuucucauuguuacuguuaaaaagaaaugugugcuaugccaaauacaauucaaaugaaugaccauuuuauguuacauuuucaucuuauuccuucauuuaugcuagaaaauaacaaaaguaaaaaugcaaugagaaaaguaucaaagucauguaugcagauucaguugaucucuuugggcuugacuauuuggcaacauauguuggccaguuuuuauaggaaaucuaugcuaaguguaugaauaaaacagagacaacguaagauuagacacuagcuucagaaaauaaaauuuugauaauacagcagccuauuuaguaagaauaaaagcagucucuuggagugugggauuuguauaugugauuaagaaauagagacaaggggccgggcgcgguggcucacgccuguaaucccagcacuuugggaggccgaggcggguggaucaugaggucaggagaucgagaccauccuggcuaacaaggugaaaccccgucucuacuaaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggcgacagagcgagacuccgucucaaaaaaaaaaaaaaaaaaaaaaaagaaauagagacaaggaaacaugauagagauagaaaacuaaaaaaaugauaauuuaaaucuuuaacagugaauaugagcaaagaucagaauaggaaccuauuuauuaucauaucuauauccuauaacugaaaaaauuuccuaaaaaggagaacacaaaaaugcuuggaagauuuucuuggauaaugcaaaauacccugggaguucucucuuuaccucuuaguucccccacauuuaaacuucaaaagacaaugacucuggagcuugagagagaucgauauuuaaaacagaaggcauaucuauaaauccccauuggauguccaaacacuuauaaaaaaagaaaauuaaauuucauuuaucaaggguugaauaguuaaggugucacuaagagaccaacuuacauuaauaaguucaaccucccagauuuuuuucaacagguccaucgaaguguagccauuaauuagaaaggcuuugguguagucgcccaguucaauggaauccagccacucagcuacagaggugggaugguagccaucaugcccaaugggucucaucuguaauaaagaaaauuacauuaggauuaaacuguauacuuugugucccaacaacagaaugcagauuuccccuugaaaauuuauuugacaugaagaacagaucuuucuggagacggaaacaaggaaaaagaaaacacuuucugauguguuuucacaauucuaaaacauuaauaauuuucacgcugaauagguuuucaaaauauacacagaaauuuccaauuuagcugcuagauuaacucuauauuuggaagagcuaaacaugucaaacuucugucauagacauuauuggcauucugguggguggaauuaaaaaugaugucaguugaauggcauuaaauucgaugcgaaagucaccaggaagugcacuuucaacauguagaugauaauucucauaugcacagcaccaaagcaugugaaaauacugcaugacuuaagcauucaaagggaauuugugcuuaugcaagacauguauuggagguagugcaaacacgcuggagaaacauacugcugcggugaaccaguaaaggagaggccuuuggguauuuuaagaccauguguucugcaucgacucuacaguauguuagacaugaauagagaacuugcuggcagacaggcaucuauuuuuugucagcuauauacagauuuuuaaaaaauaggagaacaaagaaaugugacagcaacauaauguuucugaguuuaaauuggagugugaaaguaauuuaagcaagaggaacuucuggguuuaaaauuuuguauggauuauucugguccuuuagcuuuuauuugaaauuguagcugaaucugugguucuugguuuucgaagugacucacuucuaaaacuugggcugcuuugcaugccacgccguauaucuaauacuucaguuuuucaggagagcuggcaccucaucaaccugaugggggccuucgguaaaauucacgauggaaacagcaaggcugggcaaaacacaacauagauuuuccucuuucuuugauucaaagagauaaauauuaauggaaauuuauaugauucugauuugcgagcagagaaaagauuagucugggaaucagggauucagauuuuaaucuuaaacaugguaagcuuucuaucacuaugcaugguucucauuuuugagauucucccuacuccuucauuuuaaaguuacuuuuucucuuuuccaguuguuccgcuccccauucuaguuuccauuucaaaguuuaaauguucucuguuuuauuuuauuuuuuuugaaauggagucuugcucuauugcccaggcuggagugcaguggugugaucucagcucacugcaaccuccaccuccuggguucaagcaauucucauuccucagccucccgaguagcuggaacuacaggugagugucaccaagccuggcuaauuuuuguaugugucucuacuaagagacagaguuucaccauguuggccaggcuggucucaaacuccugaccucaagugauucaccugccuuggcuuccucccaaagugcugggauuacaggcaugagccacugcuccuggccuaaauguucucuauuuuaaaguuagaguacaauuuauuauuuacauuagagucugaacuuggucagacuuuuguacuucacuuuuacauugacugacccauuuuagcuacucauuaaauauuuguucauguaacacuuaacucuguguuuauuaugugguagcuacaaauguaaaugacaacucagcauuugcagaaugaaagucaguggcauucacaaaucccuggauguuauguauguauaagaucagaggcuaggacccaaaagggaggcucauagauauucgguagcuucauauucuauagagaauuacaaaaauauuggggcuggguacauucuccaggccucguuaaaaggugguugaacuaacucuguuaaccuaaauaaucacucuggccccaggaaucuuccugacugccccagugacaugaaauaagaaagaaagggaagaaagugagaaacacuaagguugaaguuaacugcuuaguagggaggucuugccguuggcccauccauaaagcugaccacuccagcagcagauacucgggaaaagcuuagggagucuugaugacuggauuugggucaaagucaguugucucauaccagugaacugugcaaugggguuaccacagguuacccccaagcacuuacacaacacucuuuugaggaagcaauuaguggccaucugacacacagaggguguugauggucggugguggccaaagaaucagggaacccaugacaggacugcaaagaaaaucuagguaaguacaaagauguuugcuugucccuccaaucccccuuucuugucccaaugccagaaaauuuagaaucagaagagagaagugccagucccuuaggggaagucuaaacuugggggggggggagguggugaggaaaauaaaacuggagguuucaaauaaauuggaacugagccuucaacauuuuacaugguuggaaaguuauuggaaaugucugagaugauauuuauaaauaguaaagggagggucaguugagcuugguugaaugauuggaaaauaaaaaaauaaaauaaaacagcaaccaucauaucaggauugcacggaaugcaggcuguucaguggucugauuacuccuguaaggcaaguucuccuagaccaaucuuaaagaggugagagggagggaaauauuuggugggaggaugaaagacaagggcaggguagagagcacaacugaagagaccuuggaaauggguaugcugagguguacagggcaguaucauccgcccacucauucaauaaauauuuaaucaaugccuauucugaugaauguuguggaaaugguagagaacaaaacagucauagucucucccucauggagauuauaacucuuaauuaaaauaugcaaacagaugaccaauaaauuaugaagguucugcauaccugaagagaggaaaccauuagagccaaaugcaguuacaaaauuaacuugacacauauuuaaugauaugcagaauaguuacugugcugcacaauaauuucuuccaaagcaaugaucccaucuguuccuuuauuucugucccuacugccauuacccuguuuagguucuuguuagugcuuacaaaaacuaacacaauagccuucuacauggucucccaccuuugauccagcuuguaucuugcuacuacauuagucuuccuaaaagucagacccuuaaguguaccuuuguauaaaagccuguaguggcuccuucucgaaaaaaguccaaauguccuauuccagcauucaaggccgauugagauuagccuaaucucccacuccucugcuauuguguacccaauaaauguaacuagacacguguaugucuaaacaguacauuaaaucgcuaggcauucccugaaaaugaccuguauaugacacagucaauaucuuugcuaauauaacuucccaugcuuggaaugcuuuugccccugcuucuggagugauuucuucaggacuggcuucucuucuugagcucugagaugcaaauuucuaaccauuuguaggacaucucacauaaauguccuauaggugucaccaacauaagucaaaaacaaauuuaacuccuuuaguucaaaaacaggcucucuuccucuuuuuuuccauuucaguuaagggcaacuauuacuccacugcccaagcagaagcuugggaguuaucuuacuuuccucuuucuguuuacuaucauaucuaauuaggccaacauggucuaucaauuugauuucuaagaugacucucaauucauuucucuucuuccaaaauggacuuuggaauaugacauucccagcagugcuacguauuuguugggugaucuuuggcaaguuacucuuucagccuguuuccucuuuuuuagaauaagcauaauaauaccuauuccaaguguuguuguaaagauuauaugaaauagggaauaaaaauugccuagcacagugauuugaauauaauagcuauucaauuauaacucuuaguucucuuuucuccccauugcccuaaauuagacccaugcuuauuuugaaauugcauaauauucugccauuggcugcuagucuuuucagcuuccaaucaaagcucuccucucucaucccuuccuauuuccucuauuuccuuccuucuuuaucuuguuuuagaaaugguuugcaucugcuaacaucuuuaccccucuccccuucagccgacaguuauuuuuuagaaacauaucuaacgaggucacucaagucgauugaacuguuuauuccaauucuucguucucuuacuguauuagaauuaugccccugugcccuuugccaagggaucaacauuaugucucaguguggcuggaguuacuucccagucucaucaaugcuggccaauagaaugcgugaagugucaguguggugguuagagacgaggucucugugcuccuguguucuacuaaucuuucaguguucauaugcucucucauaagaauagcaagugcugagaaguugcauaacuccugguucuaggagaaagaugaagacucguggagcaaaccuaaauuuaacccaaagcuuggaaucuacccuagcucgauggggcucaggaaaguccagaugaaguuagcugaagcacagcagacccgugaguaagaaaaaaauauuuuuuguuguuguugcugugaacuacugaaauuuugauuacagggaaaaacugaauagucacuccuuguuuaaaaacccuugguguuuauccauuaugccuguggaauauaaaucagaccuuuuaguuuaugaaucuauuggcaaaugcaucuucaugagacugagaaagauuagggaugcugaauaagcaaacaucaguauccuucccaagcuaccucacugucaugcagaaacucugcaugccacaucuuuuuuuuuuuuuuuuuuuuuuaagacagagucucacucugucacccgggcacccaggcuggaaugcaguggugcaaucuuggcucacugcagccuccgccuccuagguucaagcaauccucccaccucggcuucccuaguagcugggaccacaggugugcaccacuacacccggcuaauuuucuuuuguauuuuuaguugagaccaggguuucaccguguugcccaggcuggucucaaacuccugagcucaagcgaucugccugccucaaccucccaaaguguugggauuacaggcacaagccacugccccugcccuauaugcugccucuuuauuaacccuaaacuaaguaauucuuuauuguaugaguuugauuuuuggggcauaauccacuguacauguaauauaccuccacaucuucgcucaugccauucccucugcuaggaauacaguuucuacuuuuucuccuaaugaaauucuaucuauccuuuuuuuuuuuuuuuuuuuuuuuuuuuuuuuuuuuugagacggagucucgcucugucgcccaggcuggagugcaguggcgcgaucucggcucacugcaagcuccgccucccagguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccaauucuaucuauccuuaaaagguccuguuuaaacguuaccuccugugugaaucuuucucuaauguuaccauuauuccaccgaaaaaucauaucuucugcuauauuucuguaguauuuuccauagaguucuauuauaguauuauuaaagucugcuuucaauaauagagaagugaguaucugucuucuucauuggacugccuaccccuuggugaagaaaugagguguuaaucauuuuugaagucccuaaaucguccagcagagcaucucacauauggcaagcauaugcuaaauguuuguuaaauuaagugacuuaaugaauacaugaagacaaaaugacaaauucauuucaguggcuugguauccauuugugggagagauuuguauuuuguacuccauguuaugaaaacuaagguuaucuuuuucugccuaacaauaacauucauaacuauuuaaaaccuccauauaucaagaaccaguuccagauaggauauuguguuacagaaugcaauggacuuuguuuccauagcacagaagacuugauucuauuagccauguagccaugggcaagucacuucaucucucuaagcuucaguggugucagcuauaaaaugaagguauuggaccaaggaucucaaagcugcuuuguaauuccuaaauuuugcaauuccaugacucguaaauuaauuuuaaauuaguaaccuauuuguuuacccaggaaagaaaaaauaagcccaaagacaaaacuaaaauucauauauauauauauauaugauaggacguguagacuaaaggucagauggcauucacauuucuuucauguaucuucagcaguacccacagggagcacugugacugcauucucaaauuagcaaugaugaaacuuuuuuuccagcgggaacaucuggcaagacagggcuaggaagugacagcuccaucggccugccaggccagcagugcugcuaagcaugaacggaagucaggcucacucuauaaucugagaggcagaguggugagcaggcagcaggcauucauuacagaggcucgcaacaaggcaauuugauucaauuaguugaauuccaaagucuggaaaaaccuaagcugagacagaaauucgagauagcagugaagcuuuagucuugggaaaauugagauauauuaacauauuuuuuuuuugccaaaugccuuccuuguucuuguuccacccaaaugacuuuccuccaggaguuuuuuagagcauacuuggccucagagagaguaugcuguuaacaucacaggugguacagcaggcagagaaaccacaggacaguacucuguggaguucuggguuugagggggucagcuacggggcagcugaacaacccaugcucugagacugcuugaucgacuucaaccagaguaacucuuauuuuaugcguuuuauacaaguaagaggaagaaagguuuucucggcuuuaaaaagaaauguuugaaaaccacgaaucuagaagacuuuuguaagauuacaugaccacuaugauuuuauuuucucuuaacuuuuuagcuuuauuugaaauauuauggaucuguuauauauaugugguuauauauauauauacacacauauacauauauacacaucacacacacacacacacacacacacacacacacacacacacacacacauauauauagagagagagagccugucauuccaucauucuuucucuuugccugaagccagcauuuucugugcagauaaggauaauaucuuaugagaugacggagccacaggauggaagguauagcaggaggaaggcaauaaaaacagguaaaaaaaauaaaaagagagagaaaggugauauacauuauaauagcuuugggauuaaaugagaaaaguaguucuugaugggacaacuuauuaaccuagaauuaugauauuggcaugguauuuagaacaagaggauaaggaacccugaaaagccaauaauggauuagacaggcauuuuuauguccaaaaguguuagaaaauugagaaaaagacuacuuguuguucccuuaaacuuguccucucuucuuccacauaaugggguuaaauuggguucaugccugccggacuagagacaagauacaucagcuuuuuuucugguugcugcugugaaaauaugguugagccuguggaaugcuaaugaaaguguugcauguaacuuucaggucaccucuagcuaaaagaaguuccucgaccuagaauuccucuuuuuucuucaucuuccuauaagcuggaacaucagugacugcaguucagcuuugacuacacaggcaaaacaauacccuggagucugggaaaugcuucucagaccucaacgugcuuaggaaucaugcagagaaucuuauuagcagacgauucuaauuccguuauuuggagggaggauuggagauucugcauuucuaaccagcuuccuggugaugcuaaugcugucagcccaugaaccacacuuugaguaguagugcuuuggaggaugacagaacaacaaauagaagguccucgguccuuccacaauugcauagagcaaagccaccuuguaaaccugcacugcucauuucaagacuauuauaugagagaaauuaauauucgauucuuuaaaccacuauauuaugaaugucucuauuucaguaucauagccuuuccuugaauacaaacauaacuaaaaauaaggcaguuucauguagaacauuuaaaugaagccuguacuuccauuugacauuacauuguauuaucucuuguuuuguggggccguaaguuuucacaucuguuaucguuaaagaagcuucauuuccuuuaacuguguuuguuggcauuucucugucaaucacagcaucaucccuuuguaacaacuaugcaagggauaagaggagaaaaaugcagggaaaccccaaguuucuagcuuggauaucugggcaaauggugguguuaccagguaaaagagaaaagaaaauagacugggaugacaugaauaauuuugagacaugagaaauuuaagaugcuaugcuguggaauggcacuuuaaauuuggagaagucuggggagacacgcggccuugggcaucaucaaaguacagguaagaguguuggcaacuccacuuauuagcuaucugaccucgagcaaaucacucauacuuccuaagcauccauuuucugauuaguaaugugaaagauuaaaagaauaucuaucgcugagcguugccauauguauucaaugaaacuacacaaggagaauuuagcacaauacuuggcacacagaagcacucaauaaaucuuuguuauuuuuuuucugacagcugaaaucaugcacagguaggacugcagaggugacuuuguagugugagaagagaaguggccugagaaugaaccaacacuuucaaugcauaaggaacagauaaaaauaauacucaggagaccaaagaaggaauggucaggacaagaaaagaaaugggggaaauaagagugucaaggagaguguggucagcagugaggggaugcugcagagacgucuaauaaaaugaugaaggagaaggguuugugggaucacaaauaggucaucggaaauaggucaccagacaccuuauugagaagagcacagaagcugagcugcccuagguuggggaguuuguaugggaagaaaagggggagaugagauuuuagaaagcacagaggaaaacacauggaaagggguaaagaaaugaggacucaggguugagaagggucagagucauaaaacaguuaaguuccagggugcaguggagauugcaggggagggcuugccuuuugcuuugacacuuugcccuccuuucuugaaauuacggaucugacaaggaugguuggagcuaacuucagggugaauacucuguguuaaaacagugcgaguguuuggaagcuacaugguuuagacuuggugagagcuggaugcuuguacgugaaguaccugugaccuucuggugaagguccucacgugggcaagagcugucgccuguguugucuucacuccucagauacaaacacagcaaccuaucauuuacauagacccaccagugccgauaucccugaugugccaggcucagcuacuuaaacuugccuaggaagcugccguggaccguggcuucucuuuucccaccuggauguacuuuguacacucagauuuccugccugauauggcuuuuguaauacagauagcugauaucgucagguacuucccucuauucuggcuccuuguucuagacucuucugcucuguccugcugcuacccaagucuuggacuaacagcaguccugaaaauaaacgaggacaagcagugcuagcagacagugugcugccaaguccaaaugcaggucuaucaaguagugugaggaucaaaucuacaggcugugagaccugggcuuagacaucacugugcuguuucaucaguggcucuuaaaaggcugauugaacauaaaagagaaaggcugaucuucugaccacgaggccccagaaaaaagucuaccuaucaccaucugagugcuaucuacggcagugcaacuuugcugggagggacgucuccaaaaugcugagcacuguuaaugauaagaacaucacuuaacaaugaugugggacuuuaaagagccucaagugauuucacgcaugucaccucaguuguaaaguguuuuaggugaucuuuaggaagacacccuuuaaggagucugagagccugaguaucccauauaauuauauuccuucugugggaauggaaaggauuaauauacugugacuguuguuggaaagcaaggagugauaaacucucuguguugugcaucuguagcaagggagguauacauguacaaauacgucugcuacuugcagcuccuuuguuuacaauuagacucuguuauggauacaauuucuauaaaagaauaaagagaaacauaaacccucagaaguaagaaaacugugucugaugucacuacgaacucacagcuacagaaagugguaaccccucuauuauuuuucccaccacugacugagccuuacugauuugggguuccuugaguguucagauauugaagacucccagcuguaggcauaaggcagaagcagugaagaaguaguaucuggauauuacuugauacuacauuuuugggaaauaaagggaaaggaaagugcuuuggacuagacacugucucucaauguucuagguuuucuauuucgugaaaaagagaaaugaauuaaggucuauuccagagagggccugagguaucccuaauuuugaaaagucuuagaucauggaguaaaauagaagugaagcaauggacagcaaugaaggacuagauuuaaaaauguuuucaagacacauaggggaucagcuuccaacagcacagaauagccuagaagcacuagacuggcccugucucuagucaucagggauaggggcacgcccucuggacaaaggcacugggaagacuacaaguuaaaggaguuaaguugccaaugcagccaaguucuauaaagcauccuugggaaaaaaggucaaccgcuacagcaacaacuacaaaacaaucugucuuauuucaagccgugugugagagcuacuagucaggcacugcucuuuuuagcuucaucugugcccagggagauuaacucuaucuguagcagcacuugagaaaugcuaucugccauguaggaucugugugggaugcagaugaaaagaccaguagagcccuaacacaguagacauauaacaugguccuugggguugaauuauuuuauugaaugguuuuguuguaccucucccugaagcuuugcguaaaagagguguuuuuaaaaauuuaauaagaggaaauguuuuuaccaucuuuucauuucuaaaauucuuguugagguaauguugacccuagagccuuuuguuaaacaucguuauuuguuuugauauguuuccuuguugcaaagcuuuuuuuaugaagcaagaguucagauuaaagaugaacagaggauuuacugcaacuagaauaaggcgcugaacaauguucacuagcauucacauuuccaagcucuacuagugaugugaacuauauuuagaaaaaagacacggggucucuuuuuuucucugacaguacauguuuucugucauucaugcagcuauuuggugguuauauaguacacugcuuugcucuucaaacagaaacuuuaaaugcuacuauuaaucaggaauaucauuugcauacuuuuagucucaacuaaaauaauuuccccaaacuugagucuucagaagauaaugaaugcccugaaugucaauucuauuuauuugauauuuaaaaaccauguccuuucucagagccuccaggcacaugcauaauaacauaauccacagaaguacuucaagcagauaaauguaccacacaaccagaauuagcaguacacaaaugaaugacuuauguucuaccuggguagagcaguacaaaauaugucauucacaugguggucaaacaggaguauacucacguucacuuagggaguuacaaaaaugaggaccuaccauccauuccauucauccauccauccauccauccauccauccauccauccauccauccaucccauccauccauccauccauccauccauccauccauccauccauccaaccauccauccguccacccacuuauuuacucaacaaauacuaacaguauguuugcuauauucuaagcacuguucuggaugugucagugaacaaaacauaugaaggugccaguccuugugggguuuaccuucuaaguggggaagacagauaauaauuaauaagcauaauaaauaaaguauauagucuguuagaaggugauaagugcugugaaaaaagagaaagugcaguggggggaucggaaguacuggaguguguguaugguguggcaggugcaguauuaaauagcgugguuaggggaaguuucauucagaggagaagauuuggacaaagauuuaaagacaguggauuggcugggcacagugacucaugucuguaaucccagaacuuugggaggccgaggagggcagauugccugagcucaggaguucgagacuagccugaacaacauggugaaacucuaucgcuacuaaaauacaaaaacccagccaggcauggugguaugugccuguaaucccagcuacucaggagguuagguugaggcgcgagaauugcuugaacccaggaggcagaggaugcaguguguugagauugugccacugcacuccagccugggugacaaagcaaaacucugucucaaaaaauaaaaaaguaaaaaauaaagacgguggauuggcuguguugagggugaagauuucaaguagagagaacaacuagagcaaaggcccucaggaaggaggguccagcauauguucaagaaauaacaaggagaccaaugggguuggagcagugugugugcacagagaagagagggaaccaggggccagauaagugagggcuuauaagaccuggcaaggauugccuuucaaucugagggaaauggggagucaggguaugcauuugagcagaguugugacaugaucuggcuuacauuucagcagaaucacuuugacugcuguguugaguaaagcuaauaggucuuuucagaggcuguggaaguaauucagaaggaaggggcuaguggcuuggauaagguacuaaaguaaaggcagcaagaaguaguuagauucuggguaucuugacgguagaccagcauaauuuccugaaacacaaaauaaaaucauccuuguucucuaacauggaucaggaaucugucaguuuggugguugcagcugugugucaugggucucagcuugaagaggacuguauucguucaucgugugugggaacauaugggugacuggcagggacaggcuugcagcagucugugcucagugaggauuccaggggccuggaaagacucugcucagagauucaaggaauaauagaugaguaucagagagaaugggugauucugaaugauuuuaaaaucuggcacucugacugugcccuggccagucucccauggaccaucccuuaagaugaagagguuucaauuaaauagcuguaucaugaaacauuuuuggacauugagaacaaaaggaguaggcagaauuagcaccagcaacuuugucagcaagaagagauggugccauauugcagauauuggugcccucaacauugggcaccagcaguuggcaaugauggccacuuuggcaggcuucaguggcauuggcagaacauucaguuggcauuggcuaaggugcccuugaugggaagacacuggguaucauagccagagacacagacaucaguaccuuugacacauugggcaccugcagcucugaagcagcccuuggcauucauuaguggcagauuuggcaccuucagugaguaugaagaggacugagagcacuuuugguagguccugguggcacugucucaagcuguggugacagaagacaucaccacaauaggcuagagcaagagaggcagaaaagggcagaugucucauggucagcgguagucuaguuaacagugcacaugugacaggagacacuuugaaugaaucauuagaaggaauuucaguaaggccuagaauaugcagagaaguguugcucuaugauuguugcuguuauccuauuuugaagcccugguuggaguuccugaaaaccccuuuuauauuuauaguuaagggauaaucuaagaacuauuccacuaccauuggagugagaacagcagucacaacaaaaaauagcuugaucuuuaggaaaauguuuccagccucauagucuguuguaugugcgugugugugcauguguguguguguguguguauguguguguauguguguuugucagucuagaauuucuaauuaucucagacaauggagugacuaagaaucuucagcucuauuuaugggaauccccaguagagucacucuuacaauaguuuuaguaguuauuauuuauuuaauucaauaagaauuuuuaggcacuauagugcaucauauguauaacaucauucuagauauuguauaucuaggacaauauauauauaacaucauccuagauauuauauaaaugcaaaagggaauaaaguuccuaccuuccaggaauauguaauuuccuuggguauacauuugaaauacaugcaaauaaaguucugugucacuuaacaacagggauacaucagaauguguccuuaggugauuuugucauugugcgaacaucagacaguguacuuacgcaaaccuagaugguaucaccugcuaaccaucuaagcuauugcuccuagucuauaaacuuguccagcauguuacuguacugaaaacuguaggcaacuuaacauaaauuacuaggugauggaaauuuuucagcucuauuauaaucuuaugggaccucuuauauaugugguucaucacugacccaaauguuguuauauggcacaugacuguauacaaagauaagugccaguuuuuauaaguucuagaaaaaaaugcuagaguggauuggaaacauuugggugaauuucuuuuauaguuucucuugggguuaauauauggugaaguaagugauuguaugugugcuuguguguacauguuugucagagagagggaugcaggugggagggguggggggcagagagagagagagagagagacagagagagagaaagggagggugaauauggacauccauuucucuuuauugucccuaguccuaguccuaguccuagcaggcacaggcagcauccucugucugaagugacuccuucaauguccuaguuggcuaaaaacaccuguucauucuuugagauucaguucaagcaccauccaccugcccaaaaagcuuucccugauccccaugcauuuagcucuucucuccucuuguagcauuuuccacauaguauucuaguuuuugacauaucuaucucugucuaaaaugcaggcagaacuccuugaggcagggaccaagucuucuccauguuuccauucccaucucuggacuuagcauagagcugaaaugaauagacagucugauugaauggauggacaaugagcaauuugcuaaugaaugucugugcauggccguguggguguuugcagacguuaugccucuggaguugcucuagcuuccuuucaucuaccucugagccugcugggucucgggacacaagguaauuguuacuuuaugucuacaucacguggcacucagaaaagugaucuggcugaagugcaugauaauguaauugagucccagaggugacaggcagggaaauugaucucucuauauuuacugaaauaaucucuuguacaucuguggggaaaauuucacauucaaaacuuucuuaugauacauuuaccucuuaguauuuagaaaauuguaaauacaauccuuugccaccaagcaguagcuuccaaguaaagaagggguugaggguuaaaacuaauauaaugcauugaagaaaaagcuuuuaaccugucaggacucugugauucauaaauuauaaccuuagaaaucauuuaaaguguauccauuuagcacuuauaccuucaugaauucauggaacaacaaguaaagcuaaaauguauuuccucuugaagacaugaaagaggaaucuugcaguuucuuggguacucguuuccuuugauaagggcaguaguuaucuauuaacugaaugucuauuuacuaaaauacaaagcaauagacuugugugaaauaguaaaaauggccagucauuuuuuccccaagaugaguaaauugaugggugauuccacagaguacagagacggggcacuccaguaauaggaaguagaggaaagcaguuaagggcauagacucuggagccagccuggccaguuucaauccugacucugacacuuacuaguggugugaccucaggcaaguuacuuaacuucuuugagcuuuaauuucuucaccugcaaaauagggauuuaauuuugagauuuaaauguguuaauuuagaguuaaucugaaguacuuagaauagugccuggcacguaggcaauuuucuauuuaagugauugcuauuaacauagggguuuggcccagaaugucuuucuggcaugcugaggaacaucuuggggaacguguauucuuuagauagaguucacuauggauccacagaagaccaaccaucaggcuagaacccaaagccaaaggauagguggaaggacuacugguuugaaguagaaaaucucauugauuaccgccccuccucaucccccacaaaaauaaccacaaagaaauaccacguaaugaaacagugcuuagcuuagggaaggaagaauaguaacuaugucacuuguuuagccugcuucauuaagcucacuauagguauuuguuuggguuugaaauauuugacucauuauagcuugaaggacaaagugaugaaugaaauuuauagcuggauugauggcacuagcuguauuucagcuguaauaaccagaggaugguuauuacgaaugagaaaaaauagcaucucuaucugccuguuagcuaaacauaugcuuuggaucacuuuuugcuuggagugucaugaguuaucacaaacuuccacaacaaagaaguuuucuuuuuuaacuuugaucuauguauuauuuguuuuuuuagagacagggucucauucugcuguccagacuggagugcaguggugggaucauagcucucugcucucuaacugcugagcuuaagcaaagcuccugaguagcuaggaguauagguguguaccaccaugccuggcuaauuuuuuaauuuuuuuggagagacagggucucacuauguugcccagccuugucuugaaguccuucccucacgcgauccuccugccuuggccucccaaagugcuaggauuacaggcauaagccaacacgcccagccacaacagguaaguuuuaaagguacauaggaauggcuuuuugauucaucugucuccuucuccaggaaccuacuccugauucccugaacagaagagaccuucccuuuuacuuaacguacaaaacuuguuauuuuuacuccuauuauagcuuguuucauguucugacuuguacuauauuaagaucauuugcauauuggucugacuuccuuugcuagacuaaaaucuucuugaaggcagauacuguguaauuucaucuuauuuuucuccuugcacugugucuugggacauaaguaaaugcucaauucauuugcagacauaacuugaacagaaauaucucacuugaaugccauugauggaaaauaagaaauauagccaaauucuauucaacaauuaaguuagcacuuauuucaauuguaugguaaaggcaggugacaaugccuuauucaaaauggcgaauaugcuguuuuacaguuuucguguaaaugcacacaguucugcuuuucugugaaaucacaaugccuuuagcaacuaaauggaacuacacugucaagaucugacugcucagcuucucaguucacuuccauuccauucuaugcuauguauauuuauauugaguccuugcuucuaagagaugcagacaggaagaucucucuguauuaggcuuauucauuuaaucucucucuuuuuuuuuuuuuuguuuuuugagauggagucucacucuguugcccaggcuggagugcaguggcgggaucuuggcucacugcaagcuccaccucccggguucaagugauucucccgccucaggcacccaaguagcugaaacuaaggugcgcgccaccaugccaggcuacuuuugcuauuuuuaguagagacgggguuucaacauauuggccaggguggucuugaacuccugaccucgugaucugccugccucggccucccaaagugcugggauuacagguaugagccaccgugcucugcccauuuaaucucuuaaauagggaggcaugaguuaugacuuuaaacaccuucucuucuagcuucugauggacuaaacaauaaucuuuaaauacauuucaaaauuaucaguuuaguagaugacaaucaaauuggaaaguuuugccaguuucuuaucuagaaaaugaauaacugcacugugagaaacccacuagcucagaguagaauguucacuaugcaaugcagucaugggcauuuuuagucacggacucucuuaggucaguaauugaguucuuuucuguuacuucuuggcuccaggcaaaagcaacaucaaaaauguauugauuuuuguuaauuuagggagaauuuauugaacaaaugcaaguggucauaacuaauauugaguuccucuaaaugucagaaacuucauaugcauuuuuguauuuauaucucacaaugaccuaaugugauaaguuccacuauuaucuauuguuuuauagauaaggacacugggauuagagaauuuaaguaacuuggccaaggugacacaagcaguagguggcuaaacugggauuaaauuagauuuaacuaaaagcucaagagaguuauuuuuugagccccugcaagauugcaaguuccuuaaagaugacuuaaguggauuauuuagcuuacucaucucauuauccccuuaguauccuuagggugcuuugaaguacagcguuuagacaauacaguggggugguuaagaaccucuguuaagccgccucaguaugaauucuaguuuauccaccuaaaacagcauucacagauucccaucauuuucuguccauuucuugcuuaauaguucuccauagcauuuaucauuaccugaaauuauauaguuuuacuucuuuuuuucugggucccucacuagaauuuaagcugcacgaggacagugaccuuguaagucuugcuuccuaacaccaaauucucaauagcuaguacagugccuggcaugcaguaagugguuuaaaaauaucuauugaaugaauaaauaaaaggagauacauuuugcuuaccguuuaugccuggagucguaauuuucaauacaauuaaugggccaaaugaacccuaccuuuuuucuugguucagcuucaaaccuucuuuuuaaaaguguauuuaauagacacuaauauagcacauaugcuuuggaaaacuccauuuuaugugcuuuacaaauauugacccauuuaauucuacagagaaggugaaaucauuacauccauucuaaaggugaggaaccaggcacagaaagauuuagaaacuugcccauggucagacaauuaggcaaagaauggagccaagauucaaacucggauagucugaccauguucccaaccauuccauuaugcugcuuccuagauuaaucccauaaaaaugucauuucccuggaguuuaaugcucuaaagaugugucuuugcucucuuagagaaugaccuuccaucuugccuauuuuuccuuccucucuacccagauuaagaaggaaaauaaauuaagauuauuuuacuuauugaaacagcacaguaugcuaucagugaagcuucucucaggcuaccuucaaggauaaauaagugaaugaccccgguggcugcuggacagcucacauggccuauaucugcuuuucuucuuuuucauauuugucuuuuucuuguauuucuagagcucuuggauuccugcugcaacccuuccuucuagccuugagaagggaguucagugguccauggaggcugcaaaaacugccuuuuaagccugaaauguaaaaggaaggccgauuuuauaaaugauuccuguucuugcuuuuagucaauugguucuuucauuuccugucccuuuucaguuucuuucacaaacacacaagcaacucacagccuugggucucugauauagcaccauauucacucaggaggcaauugucaugagcacagauaucugggauuuaguuccaguucaguuacuaaggagcaaucuuccuuggggcaagucauuuaauaggacugggacuuaguuuccucaccugugaaaugacuccagugagaggaagagcuggagauuuaaaggucccuuccagcucuaaacugugauuauucuuugacgaauuauguaaggaagggaaagugcucagauaucuaaagcccuauuucucucacuacagauugcaggauaacuccaagggagccacuguucuuuauuaaaugggggugaacuucucagaauugaaggaugacggcugcuggggauagcaauagaucagaaccuauuuuccugccuaauuccuucccuauuucucuguaaauaucagaaggagauuaggaguaaaagugauauuucagcucuguggucuacauaauaaacgauuccaagauaaauucuuaaaaaaaaaaaaaacacuaaaaaguucugccucuuuagcuugggaagaauguaguagccaucuugcuuugugaaacugcacaaaaaacuuggagcagagcauggguaaguauguuugaauugcgugcucucacgcccagcaguuguuuaaaaaucuauccagcccauacaguuauugcgauuuugcauuuuguacauauggggcuuugucauuucaaagggugcaaagagcuucaugaacaauggccauuccuucucucgaugugaccccguagaacagacuaguuauuggucaucacuuguaaacaggaagcaugaaucucacccuaggaaaugcaggccgccagugcugucaugcuuacaugaaggacaugccuuaucccuuuguaaaacauuuaaaaauaaaggcacucaguuuggaaauaucuuugagcauccuaaccugacccauucagaacugaccucuaaucagcauuuuuguuuggcucaguccagucuaauaaauauuaacugggcauuacuauguucaugaucugugugcuccauaccuaggaaaggaagaugaacauggccaagauccuaaucuugaguaagagacaaauuagucaacaggugguuuuuaugagguguaaugggaacacagaaggguuaaaucaucuaucccagagagaagauguuguaaagauuucuccaaggcuuaaguauuaaggaaugaauaggaguuacccaugggaagaaggaugagaguuaagguacagaaggagaugauguuucuggcacagaaugacuagauucucaggaauucuaucacauauuccuaggaagagagauaauacuucuuggccuaauuugcaguuuaaugagggcuaugaaccugaauccuggugaaucaaaugugauuuaaaguaagugaugcauuuccuguccuggcaauagaacaucccaagugaucuucuauguuccucucuacccugcugucauggcagcccacaaagaacuccaggauggaaggguccaugauggaagaagccagggucccugaauuacugguuggaggagagcugccugacccacacuggacuuagcaugugugagaaauaaauuuaacaguguuaaaccacugagaauuuggagcuguuuguuacaguggcuagguucauuacccugaucauacugugugccaggcuaaggaauaauaaaagggaucugaaugacuugcugucacuucaacauuuauauagcccaaauaacuuagguuuuugaccuuaacauugauuacucuuucuuccuuucucauccaauggcaccaaugauuucuuucuuaaaaaggugaucuuuuacagucuuucagcaagucaacugcuccuccugaguauauuaucagcaucuugugucuuuuaaugacauuugucuauuguauauaauuauauaacauuauaucuauuauuauaucuauuauuguauaacauauauaauauacaacaaaaaauguauuaucguauauauaauauauguuuuauauuauauauacuauacauuuguauuauaaaauauauaucauauuguauauaauagguuauaauaggaauauaauauguuaauguuauacaauauagcauguauauauaaugaaauaucauuucaaagguaucucuauauaaaaaucaauuuuucucauuagaauacacauuuuaugagggcaagggcuucaucuauauuacucauuacuguaacccuagugcuaagggaaaugacuaguauauaguaagcacucacaguuauuuucagaaugaaugaauaaagauaaauauaauagaauagaggcuggguuuuuuaaaagaaauggacuucagcuguguucagauguaggcguucugaaggcagaaagagcuccaaacccagacgaggguugacaguugcucauaugaaggugauagcagaagcuaugcaggcaaaugaaggcgccucaggaggguaagggaaggaagaagaugagagaauuaaggcugaauuuuagggaauaucaauguauaaaauagacuaaguauaagcagcuaaugaaacaauauuagaaaaaguaaggaaaguaaagagaguauugcggcacagaaacagaacucuguaagaaucacaguuuuggggucagaucugugaguacagcauauucaauaaacaccugucuauugauugaaauaagugcugaacacugaauagcauauagucccaugaagauggucaaaggggcugacuccuuuucuaaaagacauauagccaaugucaucccuguuaauuauacacauuucucugggaugacaucaggaggcuuggguuacccuggggccuuucacuagucugauaaaguaggcuauauuucugaucugaguucuucccuguuuagaagauucucagaaguauggaaaaguucuuaaucuagcuggauauuuauugauaaguuacgggucaguaaacuaugccuacagucuaagccuggucuauugccuguuuuuuuaaauaaaguuauuuggaacacagccacacucauucauuucugaaucaucuauggcuauuuucacucugcaacaggguugaguaaccacaauauaggacauauggccagcagaguauaaaauauuuaugauauggcuuuucacagaaaaaguuugccaaccccugagcacugagcauaucuguuuugcacccccggcaaaaaaacaaaaaacaaaaauacaaaaagcaaaacaaaaaaaaccccacaagacauuuucagaacugaguggagcuuguaagaacccugggaauaccacagccugucuuacuaaggacuggaccuauaggaaauagaauauucugugccuucggugagacugggucccgucauguauuuacuuuagguuaggaccuccaugcuaacagugcacguaugugggugugagauucucuuugaccguguaucuuuaacugauguccacugggugguaggccaacacugaguggcagugaguuuaagacaugcaauaaaaagaauaaaaagaaaugcaagugaaaagaaugaggguagauggagagugagugaugggaugggagaaugaaaauaagucgcccugucaaaagguaccaugagagcaucuaugccugugggcuauauuuugucauugcccuucugaaaaauaccagaagaaauaagaacaaguuucuaucauuuuucuaagugacagggaaauaagacugaaccuuccuuucuagacuuuuaaagaaauaacauugguuguacacuuuuccgcuaaagcguacacacaucugcgucaaccaucaagccuagaaucaauaaacaucugaauguuaaggacuuagagagcacuagcgucuuuaagagaaugacucuguucucuugaagaugcuaguucuuucaagguccuuaaaauuaucuucauagaaugucucuguucucuuaaagacucuaguucuuucaagguccuuaaaauucagauguaacuucuuugaaagaaugucacauuccuaauacuccuuucaaaggcugaaauaaccugugaucucaucauauuaagacauuucuagagugauucucuucaucuaugacauagggguagcagagugacaccuauaaccaaaucuggcccccaaugcuuuguuuuguuaacaaaguguuuaugaaagaaacccacaguuuuuuuggggggugaggaggggcaggacuucugcucuccagugugccacaguuuccaccacuccauauugucuuuucuuuaaaaguguuugaguuuucaaucccuacaaucucugcccacaccauuuugagggggccaacuguugcuuugaucuauuuucuucguucaggccuaaaauuaaaugaccacuuguaacuuucuagcuauguuaguuuauuagaacccguuuuauuugcuaacauucuucaaguuuuguccaauagaguuuaguagacucacugaccuaauauauaugguaaaauacucuuuucaguaaugaggcaacaaugaagaauaaauacauuuuaagaaacugugcuguuuuaugggauuacugauuuguguauaucacuuagaucagugauguucagguuaugaagugauuauguacaauuugcaaauaucuagugucccuaacuucuguauuaucuuauaucaugcuacauuauaccuaacucuacagaccagagacaugugccucuuuuuugaguggcaguagcaaagguggcucuuaaaucaucugacugugaacaauacagucccaggaagauggcccaaggaaauaaaggguguuuuuuuccuuguaguuuuugacggauuauuccauuuuaacuacaaauguggacaauggaaacuaggcuguaaaguagaucauuauaaaauguaccuggccaacuucuaagauguaccccacccugcccgcccuaccccaugguccccaccgucugguauucacgcccuuguguaaacaccucuauuauguaugaacugaaucuggugacuugauuguaaugaauagaaaauggcaaaaagaugggaugucacuugugugauuagguagcaaaagacugugacuuccaucuugcuagcacuuucuugucuucucacuugcuuguucuguugaagcuagcugcauguugugagaugcucuauguggugacaaggaacuaagggaggccucagccaacagugugugaggcacugaggccucaguccgaaaaucccuaagagccugaauccugccuacaaccaugugagugaguuaggaaguagauccucuugacuugagucuugagacagcuguagcugucugaaagauccagagacagaggacccaaucaacauuguaccuggauuccugacccacagaaauugggagauaauaaauguuguuauaugccacuaaaauuugggguaauuuguucuuuaacaauacagaauauaaaucaucuauuggaauaacagcaaaaauuuuuuuagccaaagccucaaacugaggauagagaaggggguaauuuaauccauucauucagagguucucagugccauucagugaaaaaaauaaauauauguagcuccaauaaauauugguuaaacugagcagaacucagaaguaaagggccacuaaaauucagguguucauuauguaguaaaguaacaguagcaaugaacaaaagugaauaccagacgucgcacuaagaucaagaguccugugauaacaauauuuacuagucaucaaauauuuuuggguuugaguuuugaggaacuccaggauuuaaccgaggagaaugaguaggcagagagacaacagcagagaugcagagaguaacuacguauuguggaagccgaaagaagacaauguuaauagugaaaauuugccccaugggguuaacaagaauccuugagcuugccuugcaagaagacagacgaagaaacagcuuguuauaauucucucugcuugcaacaaaacuggcugacuggcugaaacuggcuggaaccaauaaggcugacuggagucagaauggcacagaauagacucgcucuccuggggggugacguuuugaugucacagccugaauuuccacgucauguuucagaccaguuccccaugaauuugcacaggcaacccacggaaaagcacgaagggacaacugcgcaugcucaacggacuuuccaaacuucccauuccuuucugccaaucacuaaccaaccgggaagccccgcccccagaaucucucccuuaaauauaccgcuuuaaggcugguacagggcgacggauuugaacuggauuccugccuccuugcuuggccgccuugcaauaaaccuuucucucuacaaaauccagcgcuucaguguuuggccgcaauugugugcaggcaaaugaacccaguuugguugauaacaauaauugucaauaguaucagagucugcugaagucaaaguaggguggagauaacaaagggcuuauggaauuucugaucuucugcuuacuggugaccuuagcacugguuguaggaggucgcagcagagaaacaacucaagcccuugagggauuaguggagcaaaggaaauggggagacguugaguauagacaacuacuaaguaauuccaaaagguauuauaaaacuggaaagcauuagaagaagaaauauugaaaaacagcgugagcauacaauauaaaaguugcuuaugugcugaaauauacugucaacucagguugagggauaugaagagagcagaugcgauaugagccuugacacaaaguccugcaaaccuuuaaaaugaaaauccuuugaaugccugaccuucagguguuauauuaucaaaggacagaagcguuuaugcccuuuuaaaaaggaaaauguauuagaggauuauccaaagacuuggccacauacaauucuuuucuggaaaaaacuaaguuuuauguugaaaauaaguaaucagguaauaucccuguguccaaagagacagaaaaagcacaauaaacuuaacauuucuaggacaguagaaaaaaagccauuuucuuguggaacuuuggguuuguuuccuuucauaaaaagggaaaaaggugaaauuugaucuucaagaaguccaggaaagcuuuuagagcugagaaaagacagaguugggguuggugagggaaguagacucugggugaaaacggauaauuaagcuuuacaaaaggucaagcauugcaaaagacagcgagaaagaugcauucuauguguugaauguaucaaauguaguugagaagauguaaaucuucgcauuggugaauauuucaguauuaaaaaagacauauuaaagaauagcuauucuuacaaaaggaauaaacuuuuuucuuugaagcuugacacaacauauacaaauaaaagcaugaaaaauaugcuuugaagugugcuaacacaucaagauuguacugagcaaagcaccuuuucucuguuuaggaacaaucucacuaauuccacaacacaauauguuaauuaaaggaucccagguagcaaucauggaauauuucuucucaugacagaugaagaauacaaauauucugaagacugaaauuguauaaacaaaaugaagagacauuuuguccguuuucuggcagugcaaaguuaaagugaaugcagaugaaugugcuggcaauaaaaugacacuauuaaccaucugaagaucgggcucauuaccuaagaaggcaaagcaucaauuuguggcauuacaacauucuauuugugcugcucaaugugcgucuggauguuuuuauauacucucuacuaauuugugugcagagugagcucuucugcaucagccucucuauagaagcuuaauuuuguauuguuucucuuauauuauuuucucuaaugagaaugauauucuguauuagaaauaaacacuucauuuauucuucaaauaauucuacguucaguuucucuuguuuugcauuaucaagugguguguacaggauuacagauauaucuuaaaauugaggugcucugauuaaaaauauacauuugaaugacaugugaggaaaauauucauucacucagucacucacucauucauucuuaaaagaaugucuauguauuggguuaagcaucaugggaaauucaaggauguugcacugucucugcccucaggauguuuauagcauagaaguggcugaauguuauuaguaccuugagauaggaacaaggacagggccauaaaaucucagaggaaagggaaggucaguguauuuucucauaccacaaguauuacuuggguaccuacuaugugacaggugcuauucuagaggcuggauauauagaaaagagaauaagacagucaaggucccugaccuuauggaccuugcuuccugagggugagauggaaaauaaugaagaaaaaaagcaaauaaauaauauaacuucagaucacacuaaguggcaugaagaaaaauaaagcagagcaauagcaagaacagugaugguaagggaaggaugugaauuuuagcucaugaaggccccugugaagaugucacauucgaauagagauuugacaauguauaggagcaaguguaugaaguucugaaggaagggcuuucuagguagugggaccuuuguaggacaggauaaagacuuuauucuaagugggaaggaaauucacuggagaauugaagcaggguauagcaugaccugauuuauauuuuagaaggaucauuccagauacuguauagaaauucaauuauagagggguaagaagguaaccuggacagagguuaagcaucugugaauaguccaggauagaggagaacaaugagaacuugauucauguagucuaaccaaggaugacagacuggaaugcacugugguaguccaucuagauagaggugguuggugaggacuagguugauaauuacuuagaugguaaggagcgguuccauuuugaaggaaguugcacaaaggaagugauaugauaugauaauaucugaguugaacuuuaaaugaauggcagcaugugacaaagcaaguagucauucauggauuuguugagugcuuaucuauuuuuaugaaccaggcacugugcuaggugcuauagauacagcaguauggaagccauugcugaaagugagaacaacaaaacuugcugagaagguaauauuuuaaguaaacauacacaagcagagaggugaacaauaugcucauaggaauuacuuccugaauugguucuaaggauguuuuauucuuuuccauuuaguguagaaaauuaugugauuaaacuccuuuguauauuuggcucagugaauuugcaaaaggaguaagugucuaucaguagaaauucaauucacugucaguugggaaauuucaucagacaauuuccuuagaaauaguggcuaauauuuacuuuucccacuuagggagggagaaaguauagccucucuagaaagaauaggaggauaggagaguacaaaaccuaggacaaucucaaauauccagguguaucuauuacaguucaucugccaccugccuccaaucugccccacagucuuuuugcaaacagaugacccaacuucaacuuucccuccuucuaaucccacuuguacacugccucuagaauuaacuggccuaaaguaguccagucauguccauuccccagugccuacagaauaaauuucaaauuccucagccugacacacacugacccaaccuacuuuuucugcuuuaucucugacuacacacuucucaauuguuuuaaucaccuugaauuuucuuccucuuuuuaaaauuauuuuuugaauugcaugaauauguuaugaaauacacauaacauaaaacuuaccaucaucgccauuuuuagguguauauuucaguggcaugaaguacauuugcauuguuguacaaaucccauuggauuuuaaaugucuauuucccucauacuuccagcaauuuguugccugaaccaaauuuguuuuuauaugguuccuggggccuccugaaaugccuuuucccauccaaguacuaaccagacccgaacuugcuuagcuuccgagaucagacgagaucgggcacguucagguugguauggccauagaucugaaaugcauuuuccuuuccuuaucaauuaaaaucccacauaucugaaagauucaugcucagauuuugccucuuccuuuaggcuacuuugacaccuuaucuggaaacaggaggucaacucuguugcuagguaacacacugcuuacaguaaaaaugaugccugguugguaaauugcaucuggacuaggagggccuauacaugaacuauaaauacaugauggggaugugauacuuuggacuucccugaguaaugacucguguaauuaggucccuuguagggaccauggaggauaagucuauggaguuguugcaggagauaucgucucuuauggggcaggaggcuuuuaagccagggccauuccugcacccacccaauaugaaucuagucuucuugaaccugagcugccaccuggggggccagaacugauauuuguacugauauuaggacucucacugaagagaaaaucugaagcuucccugguggccagcaguguuuucuguaucacauuuuucuagguaaaucucaagcuaaggguucaugccuguaaucccagaagucuggaaggccgagguggguggaucaccugaagucaggaguucaagaccagccuggccaacauggcaaaaucccaucucuacuaaaaauacauacacacacaaaaauuagccaggcauggugguguguacccauaaccccagcuacucaggaagaugaagcaggagaauugcuugaacccaggagguggaaguugcagugagccuagaucauaccauugcacuccagacugggugacagagagagaccuugucucaaaacaaaaaaacaauaaaaccucaagccaaguguggcccauaguagucucauaagucugaaugugcaguuggaccuaagaagaucugcucuugagguugcaucaauauguagaacuacuguacuaaauacaaauacuccuugcaugccuggacucaaaaucacugggaaccguacacaggacuagggcaauaaaaguauugcucaccuuuggaaggagcuggauugccuguagaauucuuugucugugcccagaauuaaggauuccaauuuccaacaaauccugaucuuccauaacauugcuucccugaaacaaaacagaaauguuacaaguuaaaucaagcauuuauacuguggauaaauaacaaggauuuauuuaauacagagaaaaccagugagugaccugauuuuuaugaacaaagacauagagucauucuuccgugagggugagggcagagucggucaccuuguuacugaugugaagucuaggagaaagcuccccuccccucacaaauaucuaucguggcuuauauccacaugggguuaucugcacuggagauucauucgugugacuuaaaacuuuguuucugcacauugugcacauguacccuaaaacuuaaaguauaauaauaauaaaauaaaaauaaauaaauaaaaaaagauccaaaaaaaaaaacuuuguuucuguaaaaaugugaaugcuucuaguaagaguugccauuuaagauuaucagugacuuacacauugauaugaaugaaucauuuuuccccccuugaugacagauuuugugcggaaggcugauagaaaaauugacauauauuaggcagguuaaaagugagaguuaauacuuaauuucaaaauauugagucacaauagcaaacacauagaaucaaccuaaaugcccaucagugauagccuagauaaagaaaaugugguacauauacaccauggaauacugugcagccauagaaaagaaugagaucaugucauuugcagggacauggauggagcuggaggucauuauccuuagcaaacuaaugcaggaacagaaaaccaaacaccacauguucucgcuuauaaguaggagcuaaaugaugagaacacacggacguagaggggaauaauacacgcuggcgccuguuggaggguggaggauggaggagggagaggaucaggaaaaauaacucaucaguacuaggcuuaacaccugggugaugaaauaaucuguacaacaaagccccaugacacaaguuuaccuacguaacaaacugcauguguacucuugaacauaaaauaaaaguuaaaaaaauuauugaaugccagacaccagaucacgauaugaagauugaaugaugaauaugaugcagggcccuacccacaacugccuuuauuccuuccagucccgugauggaaagggacuguucaaaggcaguuagguaggaugcugagacugugcuaugauggugacacuugcuuaggaguccagagggaauccaggguauuuuuucagagaaaaggacaucuaaucagauauaggaaaaaugggugguuaaggcauagcaccuaaaagaggaaggacaauggggaaauuaugugcaaagaccugugaguaagaaggaauguaguauacuuggaagcaucauguucugggauaauauggagagaggagcaaacgguaaggcugaaugaguaagcagagggcagaccauacagauauugcaugccaugcugagggcuucagacuuuauccugaccauaauggguagccauggacagcuuuuaagaaagagaguuacaugcugagauuccaaauuuagaaacauuauuuugauuucuggggcugggccucaguuucccuaccuauaaaaugauaaaguugagcccacaauguccaaggaccaguucaguccuaaaauucugauuucaaugguuauuuuaaaccugugauuaauauuugaaugcagaaguuuacauauugcucauuuuaucccuagauuuuaaucuuucacgguuuguaagacagaguuucucuuuaaauugaggcgucuauagagguucaagaauucagaucacuauuuuuuuugacaaaucaaacucuguccuacuuauguguaacacaaaaacgcaagaauagaaaugacagaauauccauuuauuuagugaugaguaccauuagacacucaaagcaaaggagaaugaauuugaaagggugauucuggggcauggagaccacugugguuguuuucuagaggcgcugugggcauagacuaacguaguagucacaggagcaaaaagaagcagguggauuugcaaacuaucaggaaguuugacguggagauugaacauguggaaugaugcagaaauguggaauacacaaaaauucaaggcuugggcagugaguggaacuugaugccuuuuccugccauaauaaaggaggaagaacagcccugguggggcgcaaagugagacuaacaucuuucccuggacagggacagaauagaugcauguaaacaacuuaauaauaucagacuaugcuauaaauggauaacuggcugugcuuagaaggauuaaagccacuggaauggcacaacagcuagggauuuaaaacgggcauucacuggacaaaagcauuccaccuacucauagugucauucuuaugcuuaagcaacaccagccaucucggaggaagcagaaugauccagguauucagcagcaugauaaugaaaagccuaaugaaaaacaaauaaagccagucuuggcaacaugccacaggaaauauugcucucaagaaauuacucagugcacacaacagagcauggcugagaauacaaaugacuucauuuagagaaagcguuauuauuuccagaaauggacuaguauggcaugagcgagauaugugauaccauucugacuuuuacucuuugaggaguuaccuggcccuuaagaaaaaaucuuucgucaucuuugugcuagaacauuaccagguuuuccagguccuaacuuaccaacccacaacuucagcccauguagaauagaggaccugguuuuuuugcagaaacagaaagcauacgaauaucccauagugugcauagcuacuaucucuagguaauccugacaacuggauuucaguguuugaauacugaaauguuuugguaaauuaaauccuaaagaucacuguucuuccucuacaccuccaauaugcuauuuucuguaucucaguaagagaggaguccuuuugaagaauuauagggaaguuagauauuuuuaaagaagguguugaguacauaagaacaucuuuuugagccaaauuuccuagcauauaggauaauugccaaacauuuuugaaaaaugaaccaaaauuaugggaagcacaagaaaaauagugaaaaugugucaaaggggaaauggcacuaauugggaaauggaaaggaaaggauuuacuguccccagugaggcaugcuguuagaaauuuucuauuuuaucuuuuucuauaauacauagggaugccaaaaauauccuaguacaucauucagccagccuuuuguccaaacacuaggggacuuggagucugcagaacuggguuuggaucauggcggggcaaacuuggcuaagucauacauucuuuguaggcuuccugguccucacccaccaaaugaagcaguuuaaugaauauguauucaguuucaaaaugcuaugauuucagccauguuugauuuuugguugguaucauuauauauaaauauagauuguauauuuugaaauuauguuucaguguuucagaauuuguaaccuaaaauuagcuuuaagaagugauuaaagagaaauucaagaauauauauuuuuuuuugacaaaucaaucuugguaugauggacuuauaaaauuucuuauuaaaggaaauuauaagguaacuuauuuuuguaguaguacggauucuuauagcuuuucagggaaaaacaaaauguuucaaaccuuauaacuaucuaaccauuucuuuggcaccugggugacaguugugccaucaaagacaauaaacauucccauucuuccuagggagcuggaauuaauucucacuuuaucacuugccuuuacuaaaugcuagcaaaucucaguuuaacuucuguuuuuuuuuuuuuuuuuuuuuuuugagauggaguuucacuguuguugcccaggcuggagugcaauggcacgauccuggcucacugcaaccucugucuccuguguuccagugauucucaugccucagccucccaaguagcugggauuacaggugcccgucaccaugccuggcuaacaggguuucaucauguuggccaggguggucucgaacuccugaccucaggugauccaucugccucggccucccaaagugcugggauuacaggcgugagcaaccgcucauuuuucucaauaaaaacugaacacaacucuagcuuucuuccuccuccaucauuuuuuuuuuucacauaacuuuuaggucaaugauuugggggcagagcuccgucauguccaucuucuguuuagucaucuacuacacugcacucucaaucuccuuuccuacccaguacacuccagucccauguuuucaucucccauuuuccuccucaacccaccagaauaagcuguucccccccaucaacuccauagaacuucucugucaaauguuaagaaugaccccucaauugccaaauauaguugauucuuuuaaaucuugauuucaagaauuuacuugccauauguaggugauggccaccauauuggacaacaaagauacagaacaucgccaucauuguagcaaguuccauuagacagugcuacucuacaguuagagacauugaaacuuuagucaaaucacaaaaauggggcaguagcagggaaucaaaucagggacucaaaaauacucaugaguuuuucucaggauguaguuauucaugugccucuuagucaaaguucaugaacauuaaguuuaggaucuuuagcaaauucucuuuuaauucuucagucaccaaaagaaauuagaagguuguucuacuuucagcaacauuucuuuaugguggggcuauaaaucuaugcuaugaaaaugacaaguccaaucacuaaauuauuuuugacuuucuuagcauccaccaaucacacugcauaagguguuuaaauaacaauaaucaauaaauaaaguuguuuaguuaaugacuuucuagaaugaucaaagacccaaaugcaguauuuuuagaauagcuguucuuugccugucaagaaaugucuaaugcagggugucuuuauugaucucuuaaaucauggaauggaaaaagucaccuaauguuuuaugcacuaauagcugaaaguggaaguuucuuugaccacggggagaauaucuuagguacugaacuucuucagcugugauaaacuguuaggaugcccaaauagaaugaaaagcaguguuuuguauuuaauuauucauuagaaguaaaacagcuauuuaccaaaaacaucucaaaaauaucuguacugauggcucugucucuccaaacucugcauuuaaaauuucuuguaguuuuuuaaacuuaauacgauaucuuauucauuuagcaagcuuuccuucauauuauauauuguagaaaauguuaggaaaauauauuuaaggaccacagggaacuggcuuauucuuaauauaaacuugaguuggauaauguuauuuauucucuuccuucauccaguccaagacuaaaaaaaucaagaugauacuguugauuggggaaacuuguuuuugcucuauaauuagcuaaauuagauucuucuccacaauuuaugugaccuuaaauauuuaaaauagaaucacuguauaauagaaugacagcaagaucuuacaaacuuacacauagaaaaacauguacuuuaguuugcuuuuaauauuuagccuuuuauaacauaaauagcaugguagcaugaaacuguacauaauuuucuuggaauaacaaugcuaccucucugcuucuauaaaagcuuugagucaauuugauaucaauuuacaaguaaacccaaugcaugucuucucugcaugauuaugauaaugguuauugugcuaaauaccagauuuauuauuccucugucaguguuggaacaaagcuuuauuuagcuuaucauauagaaacacgggugacuauaacugaucagauaauggaugaugugcuucuuccaacuuuaacuuccucucucacauuaaugaaauggcaguggaagaaaauucuauaguacacuaaaaaaucccucuacccuaauccuccauuuaaacauauucugucuaccgcaauaaaauuucuugcauacaacuuaaguaaauuuucauguuuuuagcuuaugaagaaagcuuucuggauucuucagacuauguggacuauugauucaaaaaauauuacaucacugaccaauaagacaucaucuuauaugugcaagcuguguauuuuaauaaauuauaucuuaagguuaagauauaguuuagcauuauauauuuaacagcuaccaugauuacaaugaauuuucugucaccgauuuuuuccucuuuauuuuugaaacccaauuccccuuugaaacaucuguugucaagcuacagagaaagagaaggaauuuaaguaaccagguauuuauuuguuaaaguaucgagcaggauuuggugauaucauaaauuauaaauguaauucacuugagauguguucauguagguuuuagaauuauguguauuuguaaaagagugcaaaauaauuuauacaguaauuuguacugccuuuggucaaaaauuuuauagcuaugagagaaggagccuauucuucauuuuuaaggaugcuaacccagagcuccuucaaguaagaagaaaaguugaugugaacaaaacuuuuuuguaugcucuuacuucucuccagaugcauauaucuguauaaauauaaagcugaugaauaccuacugucuuccuucaacuuucacacugauagcaguugguguucauuaguguaaaguaaauagcacacuuacugugucaggcacuguucuaaauaccuuccauauauuacuuuauuuaauucucacaauaacuccuaugagguagguagcuuguucccauagcugauaggagacuuucucaagacuuacccuauacuaccucuagcaggaaucaugcaggagauaaaagguugaguuaaaaaaacaugguuagauccacaccauuuauauuuuuacuucagagucaucugaaauucacauuugaaagcgaguguuccaaugcauuuauguuugauuucacaguaccgaagcaacaaugaacccucucuauggaagagaacuuggagagcugucuggccuaaucuucccugcuuugcuccaguccuuucuguucacugaauccuggaaucaggcuuggcagggaccugggggguuucuaguuucuagucuaaacguucccuaacuacccacaaagcuucaacuucucuuuugaaguguggugucucacuggguugacaccauccccagagagguagggaggauauuaaaugcuuuaaauggucuuucccagcagcugagucugagcagggggugcggcugggguugggguggcaccucuguccuacucuuuuagcucccacugugguacagaccaaguguugcaggagagcuaucugaagaagaacgugccagaagcggagaugaaaggaaaacaguuagcagcuguccuguguccuuuuguaaucacaagcugugaagcugaaaaaaaaaaaaaaaaaaaacuuccuuggguaggcuguacauaaucuuggcagauaucugaguguuguucuucugucuaauaugcugaacguuucccagugccucacaagagaaaagugagacaggguuaggugaguuuggacaccuugcuccgaacaggcagggaacauggcgcccuuguacguucaucaagcucuugcaaaugcccugucacuguagaugcugaugcagagcuccaaaaggaagggcuccucugcaggagaagcaaaaagaauuugcuccuggguauucccaacacagccacauauaaugacgcagaaagaaguaccuaaaaagauuaccagccauuacauucacuguguagcagguacuucacccaccuuauuuauaaaccuuacagcacucuuguaacauaggugguauuauuuucaucuuauagaggaggaaacugagucucagagaugugacacuauggagucaaguucacaagauaaguauaggauggaucugggaucuguguuuuauuuggucagacucugaugcugaugcuuccuucacuacauaaaaagaaccaaauguuuaguaggggacauuuucuggauggagauuccgguccauagauauguaacguuaccaagaaguuacucccaugacccuauuuucacacacacaagcuuacaucuauauuuacagaccauagggagugacugccagaguuucuccaacacauugaauuucacauaaauuauuuaucuucugaaaggucaacugguuaguucuccuucuaaacuaccuuaguguauuccagaaccaaacauguuaaucaaagugacccaagguguuuguggcuaaagcacuaacuaacuugccauguuuccugcugugaggcaggaaguaucagcauggcauuagguuguugugagagauucagcucuucugcagugccuugucaaacgaccugacuggucaacugggaaaaugaaguucucagggccaacaucguauuuggguguuuuucuuuuaggucuguaucaaagccagauuuaagaaggagggugucuacaaaugaacgaaagcagaggaugucuggggacaagcuaaggacauuugugucccacacugcauguauucugaauccagagaaaagagagugaguugcagucuccugagaaggcuauccaggcuaaggagccugugauggugaagguggauaauuuagcccucugagaaguguagaccugucaaaaaggagauucguuaauucuucaaagauaugguugucuucaaagaacagacauccccagauuuaaggaugauggggucucuugacacugagaacuacauucagaaauagccaaacaagaggaaaggagcaaagaggaagagaaagggagggaggaaaugagaggaaguguuuauucuuaagggugaagguaguggugaagggaguagaauuuccugauaaaauacagaaauucaaauuuaaguggcaucauguauuuuuauucacuuaaucuggcugccuuagacaggaggucacugaaaucuggaaaugagcuggcagaguccaguccagagcuaccacugaggcaggcauugucauucauucauguagucagcauuuguuuguucaauaaauauuuuuugagcauuuauuaugugccaggcacugggcugugguugugagauacaaugagaucaggacagacaaggucccucuaccuuuagaauuuacagucuaguggagaaaaagggaaacaguggaauaaaaaaauagauaaauaauuauuuagcaaaguuuuacuauauaccaaguauuuacuguauuaguagggacuauuaagcacuuugucuuguuuguuguucaugauaaauucugauguuaguauauacaauuauuauccuuauuuacagauaauagacuaagaauugaaggcacagaaaagcugauaauuagucuaaggucacacagguaguaaaacugacauaaagggaaucaauggaguucuaaaauaaaaaauaaacaaauaaauaacaacggagaucuauguuagaaagacuggugaggaaagucucucugagaaagugacauguaauuaagaccugaggggauuagaaggagcagccuaacugugagaagagcuguuacaaggacauuccaggcagaaauaacagcaggugcaaaggcacugaggugaggaaaaaggugaggcauguuuuaggaacaaacagaagccuacuaagaauaaaauuuagugacugagggggacgaagaccugggaaagaaacgcaggaaauaagacaauacagagacuugcagacucugauaaggacuuugauuguauuccaagugcaaugggaaacauugaaggaaauauacuaauuugcaucuucaaauauacucuggauucgguguggagaauggauggagaaauugggagguauggaaguugagcucgacaaucaaaauugaaauaacagccuagaaacauaaauaaucuaaaggaaaugugaugaaauaugaccuuuugggagacuaugggaaugggucucacuggggggggggucaagucuccaagccaaaugcaucuuuuauuugaaucaaagagaaaagccauaugacaaggaugaaaucagaauagucuuugauaaagguucuauguggauacaacuaugaauaaagauuuagcaguaccuacgaaaaugaaaauguucagacuccauggacccagcaauucuguuucuuggucguggcagacauugcugggaggcugaguccuuucccucucacuaccucccacugcagaggcuggauaagcuaaaguucucagcuucccuuuaaagcaaugguugaacaugugacagaaguugucauuggggaacuucuggaaaagcuuuugcuuuccuaaugaaaagggaaaaauucaccugcuacccuucugugcccauaagaaaggacucuccucaggaugaguggcuaaacaguucagagaaggugacagcgaugggcccacaguccuuggaccuccaaugauagauaucuccauuggauaccuggaggcaggcaaggauaggccauggaaggguuaguucugcauaaaaaacguuauuuaaagcucucuccaucuuuugcaucuaaguugcucugacuaguguuuaucugucagugaaaauaaugauggggauguguacuguggcauguaauuaauagagguuauaauggaggcaacaggauauuuacuauuuauuuuaggcagacagggguaugauaacauaaagaauagcagagaagggauacuaggaagaaugaaaguuaucagauccaaguugggguguguguguuugugugucaauuauagcauugccucuucucauuuugacuuaacguugugaauuucucauaaaaagaugacuugaaggaauuucuuuacucuggauuuugguuucuauuaaaaacuaaaacggaugcaaaauugccaaagugcucaugggacuaacagguucuaaaucugggaguggguuucagcuuauaauugaagaugacagguguccagagauuguaugaaguuaugguucuaaaggaaguacaguuuuacauaaaccugguauucuacaggaaaaaauguuacucuugaaauccaaacacauuauaaucauaacagggcagaaacaauaagaacauuuagggguauguuagguugaccuuaguguguagcucuuccaggaacucuugagaagucagaguuuuuauuuagguccuuuguaaucuggaaugccuuuggugggcagugaauggcgauuauugaaagaguugacugauagaauauuccugacuuuuccccacauuuauuuuuaguuuugguuuuggucuugaagacauuuuucuuaagaugucuucaggaaaaaaaaaaauuuuuccacauugaaaacuuuguuuuggcuuuuucgaguuuaaaauucggugaugggaaaacuugcucacaucacaacaaugggauuaagugugaggagaugaucgcugugggcagacaggcaggaggcuaaccccacgaagggcuaaacuaaaagcugaguaagagcuccacuaagaagagcucuuugaacuguucugggacuggcuagggccacuaauuguccuuggguuguauaugaagggaaaauuuguaucagggacacaaauauccuuguccuuuguauagcaucuauaucaugaaggauauucucauuuuuuaacuccauuuucuucacugaauaauauuacucaaccugaaagaaauacaggggaaagaaacggagggacaugcauucucacagugaauguaauuaaauguccuccugucuaguuuuucaaguuaaagguucugaguuuuguuuccagaauauucaacugguacuaaaagcaucaugaagucccucauauuuaauuaaauggugcauuauuaaaagggggcacacucuaucuagguuaaagaggugauaaacagcuauagaauuucauguuucuuucuacuugguauuauaugucuuguuuccuuuacuggacagcaaacuucuugggagaaaggaucaugccugaagcaucuuugcaucuccccuaacaucuguuugcuaaguguugaauaaaauaaaagcuugaaagaaugaaucuguaaguaaaaacaugaguuuuuuagauuuauuaaaaaacauuuagucuaaagaucacuaaguaaguuuauaggaaaagcacugaaauuuugagcuggaaauucuaauaugcaggaugccugauguguuuuuccccccuaauugaaagaaagauaaagauggaauugcugguacaccauaacaccaaaauguucuuaauuuuuuuuucaguuuugcaaauucucaugauuugauuuucauccaggacugucaguugagacaucugauaaucuaaaagcauucagagaauuaggaucccauauggcucgaaaauauuuccuauccggcaggaaaaagagaacauaccaugaaaauaauacugguauauccuucaauuuauguguacaaggagcauaaauaaauuuaaaucauuauucaaaguauaauaauuauaaugaucauaagguugauuauaacaaccaaaauaaaaagaauauacaguucuucauaaucaugugacauuauaaaaaaucagaaguauacuucaaaucaaugauaguaauagaguuguguuugucuaacagaagcaacagucauuagaaaugagcacgggauuaggaguccuggcuuaucacuaauuaacuguauaaaucugaaaagguaauuuaacucccuuaggucuuaauuuucucaacugagccaugaaagggcuagaccagauguucccuuuuaacacggcaucuguucuggagguucuaacaaggaguacaucuacucauacacuccuauugccugaagaauaauuaauucuucuugcuuugggggaaaugucauuuucuucagauaaguguucaguauugagaggugcacuuacauaauggugagggagcaaggagaccugggcuuagucaucuaauuucaccaacaaaauuauuacuaacaauaacaauaacggcuauucauugagaguuaacugcaggccagacacugugcuuuuauccucugaacaauucuauaaaauagauaucgcuauuaucauccccauuuuacagaugagaaaauggaagcauaaagauuacuaggaacuuggcugagaucacacaguaaguggcagagcugcuuuggaaaugaagauggguguuggaaucaaauuccccucaccccacuggcuucccauagcuuugacaagugucuucugcauggaauugccucagagaucugauggauggagucuuucucugccagcccagucgucuccaugaaccuccuuuccuacaauuucuacccagggauugaggauuauuaauaaaaagaaaaggaauugagugcuccuggguucaccuuacagcucugcacuuuaauagcagugugacucaggaucagcaauccucuuucuuuguccguacaauggggauaacacuaaugcuuaucuuuuaaggauauggugacauaauguuuaugaaguugcuuuauaaacucuaaaguaaaauugcuaaaaauaaagcaugccugcuaggaacuacuuuuuuuuuuuuuuuuuuuuuuuuuuuuuuuuuuuuuuuuuagaacauagcacuguaaaucuucuaguuucauguuguuuuugcuggaaauagucuauucugaaagaggcagcaugugugauggcagaaaaauucaggguucccccccccacccccagcucugccauuuacuuagcuuuguggccuugggaaagucacuugaucuggcaucccacagggucccauacucuacaggcccugcauuugggguuuaauuucugugguugcuguuuugaaguucuuccuaauuuuuuucuuugaguuuguguguuauaagugaagucugaagggacaacggagcaugcgcugggcuuggcaccuuagaucaugggaggucuugcuuccugcugcaucuccaggauggguucugccagagacccucuucauuggucucucuaucuuuaguccugcccaaccucccuuucucuguugaguccuaaaauugcugccauccuucacuccuagcaggagucugggugccggcagagggagggcuugggugggucacucaaacccauggcaccuuggggccgagcauggcaucgcccaucccugcccuaacagguagcagcauuccaaaucaaaugggugaccagccagaagcuaucccaauccagauaucaagcauguccugaugaagagauuuaaaaauccuuugcgggguggggguccccugucugcuauggauggagguaauguggcacuggauaaaagagaugccugguuagauuuucugggacccugcucuauccaggacacugugguagucaggagaguguugggggccuggcaguggggcaccugugcccugcauaggaggcacgguccagggugcuugcauggggcugcacucucacuacaagugucuugugccuuggaaugcuccuuuggcuagcuccaugccuggagcauucucccuccuucuaaccguccuggguuuggccuguauuugucuuuuuugaccagaucaaggcauccuuuggauaaaaacacaaaauauaaacuggggaauuugguauuccuucauaggaguuaaaugcuuuaauauuuucaucuaaaaguaacauugcacaauauaaaaaugaaugacaaaauucaugcuaauaacauaaaauuuuaauguuucuuuacacagaacauuaaauaguaaacaaaaaacaccaugacaagucuaaagagagaccacaaaaggaaggaaaaagguuuguacguauuuuuaauggcacucuuuccccugccuuuugaauagggggccccacauuuucauuuuggacugagcuccacagauuauguagcuggcugcgcucccaggauguaagguuugcauaaucaccugguccuugcuucacuucacagguauauuugcagcagcucugcuuguaguugguaagcucaguuaagcaacauaguuggacugacuuaagaauagcuuaccauccaaugaucuguggcuuuaucuuuaccuuuccaaguggguagaaaaggaguaaugggagccauucccuuggaaacuacugaggucauuuaacccuaacaaggaugaugcuucacuagauguuaauuagagaucauuuccauuuuuaguuuuaguucuagagguugccuuaaaaauuaugagggcaacaggaaacacugaacuugccuagacuucuggggcuucuuuauucauugacuuauucauucacccauucaaucauucccuccuucacucacacuaucauuucacaacauuuacugaagugcuaucaugcugcccacacuuuaaguauggagaauucaaaagugauugaggcagucucucuccuaaagaagcucaaagucacugggggagggguaagguggaggugggaucagaaggcauauaaagagauuauuuuuauuauuguuuugagacagagucuugcuaugucacccaggcuggagugcaguggcaugaucuuggcucauugcaaccuccacccuccagguuccagugauucuccugcuucagccuccugaauagcugggauuacaggcacaugccaucacgcccagcuaaguuuuguauuuuuaguaaagauuggguuuugccauguuggccacgcuggucucaaacuccugaccucaaaugauccacccgccucagacuccuaaagugcugggauuacaggcgucagccacugugccuggucaaagagacuauuuuuuugaugcagcacauacaaugauuauggcuguacagagaaaagauuccugaaguacacagcuuuggaucaggaaagacauuuugggaagcggaacaucucugcuaccugcuaaaugaugaggaaaaguuaaccagaauacaggcaaugcuugaagcaagagagagaaggcacugcguggaucgguugcagcaugaacaagggcaaugagaaaagaaacgguauagugagagugaaaaccagaaagcaguuuacaguuaaccagguggaagaaacagggagggagagaccagguagccagccuuguaagcgaugaugugaagugggcuucauccugugguucugggcaguuggcaaguuguuuuaugccuggaagggagauggcuggauuuacaauguagagagcaaacuccaguggcuaucugaaguguggauuugaagggcuaaaacuggagguuggaagcccauuuaaagagcucuugcagccauaauacaagagacaaugaagaucuggacuaggacagcagcagcaggaauggugauguauuaaagaaauacuauagagccaaaacugacugaacuugauuauugauuaaauauagguauugguagaagacaaguguuaagaauaacugucagcgcucuuguuuggguaacugaugguuaaggagucaggugagaaauagacuuucagaggagguagaggguuuggagguacaguguuuuguucuuguuuuugagacagagucucacucuauuacccaggcuggagugcaauggcaugaucucggcucacugcaaccuccaccucccggguucaagcaauuauugugccucagccuacugaauagcugggauuauggaugugagccaccaugcccagcuaauuuuuguauuuuuaguaaagacaggguuucaccauguuguccaggcuggucuugaacuccugaucucaggugauccacccaccucagccucccaaggugcugggauuacagguaugagccccugcgcucagccuugaggggcuguguucuguuugggacaugcuuaggggccuguggaacuggaaggaggggauguuagcagacagugagaggaggcugaaguuuggggagagguucaggcuaauguuguagauuuggggaugaucagggcugaggugguagcuguaugaaauggauaaaugcagcacugagaagaaaggggaaaugccaugagagaaagaaggaaaagaugaaguuaaugaggaaaagagggagagugugucgugucagaugccaagaggguaacgaguuucaugaauaaggauaugaaccaacuguuaaauauggcagagaagucuuaauggaaguggaaaaggcccuuugguuugguaaaauacagcagcucaugaggaccccaggaggaguuuuccauuauggguacaaaagccagauuagaggauugugagacaaaagggguggagacaaugaauguagacgauuguuuugagaaaucugaaugaguaagggaggagaaaaugugcagcacagcuggagaaggaacaggaucacaggaaguugcuuuauuuucuucuucuucuucuucuucuuuuuuucacucguaagaauaggaggugacugggugcacugggucaugcccguaaucccagcuuuuugggaggcuaagauaggcagauugcuugagcccaugaguucgagaacagccuaggcaacauaggaaaaccccaucucuacaaaaaauaaaaaaguuagcugggcaugguggcaugcaccuguagucccggcuacuccgggggcugaugugggaacaucauuugauccugggaggcagagguugcaguaaacugugaucauaccacugcacuccagguugggugacagaguaagauccugucucaaaaaauaaaaaacuaaaaagaauaggagacucuuagcugggcauggugguucacacuguagugguggccaccugggaggcugagaugggagggaaaauuuuuugaggucaggagguugaagcugcagugagcuaugaucacaucacugcaccccaaccuaggcgaccgauagauauguguuuugaaaacauaacgcucagagcagguugaaacccugucucuuaaaacaauaauugaaaaaaaaaaggagacacuuaagcaaguuugcaggcagcagguaaagcacuaguggagagggaaguuggauccacaggagagggaaaggaaaacugcuggagguaggagggguaggccuggggugagauaaagggccuggaagagggaagcaaggaugggugagguguagaauccuuacuccugaagcccuucacugcugauacuucugcuauccuuggcaugugacaauuccucaagcugaggucaaugccacugugucaauugcauagcaauucucuuucuuggggauuccuauaaaaacucccucauaacaauuccccaagucucuagucuuaccuugacgccccucagucuuacacaauuccuugcuauuuugacuaguuugagguuacccaucaugaacuccuucgacaucucuccuaucuugauuuauauacucuucuuggucucauuuuuuccugcaauauuaaaaauucuacugaucuuucaagguccaacucaauugauaucccuuaucuaugucucacuuucaucuuacauauacauuuuuaaauuacuugaugucuuuuauguuaucuuauaagcuaauuuaaauacuucuuaaaacaaggaagggauucaaucaaccuaucaaucgucaugauacccuuuccuaucucaucuucuuuucaucuucuucaacuuuuugacucauuuuuauaucauuccucuaugaaacuauuaaaccccuuaagggcaaguaaauguuuuuugcaccugcucuaguaugacaauacauuauacauaauaccuaccuacuacaauuaauaaauuguaagcuccuggaggacaagaauuuaggaguuagcuagcuagauagagaugaauacacaugcagagauauauuuacauucucucaaguauaccaauuuaaucuaauacuuacuauauacuugcuagcaauuagagauauauaaagauaaauaaaacaaaacacagucucugucuuccaagggugccaauccaguguggcaaucagagaaugagagggcuugaaugacaugcugauaaaauuggacuguauucugcuagguuucuugcagaacuuagggcagaggauauuaauagauauguguuuugaaaagauaaugcucagagaaggaugaaggaugaauuugaaaagaaugagauugaggguaggcagaucuaugagggggcuuuugcaauaguguagaugacagauaauaaagaucaagugagggcaaguugguuacagaugagauauugaguguauaugcguguauguguauguugggggagugagguuguggugcacaagaauaaguguccagaaguuauuugcuaaucuuacuuuuuaaaagacauuaaaugguaaauaguaguaauaacuauagcuuauuacauaucguguaacacauuccucuagacuggccuuaggcaauauugagaucuguuccauuucaccacuuaggauccucuaggcccgauuuuggcacuuuauucuauaugaucggcuauuuguucuucucuuauuacuucaggucucaaguuuugaucauccuaugagcccauauauccuucagagcaagacaaugugaauaggcaucguugcacuugguagaggguuaggcaaauaguggaugccaaauaaauccuuguggaauugaaugguauuaccuggaguucccugaagguuguacauccucuuacuccuuggccuuuggaacguccuucucuauaccuggaauucuuccucucucucuuuaccuccucugacuacugucucuuuaccucacuuugaccuuccuaguucuguuuaucacuuccucuaagaguuguugcuugaugccccugcacuggguuagcagauuuugcuaagugguccacagaaucaccuacuuauguguuucucugccagcucuauaaagacagaccagacuaccuugcgguaauuuguucaguauuuuauccccagguugagcacagcaccuggcauacaguagacauucaguaaauauuuguuaaaugaacaugguuuugugggguuuuauuuguaaaucugaacauuuugaaauuugaaucuucaaauagcuggacauaaagugcuagauccauccagacgaaagaaauaaugggagaccaucuagaaaaguauuuuguucuuuaugcuauuaaauucaguagaaauuaguuauuauauuuuuugaggacuguuaugcaauuaacacucuggacaacaugaagacaguucagauuucaccuuucuauccugccccccaaggacaugcaaaauaucugcuuggguacccguuuuuucauguguacacacuagcaucuucaguugauaaguuccuguggggcaggaacaguaaacuucucagaauuagaaagcaaaagugacagcaaaaacacgacaacaucagaaagccagauucuaugucagaaagucuuaggaguuguagcuuuaguguucugcagacaacccaaugucacaggaaauacuaauucccuugcucuggggcauuuauuaaaaacaaaauuuuuugggaggccgaggcgggcggaucacaaggucaggagauugagaccauccuggcuaauauggugaaaccccaucucuacuaaaaaauacaaaaaauuagccaggcguuguggcgggugccuguagucccagcuacucgguaggcugaggcaggagaauagcgugaacucgggaggcagggcuugcagugagccgagaucaugccauugcacuccagccugggcaacaaagugagacucugucucaaaaaaaaaaaaaaaaaaaaacuaaaacuaaaacaaaauuuuacuuccuacugccugguaccauauuaugcaguagagacagagggguuaaggaaaucaggcauaguccuuguucucauguaguuuguaguuaaggagugagagaacuggcagugaccugauuuugaagaggcugauucaggucaagacccaauuuugaagcuggucuccaacaagaagagugguuucuaggaauauagcucugcacaagcaaauacauaucccuuagacagucugugacauggagugaaaaacccucccugacagauccuuuacuagggaucucugcaagggcucagaucucuacuucaauagaaaugcucauugguacuaucugaggacgauuuuuccaagaggcacaaggagaucaauuacuacuggcagccuaauuugcaagauaaagaaauuucccauuauucuaguaucuucgcaaccacagucuacuucagcaucaucagccgacaucauggcauaguggaaaaaaauuuggaauagcuaaaaagucacagauuagaaguucucauagcugagaugcugcuaugugcuucuuguuaaaauccaggguuaggacaagggucagaggauucuuguccuucuacacuugaguggccuacagccauguauucuucuaaaucauguuuugaauuucgucuugaaagauaauguuuuaagagugcuaagcuuauauacucauacaacagaaauaauaugugugauaaaguugggcaagaagugcuuuuaaaguugucgguuucuaaaggugucuuuuuuuaaauggguacuuaauaguuauaccuauuuaugggauauaugugauaucuugauacaagcauacaaaguguaaugaucaaaucaguauccaucaucucaagcauuuaucauuucuuuguguaaggaacacuccaauucuacucuuuucaucauuuuggaauacacaagaaauuguuaaucauaguugccuuauugugcuucaaaaaaguugucuuuuagguugucuuaaaauuugguuacgaauugauaacacuagucagaaucaugauuuauauucuguagaucauuuuuuuccauuuagcuuucaguuauaauaccucacagaauaauaaagcuugauagguuaagugucuugguccugacuaucuugagaauaaugguuggagcaagaacuaugguccagacgucugcucuagcugcaauguuuccccucccuacuccauuacaccacaaugauggaugaaugacggaugcugcagcagaaguaauuacaguaaacucaagauauaaaaacaauuaauauagugaaaauauauaaauuaauaauaaauauaaaauacaugcaucuuuaauauuaagauguaauauaauuuauaaauuaauauagcaaauacaguaauaucuaauggacagugaccccaucaccccacuuuuacacgugccucuaagagccauuucuuauuuuugaaggggagcagcuacacccucacucuuuggguugcggugccguguagaagugaugagaaugggaaacugauacacuccugcacagagaagccaaucugaaugccagaugauuaaguagaaaccuccaccaugcugccucagacuuacaaaugaagugcaaauuaaaauguuagauagacauacucaacagccuguaacaucacaaggacugucuuugggguauccauuucuauaaaaagaaaaucuggcauuccuuuuuggaacauuaggccaaaguagaggauaaugagaacagaaaugccuuaugcagucuuaauaaucuuucuacucagaggauucaguggaaacuaguaacuaaaaaagauuagccuugcaucaagaccgagcuauccagaaaucgcccggccugggaugcagauucagucacuuaagugaguuguaacacaggcucacuuguagguuugccacaauuuucuugcaauucaguuccuuccucugucaggcugcaauaaugagaugaauuccugcaagaaguacucccagaaagacacagggaggucugaguagauaacuaacacagauaucuagagaacagaagugcuagacgaagagagaaauaaacacacacaauaauuaaaacaaagauuuuuuuaaaccauagcgacauuacacuuaucucaaucuuuaaaauccaggauaucuauaucuuuguguauuucucacugaaacuuucccugggccucccaggaagaacauaaagaauaaagaauagguucauuuucuuacagauuaagagaugugaggcucaaaugaccuuauccugguaacauagcuacauuacugcaagagcagcaucuuuaaucccuaugauuccuacuccagucacucuuuaccagugaaccaucaaaguaggugaugaugcugaaagagguacagaagauucagcuugugaagauaagccgaaugacagaaaaugcacuuugugcaaaccuccaugcagugaucacaaugcauuuuagccagugguucaguucucucucuguccaacuagacuauguaccuugaggauagaaaccaucuguccaccuaauguccccaguagucagcacaguaacuaacacauaguagucaauuaauauuugaagaacguauaaaugaaugaaugaaagcaugaauggaucuggaaaaguugccaucaggaauuggggcccugaagaaagaaugggguucauaaauaacauucagcaaucauagucacugaauuggguacuaauauuagugaaaauaauagagacaguaaaaccaauuauaaauagauaaagaagguagugcuuguucuguuuuguuucauaaaagauugacaauuuuauuuaugaacacaggauuugagcuaaaaagagaacagauaagaagguaggugacuaaagaaaugguugccgagaaaaaguaugaaacagaguuuagaacagagaagaggauacagagauaauuguaaagguguuugacagaaaaagggaaaaggagaaaagaaaaagcuuucaguaggacacuuuaugggcauaauaggguucuucuuuagggcauuucggaaguugagagagcaaagaugagaacucgagagacauggaauggacaaaagagaaagggaggugagauacaugguacugaucacucacagggaaugaggaagggaaguaaauggccucaaagaagucauagcugucaucgagcagcaaaugccuucugucaugcagguggaauuaaagcuuaaaugugaacugaugguccaucuucagcuucuuucucuucucgcucugauaccugcccucaagguugcucccuggcuggucagggaacucacacugagcuguagaauguucccaggcucuggaccuuucuguacuguuauucaaccaucagcacuugcuagcuucuguccuauucucucaggaugccuguuuuuauuaaaugacaaaggaaguuaauugguucaucaaguagagcaauuccuauugugggcuuagcuggcuacuaguuaccuugccuauuacauauaacagcagugaaauaaacauaaaggaaugaaugggugggcuuucauuacgugccaggcccugagcuagaugcagcagaguauggcagaacaggacaugggcuuuggagacagacacacccaagacagaggucugguccauaauuuccuagcuauaagcuugaggaaguuaucuccuaggguucuuggauucuucaucuguaagauaugaagaauaauuucuucacccucaauuuccuccucuaugaaauggagauaauguugccuacuucgcaggguucaaaauacauauaagugauaauaauguuauuuacuauuuauucauuuauccccacuuuaaaaaggaaaagcugaggcacagagaaguaaggugugacuaaggucaccuagcugggaaauucuagagcuggcauuuaaaucuagcauuugucuuuaugcacuuacccaacauacuaugucaucuuaaccaauacacuaaagcaucauuagauguuuccaucuacagccucuuacaguggggaaacaguuugauauucaccaaucucauuuaacccucacagcaccucugugcaguacuaacaucuugcuuuaagaugaggaaaggaaagcucagagaagguaaccguggccaaaacucaacauaggcccagagaagggaacaccagccaaaacucaaagagcuaauuagugacagaacuugaaauuagauguaggguuuaugaccacaaauauaaauauaagaaagagagccaacucugggcccagaguagaugcccacaucuuuacuaguuaucuaggugguauuucuacauugcuuuuaaaguucucugauagcaaagcugaaaccuggcuagguguuguaagauagaugagaaacugcaagucaaggugugaguucaaugaguggauuuuaacuccuaacuucaggaguacuggucaauuauccuuuacugaguggugcuaucagcccacgguaaaauaaauuagauuuuuaagaaggugcagaauugccacuauaaaaucagauaagccuacugcaguugggaauaaauucuaucauagaaauacaucuugccugauaucaaaggaagccaagaaaccaugccaagaguuggaugaaaacugacauuuucugcuguggagacagaagugguagcacugauuggagaauuauauuuugaagaguucuaaaauauuuaucaucauucuaggucauuuauucauuuacccuuuuaaugcucauuucuuuugugccacuaggucgagcuuaaaagcaaagaaugaaaauucacuguguuuuuauauauuaauaugaagcaggaaguuucucuauugcuugguuugaaaaauaaaagcguuucugagaaauauuagaacacuaaauguucuuucagaaacauggcuuuugucauuaauaaggaugcuggguguaucuaagcguguuaugaauuuguacuuuuuuuuguuugauaacuuccuguaacuugaaguauuucaagaagggaaaaagcugauaaaaacuacuaaaauugccauugcuucacuguauugauugccccauuauguuucuuucuagacuugacucaggcaucuccuucuccaggaugccuuuucugcucuccauucuaauuaagauggccuuccucugugcuccaggagcauuuacacaaaccacuauccaucacugcccuuaucacacugcaucgaagcuaucugcccgcacaucugugcccccuggaaggcaaucaggacaauaaccauggcuuauauuccaccugguguccucagcaccuggcauggagccagaacucagcaaauuuuuaccaaagaacaaugaauuuuaaaaccugacuauagaauggcagaaugcuccuucugccuccacgaaauuuacuuucaaguugaacaauuuuauuaaaaauuccauuuucuaaugguaucagagaccugcaaagcuaaagaaaaagcaagucuuauuuccaggucagaacuuauuucccagguccucacuauuuggcuuauauaauauuaaaagguauuuuuaagaguauaauuucuauuucucaggcuugaaggauacuuuuguuaguguccucauagcuuucuauuuuggcuuugcauccagagaaaugaaagaggcuugacucagcugccgcuuaauacugcacaagccugagagagaagacuauuauauaagcuaauguguauuuuaagguguuuuuuuuuuucauagccaauaccuaaaugccaccuuccaaccucaugaaagugcugaaccccagugugugggaaagcgagguccccuacacggcucuguauuccuuauaaguauaaaaaauaaaagcaguugauuaaggguuagcaauuuucuuuucuuucuuuacacguacuuguaauucauuuaaugcaggaagugggcugaguuuucuuguucuuuccaauucaacucucagggagcuuucuugccagccugcuaugguuaccauggcaacaaggcgaugguggcaguaauaugaucucauaugccuugugucaauagcaucagaucaucacgcuugaggauaauuuugacaauaagcuucagauauagauucaggauauauuaccauuugauugauuuaccagaaauacugagcaauuacagccuuaaacuucuaauaaaagcauguucacaaagguuagcguuuuucccuagaugacauauuauauggcauucugaaauuuguaaauugcuuucauauaucugcuucaauucucauuaggcaggacagauauaaucauccccauuuuauagaagaggaaguaaaggcccgugcaaugugcuguguaagguggcaaaagcaacuccacagugaagcugaaacuucaacuugaggcuucuggcaucagaaucacacuuuccucaugccuguguuaagaauucauggguauuaucaaaauguucuuagaugcauagguuagacccuggaaugucugaauuaaaauaauguaaauguaucugugauaaauaacuacuaguuugagaauauuaguauuuuauauuugggugaugcuucauacauuuuauaucucccauuacaccuuccuuuccuaaggcuuuucugauacuagaugcacaaauagaugcuuaucucuuucucccacugaucaacaucuugucuuuuuuguuguuguuguuauuagugacauuuauuuuuccauugugaguuccuugaaaguagggaucauguuauucauucuuggaaggucccugauccuggcacaguauguauggaucuguuauguaucagguacuguacauaauauguaccagguacauaacagauacaccauaaaugcuuguugcuuguuaaacugaacucaucugacacccacaaaccccaugagguaaguacagcuggcauuaugauccacuauuuuaauaaaguggaaauagaggucauggauauaucaugggcaauuuaauucuuuccacucccagccaugugcucuuuccaugucguccuguuugcuuuauucuuucauuguuucucuuucauucauuaauucaucaaacauuuauuaguugcucuuucuauaucaagcauugcuacagauaauggguuacaaagauaaauaagacacaauccucagcaccaaagggcucacagauaaugcagauaauuuucugccuaggcaaguaguaaaauaaaaccuuauauggaacuucgaguaugcauuauauuauuucccaacuuuauuggcucuuuaaaauguaucuugagaauauguuucaagucccucuuuaaugcaguguuuuagaacuggauaagccuugagccauugccaauauagggugauacuaauucugcaucuucguuuuuuuucuugggcauaaaaucagcauuuccaacaucccacagaaucccuaaacuuaacguguccucaaugaaacucaguaucugaccugaacgaaugggaaguggcagaaagaggcagauggucagggugagaugccagacucugccguuugauaugacuuagggucaguuacaccaucuagggguuucuucauuaguaucuggcacgaaacacaguguucaaaauacuucuuaaauguauuaauuaaugaaugaguugucaaagaggaugaaaaaugaugacauaaaauagggauaccugaagcaguguuagcauuagcagguacucaauaaacaucuuuuaaagaguggacuaaauauauacgauucaauuccccuuccugaaacauauuaaauugccaagacaaaacuucuaaguuaucuuuaugucucuuuccacaucauagagucagguuuauuucaccucugcaaugucuuggacuugugccuuucucuucauccaauagcaugauuugauccaacccccacccuuucacuaguagacucucagagaaggcccuugacugaacuuccucucuuuccagggucucccauuccaccuuacuggugaaacucuuauuuuuaaaggauaacuaggaguguauaacucuucuggccagagauuuuguauugauuuguauauucuaauuaagaaacuuuuuagaaugguaaucaagauccucuaaaaggugaucuuuaguuauaccuauagucauuccuuuccauauacucuagguuuuagcuuccccuacacacacuuuuggacuuuuaagcuuucuuccuguauuccuaguuaguggaguaauaacagcuuuguaauacuuuugcacaacacuuugcaauuuguaaggaacucauauauguuuauaaugaaacuuugugauaaccucagaguagguggauaugaucauuuucauuucaccaauuaggaaauugaaaaucagagaguuaaaucauacagauucucauaaccuuuaugagaauucuauuggaaaauauuugugucuaugaugauuguuuaaccauggaauacuugaaucaaacucuuuaaauuaacaacugugacuucaaaaugcuaacgauugacauuuguucagcucguuagcccagaggcuaaucaugaugcuuuucuucugcauagcaaaagaaacuaucaacagaguaaauagacaacuacagaauggaagaaaauauuugcaaacuaugcaucugacagaagucuaauauacagcaucuauaaagaauuuaaacagggugggcaugguggcucaugccuguaaucugagcacuuugggaggcggaggcuggugcaucacuugaggucagaaguuugagaccagcuuggccaacauauugaagccccaucucuacuaaaaauacaaaaauuagcugggcgugguggcaugggccugcaaucccagcuacucaggaggcugaggcagaagaauugcuugaaccugggagauggagguugcagugagccgagaccguaccacuguacuccagccuuggugacagagcgagacucugucucaaaaaaaaaaagaacuuaaauucacaagaaauaaacaaauaacuccauuaaaaaguggcaaaggauauaaaccgauacuuuucuaaagaagacauacauggagccaagaaucauaugaaaaaaagcucauuaucacugaucauuagagaaaaugcaaaucaaaaccacaauaagauaccaucucacaccaaucaaaauggcuauuauuaaaaaguaaaaaaauaacagacgcuggugagguugcagagaaaaggcagcacuuacacacgaugggaucauaaauuuguucaaccauuguggaaagcaguacgguaauuccuuaaagagcuaaaagcagaacuaccauuugacucagcaauccuguuacuggguauauacccagaggaauauaaaucauccucccauaaagacacaugcaugcgauguuuacugcagcaguauucacaauagcaaaaacagaaucaacuuaaaugcccaucaaugacagauggaaugaagaaaaugugguaaauuuacaccauggaauaccaugcagccacaaaaaagaacaagaucaugucuuuugugggaacaugauggagcuggaggccauuauccuuagcaaacuaaugcaggaacagaaaaccaaauaccacauguucucauuuguaagugggagcuaaauuaugagaacucaugaacacaaagaagagaauaacagauacuugggccuccuugagggugaugguugggagaagggagaagagcagaaaaaauaacuauuggguacuaggcuuaguaccugggugacaaaauaaucuguacaacaaacccucgugacacuaguuuaccuauguaacaaaccugcauauguaccccacaaccuaaaauaaaaguuaaaaaaaaaaugauguucuuggcugggugcaguggcucacaccuguaaucccagcacuuugggaggcugagguggguggaucacuugaggugaggaguuugagaccagccugacuaacauggugaaacucugucucuacuuaaaaaauacaaaauuagccagcugugguggcgcaugccuguaaucccagcuacuugggaggcugaggcaggagaaucacuugaacccaggaggcagagguugcagugagccgagauugcaccauugcacuccagccuaggcaacaagagcgagacuccgucucaaaaaaaaaaaaaaaaaaaaaagaugcucuuaagcuggauugccuguguggaauccuggcucuacuauuuccuagcuguguggucuuggauagauuacuuaaucucucuguccuucaauuuccucaucauuaaacuggggauaccaauaguuucuauuguguaggauugcugcaaggauuagugaauuuuaugugcguaaagugcuaggauaauaucugacacauagcaagcacuccuaaauguugcuacccuuaaagacacaaccuaagaacuucuuuggcuagucccuggucugagaaggaaaaucaauuccuuccucauuggugcuaccuuguuugggucuucuauacuggggacacuauagcugccucaggguguuggcucaggauagauucagaauaucugaaucuacuuauugggagcagucacugaguuucucuaagccucauucaccaucugaaaacaccuggauaauaacagcauuuuacaucauaggauuguggugaucauuuuauuaacuaguacauauaaggcaucuagugcuuggcauggaguaacuaaucaguaaaauuuagugacuauuacuguuacauaaauguuuugcccaugauauuuugaccuucuuggguuaggaccugucuuuuucguuaucuuuaugccuaucuuuguugcuucuucacaguagauuuaaaaaaaauaaacauuuaaauaaaaaagauuuugcuuaugagugucuuggcuauaugggcucuuuuuuuuguuccauaugaaauuuaaaguaguuuuuuucuaauucugugaagaaagucaauaguagcuuaauggggauagcauugaauccauaaauuacuuugagccauauagucauuuucacuauauugauucuuccucuccaugaacauggaaugcuuuuccauuuguuuguguccucucugauuuccuugagcagugguuuguaguucuccuugaagagguccuucacaucccuuguaacuuauauuccuagauauuuuauucuguuuguagcaauugugaaugggaguucacucaugauuuggcucucuguuugucuauuauugguguauaggaaugcuugugauauuugcacauugauuuuguauccugagacuuugcugaaguugcuuaucaguguaaagagauuuugggcugagaugaugggguuuucuaaauauauaaucaugucaucugcaaacagacaguuugacuuccucucuuccuaucugaauacgcuuuauuucuuugucuugccugauugcccuggccagaacuuccaacacuauguugaauaggaguggugagagagggcauccuugucuugugcccauuuucuaagggaaugcuuccaguuuuugcccauucaguaugauaugggcuguggguuugucauaaauagcucuuauuauuuugagauaaguuccaucaauaccuagcuuauugaguuuuuagcaugaagggcuguugaauuuuguugaaggccuuuucuguaccuacugagauaaucauaugguuuuugucauugguucuguuuaugugauggauuauguuuauugauuuguguauguugaaccaaccuugcauccuagggaggaagcugauuugauugugguggauaagcuuuuugaugugcugcuggauucaguuugccuguauuuuauugaggauuuuagccucgauauucaucaggaauauuggccugaaauuuuauuuucuuguugggucucugccagauuuugguaucaggaugaggcuggccucauaaaaugaguuagggaggagucccucuuuuucuauuguuugaaauaguuucagaaggaaugguaccagcuucucuuugcacaucugguagaauucggcugugaaucugucugguccugggcuuguguugguugcuaggcuauuaauuacugccucaauuucagaaauuguuauuggucuauucagggauucaacuucuuccugguuuagucuugggaggguuuauguguccagggauuuauccauuucuucuagauuuucuaguuuauaugcauagagguauuuauagcauuuucugaugguagcuuguauuucugugggaucaguggugauauccccuuuaucauuuauuuaaauacaaaagauuuuucaauaaaaaugauuaaaguagcaggauagaacaaucuuugcagagaaaaucccaaacucuaaguggauggaugcugagacuguaugcaaaaacgcuaaauucuagaaagaguuaaauuugaaaauaucuauucuuauuacaaaauauugaucuagugguuguugggaaaauauaaauguaccauauaauaaauuggguuuggauuauuaaaauucuauuaccuuguccacaauggaagcaagaauauaaaugacuuuauaaaacuaaaaaguuuuaaauuuucuucuguacauuggcauaucucacaaaggaauggaauugguuacacugcauaugagaacauuuugaugcaguauaaucuuuuauugugcagcuuuauauagcacccuuuccugaaagagugacuguacagcgccugguguucuaaauccagucgcuaacucaaaccuuuucacuuucauaaagagguuuugggaaugaaguuaauauuccauuuaccaaacuaaaauauaauauuaugugcugcaaugcugugagcccacccacccaccagacugcagauaaucuucuauucauaugcucaaaucaaguacuaugcauauuucuagcucacuaucaaaaguaacugcacauauacacaaagaaaggauagaagaaaaugaaugagcagucaaaaaugacugcaggcgacuuuaacaauacaagaucagccauuuuugacaaauauuugauuugaaauucacugaucuucuauuaggacucaagggcuggcaggaguaacgaauuuccugagcuucucuuauguauguucagaaguauuggaucaguuuuuggucucgggguaacaacaauagcagcaaaacaguaacagcaaccaacaugcacugaguuuacuucacaccagcacucaggcagaacuucugcuucagcagggugaauaagagcccccaaagguaucagauccuaaucccuggaaccuguaaauuaugccuuauuaggagacaggaacuugcaguugugauuaacuuaaggauccugagauggggagauuaccauggauuaucuggaugggcccuaaauacaaacacauguaucuuauaaaauagauggaaagggagcuuugacagacaaaagaggaggaggcauugugaccacagaggcagaaauuggagugaugugggcacaaaucaggguaugcugacagccgccagaugcuagaagagguaaggaacauauuacccucuagagcuucuggagggaaugagccccugcugacaccuugauuuugcccaagugauacuuauuuugaauuccuguucuccaaaacuuggagagaagauaaauguuuuuuuuagccagcaaguucaugguaauuuguuacagcagccaugggaaacuaaauuaagcauccaaccauugaacuaauauacuaauauauugcugaacuuugguucauuccuucauaagccucccaaauucuugauuucuuuguucugugggggcugcugcugguaagaguagagcuauuaaagcauccuuccaugugaagcaucaccugcugacauuuuugcagaaucccuuccauugucagcccuaccuacuuacaaguugaaauugacacacaggugcagugagucaaggucugacuugaaugcuuugcuuuucucucaguagauuuucuuaaauucagcaaguccucacuuaaugucauggauaagaucuuggagauugcaacuguaauugaaacuauguauaaagaaaccaauuugaccacagucaaaucaauauaaacaagaguucaguuccuaugguauauuucuggucaaagaaaguaaucaccaaacuucuaaauaaagaagcaaauacuucuaauauuaaacaucaaaauaaaugggagcuauacauacauuuaagaaauauuaaugaaaaggaagaugaugauuuacccaauuauuccaguucaaggucgccugucccggcaacucagggcaccaggugggaacgcacccuggacgggacacccucccaucgcagggcauacucacacccacauucgcacucacucagacugggaccauguagacuugccaauucaccuagcauuaagcacauccuugggccguggaaggaaaccggagugccuggagaaaacccaugcagucauggggagaacaagcaaacuccacgcagacagugacccgggcugggagucaauuuuuuuucuuaucaacaucauaaggaaacagcauuacaggaaaugguguaacuugaggacuugcucuauagaacuacacaugccauuauuucaguauguuucuuuucuuguuugaucucauucauuugcacacuugaauccaccaauaauuaaaaacaucugugaauauaaucaauacauaaguaaugaauuuauuguuucuuugggccagaaaacuguuaagaacuuguuauaugcaaggcauugguuuagaaaccagauauucaaugauaaauucuugaccucacuuaaauucuuauugagaugaaaagaaauauuaucaagucacaaacaguacaaagcugggugugaaaaugccauaaggagaagauggagacaacgcugacauucagauuucuggcuuaaaugacugaaaaaauagugaugccauuuacugacaugggaacugcaggagaagcagcagauuugggaagagcaguggauuugaggucccuggggggcauccacguggaaaaacaggccugauguuaaggagagagaacuuagagguuuugaaauuaucugggcauuggugauaauuaaaauccuaggaauggaacucauugcuccuggacauugcauaaugggagaagaaaagagaggcuuagaaaaaguacagggcuaguaaagcguaucgcauauuaagagaaugaugacuaaccuaauuugagauuuaaagggaucugauaggagauaaauuaaaaaucaguugggucuauccaaagaggauaacccuauaugccagccuccaaaauuuagacuuuuuuuuuuuuuggucauauguauugagucauaguuagagguuuuaauuuggggacuaguaggauuauagcuaugcuuauaagguaaauccaggguaguguguaggauggacauuagagagaaaagacagaggcugaagaguugaguuggaauguuaaugugaugaucuagaauuagagguaaugaaggccugaagaacuguuuuaacaguguguguauguagguauguguguguguguguguguguguguguguguguguguauuuuccccccaaauauacuaaauaaaauugguaucaacauuucuuaucaacacuauagggaaacagcauuaaaggaaauuauguuacuuaagguacuugagguuugauguucacucaaacacuuuugaguauuuauuucugcauuaaaggucuugcauuucauacauacaggugaaaaaagaggaaggcaagaugucaagagaaaaaaauguggcauauggccugacccaguuuauuuguugagaacuuuguggaagcaggaucaguaggaugcgcugcgauguauccuggcaguggagaggaaaguuaauaauaaccauagccacgggaugaacaguggcugcucacugaguguugcuaagggccaucaagaggugaaugaaaagaauuauccuuuuguucccuucauggagaugcuggcaaaugaacugaauuuaacucaaugaaccacaaagccuaaggguaacuguuuuccuuugugguuugcuuauugaaagucacugcugagcugauacggguguuggggacaaugucuuugaccuuggaguucuuaaaaccauccucagacucaaugaacaguugguaagguuuuaggaauguccuagcaaaagcacucuggauucugcaggcaagugggauaauuccugaaguauuauuuuaaaaauugugugaaacaguggaaauacacuauuuggagucagauagaugaggguuugagugccauuucuaucacuuggugauccugagaaaaucagucuccuuaagccuuaggcaaaauggggauaaugaucgauuuugugaaaauguuaauaaaauaauauauggaaaaauaauauauuugaauuuauagaugagacuuaauagauaaaugugacugcccucccauacuuaaggucacuaaaaauauuaauuaagaguauguugaauagaagaauuuggaaaagaaaaucaagcuagagagaaugggagaaauuuccuuaagaaacaaaacauaaaauuuuauuaggacuauuugauuugcuuaacugaaacucuaucaaaagccauuuucugguuuuuacaugaaucuucaaauauuucuaaucagcaguuuuucucuuaacugccacucagcuuuugguuggaugaugcagagauguagguguuucgaguaacuaauacaauucccuucuaggguauguugcagggugccuuaacuuacuguguaugcaagguaaauaacuccuaauaugagacaacaaacaaaauacaugucuaaucaauucagaaaaauguuuaggaagcuccauaaacauguuuucauaaacgcuugcuggcagccaacuugccuggcuuucagaguugcuauaacaaccagcaguccucucagcagccuuggcacucugcauucuuacaucuuuuaauaagaaauaucauuaucuugucugggcucauuagcucaauuauuuaaagcaugguacuaguaaagccaagguagaggguucaaaaguaugcauuagcaagaaaauucuauccauguguccuuugccaaggcgacuuguucauucauucauucauuuaaaaauauuuauugaaugucugccaugugccagguucuguucuaggagcuagaaauaaaucaguaaaauuaaaaaaaaaauauauauauauauauaaacauguauauaaaccaacaaaacaacaacaacaaaaaaccaacaaaaaaaccccaaaaaaacaaaaauaauuaagaugccaguuuuagugaugucuauagucugguuugaggggcaagaagggagacagaugcugacuaagcaacaaauuaauauacauguagaaauacauguagagugagaacaaugaagacaaagcagggaaaggagacaggugcuguguuagggugaggagaaagugccucuugauauggugacauuagagcagagauuucgaugaauugaauaagaaaagcuguagcuaagucauggaagaacguuuuaaacagaagguuagcagggcacaagcucugaggugagagugugcuuggccggaucaggaccagccaggagaccuguaugacugggguauuagucaggguucucuaaagggacagaacuaaguggauagaugaauauaugaaggggaguuuauuaaggaguauugacucacaagaucauaaggugaagucccacaauaggccaccugcaagcugaggagccaggaaaccaguccaaguccccaaaccucaaaaguaggaagguagauagugcagcuuucagucuguggccuaaggcccgagagccccuggcaaaucacugguauaagugcaagaguccaaaagccgacgaaucuggagucugauguaugagggcaggaagcauaguacaggagaaagauggaggccagaagacucagccagucuaguccuuucacguuccccugccugcuuuuaucccagccacacuggaaguugauuagauggugcccacccagauugagggugggucugccucucccaacccacugacuuuggcaacacccucacaaacacacccaggaacaauacauugcauccuucaacccaaugaaguugacacucaauuguaaccaucacaauuggaguggagugcucaagggaagaacagaaggugaugaaaucagacaggaagagaugaucuguccaugcagggucuuggaaaccacuguaagggauuuuagauuuuauucugagugagacaggaaacgaaugcagaguucugaguaaagggguaauauaaucugacaucuacuuuaggaaaaauugcuuuggauccagagacucuacguaggggcucaagaaggaaaggggaucuguuaggagguuauugcaauuaaacagaggagaggugaugacagcuuagagcaggugccaaggauuuaagaaauaaucagacucuggauguuuuuagagguagugccagugggauuugcugaugaaauaaaugugaaguuuuucucuugagcacuagaaaaaugaagacagcauuuccgcccuggggaagacugaaaaauaaaagcaugcacaaacuuauuugugugcauguguguguguguguguauguguguaaggcagaauggaguuguggaugccuuaauguugagauuucugugagacaucuaaguggauacuuucaucuaggcaacuaaauguaaauaauaaaaucucuuuauagauuucagaguucaggagagaugucugggcuaaagauacaacuguaagagucaucaguuuauagauguaauguaagccacgggucugaauaaggacaccuaggaaguaaaaaugauagagaauagaacacaaagaacugagccuuuggguaauacaauguuagacuugggaaagauaggggaggggcauccaaaaggagagaaugagaaggaauggccugcaagauggaaaaaccaagagauaauggggguauuggaagaaaauuaauucaauaugaaggaauuuaucaguuaagucaaaugcugaugauaggucauauaaaaugagggcugagaauugacaaauucggcaaugggaaagucacugaugacuguaguuagaucacuuuuaguaggguggaaaagagaaaaauuuccuguuaaagagagaauagaggugaagauggugauuacaagaucuuuugggagguuuugcuauaaagugagcugaaaaauuggacaguaacuggggguaauguaggguaaacagaauuuuaaaaauucaaaugaggacuuauugugacauguuugcaugcugaugaggauaaucgacagagaggggaaaauugaugaugugcgugagagcagggguagugaagccuuugaguagacaagaggggccacauaguuuaaaugugggaaauuucauucauucauuccaaaaaguuaagcaaacaucuaccaugugccaaauacacagcuaaguacuaggaacacagaaaugaauaaaacaugguucccauuaucaaagaagucauuucuuugggagggagaauaagcauuuucucuaauuaauaauucacguucaaugcagugaugguaaugucagagaaauguacccagggcucuuuucugggaucuuuucauuacagcaugcugaaucuugggcugccaugucauuagaagccuagauucaagaccuucauuuccaucaugcauugacauguucugggcuguacuacugaugagacugauuuaggcaagaguucugggcaugaauuggugcuguggcugcacagauaaagucgaggugauagauuugagaacugugugcuagguaaaucagcaauccuggugauugguugacuugaaguaagguaaagaagagggaggcucaaggauaacuccuagguuucccauauuuaguuuuauccuggaagcgaggaugcugauaaacagauuccuaacagguagcguggguggauaagaagaagaaucugggcccuuuucuuaaaaaaaauuaaggucugauaaauaccugauacuuucaaaaauauuugaaagcagccagauauuucugucuauaaaaagaaaaaaaaaauagaccugaucucuauaggaugucacaaacgcucaaaaaauaaaagauaggaaagacuaauaauacaaugcuagaacacuuuuugauacuaccuaagagacuuaagaaaaaaaacaccaaacccccaaaacacagaguucuugguaugauguauuuguuuuuccauagaaugguuugagaaauucagugaaaauuaauuggaacaugugguugucauucacaugguuccagacuuuaugggcuuaauaaaaacauuaugaauaguuuuuggaguuuugggagaagcgaacauggcuggucuagguaucugcuuuuagguuaaucccucuacgcaggaaguuucacagugucauacagugcuuuucaauuuuucccacucaaaugcucccacuaucagagggaugagaaugagcuucccuggauggcagaggaagaaaggggguaggguagucugaggguguaacuugaaguuucaaguugcaaacauaaaguuuccuuuaagucuaguauuucaauuuaacaguuuagcaaauuuucugugcaauuccguaaaauauucauuucuuucauauagaaauaauagagucucccccuccccccaccuuacccugcucugaaucacugaguaaaaccuaugcauggcgaagauaugucauguuuuaucucaugacuuugauugcauccuuguauccugucacaaagcaggggaaggggaaagacacagaaccaaguuucaggaggccuggacucuucuacgccaguucgacauuuauuuuuuaauuuucuuugcacucuacuuauuuccaagaggaguuuuggaguugcuguaagacuuuuagaaaauauaaaugaucugugccuugauuuccuuauuucuaaaaacaaagaaguuacucuacaugaucucuauauucccuucuuaucgauuaagagucuacccacuuuugguccaagcaaaauguuaacagggcuaguggauggugguaccaaauguauacugguaaccgaucaauuaacauuuuggaaaaaauggaauauucagcuaagauuugagucaugauggaaaccuugaauuuaaaaaaaacuaaccuugggagauuauuagaacuuagaauccacauauuugacaugugcuguaaaaagagguuauuucuugagaaguagaauugcaacuuucugcugaaaaaauaucaauccuccaaggcauccucaguaagcccacaggcaaacucccaccucagcagacugaauaauuugccuauaaaauaucacguugaauuugggaggcugaauauggugggaaaaguuucauguaggagaggaccugcccuggagaugcucgcugagguggcaaaggcaacuggacucucaaaguaguccuccguuuaacaacaucccuuucucagguacuucucucaucugcccgauuacuuuuuuuuuuaaagccugacaggaaugaugcuuccagauucugagaugguaacaaugaucuaaauagacugucaucauuuaucagcauucacaaagagaaaacagcuaugaauuuccagugggaaaaaaaacuuuagaaucaaaaaagcaaaagguacauaaugcuguauccagugaaaacuuauaaaaguguaauguucgcuuuaaacacaauacaccacccugagaggguugccuucaguaaggaauuguuuuccucugggaaggaaaucacuggcaauaccaaaucuauaaggagugccuuagaaacuuggcugcaccaagggccguguaguuuugggaaaacucagccuguuuucuuugucucuagacauuuuuuagacuugauaaucccucacauggguguuggggugucuucaaggucuccaacucugugcuguacuucgaucagcaaaugcuuggggagaauuucuguuuugauugcaucugccauuugccuccacaaauuagacuuuuuuaaauaaaauguaauccuuuuuugcugagacaaggaugaacacaauuuauuuugaaaagauacauaaaauguauuauaaaagacacaaugugcaaaccagaaauugaaaacuaaaaacgaacaucaccuacacagaaaauucuaaguucuuaaaccaguugguugaacgaccuugggcaaguuguuuaacuucuuugaaucaauuucuucuuuaucuguaaaauaaauacuuauaaucguuucaagaaaguuuauugacuagaaucccuggagccauucaaacagauucauauuagcccucagcguggcuaauggcuucaucucaauucuaagugcggcacauacuuucuugaaaguauuguuaaguauuuauuuuauagaugaaaacugguuaaaaacuacacaguagcugcauacuguaauggauucugaaaaggccuaguucaaacucugaccuucuauaaauaacauuguggccugccauaugaaaagacaguauugcuaguguccuguugcugcaugggugaugaaauuaggacacggaccaugaaugaguugccugauucugaaucagacuaucaggcaguacagaaggaugccuuccucuaagaguucauuauuuccuauuagaaugcugugugugcugcacauagaauugagguggagcccuuagccacacugauggcuaauuugaaccuguuugaauggcuccagggauuccagccaauaaacagaaacuugucuguucaucuguacauuccucucaaauugguugaaauaaauccucaacacuugauguuucugaccugguucacagauacucaggagcagccugugguauagcauuaugagaaauuuuccagucuguugaguagaaguaauccaauccugucacuguuugugguagaaaggagagagaauauagagaugagauccaagaaaacaagaaaaguucugaggccuagaagaaguggaauucuguggcaaaaagucuggagaaacugaauuugaguuuauggaaaaagccaaaagacagaacauccuggagaauagagccacucuuugacuggaagcuuggaggaugauugugaguagaauggccuaugucuaauucuacaugcaggaggauggagcagguggggccguuucagggccaggaaagggucucccuucuacuggacugggaugaaacaagagccaaggaacaaauugaguugcaguagcagauagaggagguccagucugaggguaaagcaugguguccaaguagcauucagcaauggcagagcauaaaguagauaguuccaacugguagcccaagauaaagaagcauucaaauguaugccuguggaugguguucccuucccacaaggcacagaggauucugggucaggcaucacucagaguuccagagggaaggguauacaucugucaaugcauagcaggucucaguuauucagcccaaagcaaaccauuggcuaaaaccuuugauaaaaagaaaugugacauguagcauggaggguggggcaagacugaggcucaggaaugggacagggccugucagaauuaccagaagugaggcagcaccacaagacuagaucagcagcaagaguuauuugaggugcagucacaaaaggugaguuagaauuuaaauacaugccacuuugggucugauuuggucuuaaguguguaggccaaggcucagucuugagguagagcaugaucucauuugugguaaguugagaguaugcugaaauucagcaugaaaauggagaucagagauccuccaccuugcugucagucuagacagagacugaaaaacuggguuaaaacuuuaaagucuuuauaucuuggauauggagauaaacaagguaauacugccuggauaaauaggggaagaagcuaucaaaaugguauugaucuuuccauuuaagacuaucuauuaccauucaucucuucaacauuugaaaagauguucaguauaacauugggauuuuaagugaugauuguaucaaaaaaugauaaguuuaaaacauuuuaaacuuaucagugcacaagaacgggaugaaugcuuauccaguauuucuuucuguauuuauuauuugaguaaaucaugaguaauagguuggucccuuauuuaaaauuuuaguuauggucaauuuuaagaggaacacaauaaucuuuuuuuuugucuucuguacaguuauaucaauuuuagcaguuuggugucuaguuuuaccaaugcuauuuuaugaucuuugccauuugccaugguacaauguguuuaaauggcacaucaagguauacugaugguugccauuugcuuaauaacuuaaaaguaauccagcaauuucuuccacuuuuauuucuuaacauaugauuuuguuuugugaaacaugaaagaugagucuuauauuuaggaaccauuugguugggaagcugggagaguaaaauuuaauugauuuuuuuucuucugcagcucuugaagaaauagcaugugaauccagauuagguggcaucauguauauuuuuguaaaaggaauuuuuacuugcuuaggcugaauucauccuuauaagccucccucagccauccuuaauuccucccuuucucucacuccugaagucaaggauuacuauguuuuauuccuuuuucugcugcaauaucccggacucuucucuguccaucacuauagccacaucagcuaauaagcuccucuuccuguguccuucuucccucucuacucauccucuauagugccaucaaagucagaguauuaauaaacaaauccugacaugucagugugcuuacuccccacauuuugaacggauuaaguucaaaugccucacaggauggcauuugaggugcugauccuaauuuaucuuucuaaccuuguuucuugccucuuucuuccauuccucacaugcaaacacugaacuccaguaacaccacuuugucuucucaacauacucugcacuauugugucuucaugccccuugguacaugcuauuuccucugcccagauauucuuccugggcuucuguaccuguugaccccuucaacucauccuuuaaggacugguucaaagaccacuucugugacaucaucccugauucccacagaguuaaacaagacuucuaugacacgccacagcaucugaaauacaucugugcuggaaacuucuacuauauugccuuguaaugauuuguuagugaaccucucucuuccacuuggucuguagcuccagaaaaccaguggcuguuuguugccuacucgucuuugcuuuauucuuccuucugccuguccaccugcucucccaacauccaggggccaggacagucccuggcacacaaugaacacccaacaaacacuugguuuaagcaaugaauuauuaucuugcacgagauuucaugagucucuuuaguuuugcuuucuuaacuuacuuaaugcuuauuaagaugacuuuucacuuucaguucuuccuguuugauuccaguucuuagucaugucuuccccuuggcacaaaacugauugagcaauauaugcugaagccucacucuucaaauuucaugacaaagucugagggucccaggacuuuggccaagcacaaauaguaagugucugggaggcaucaacuaaauuaucugccagugaaaaugcucugucuucuuugucucaguuguuuaugcagaacaaccaaccguuccuguaaaguuauuuuuccuaauuuuuagccuaaacuuuucaauagauacaggccauuucucccugucuccuccuaucuccucaucuucugagacuguaaauuauccuguaacuucauuuauaaugggaacauauuuauuuucugugaugauggcuccccugagccuuucuuuuucuuagcuacauaaaguuaacuuccucuguggcaaauuaaggacagauuacaagcagccugggaaccgggcuccgucaccacagggggccgccuacucagccuccuucuguucagccaugggaaagaugcagcugcuaagccagccgggugcugggcugcucucccccugccucuccugaucccucggagggaguugagaagucccuuucuccaucagucucugguuggugucugaugcucuguuuucuagccucucuucuucugcuccuccccucccccagcugccuaccaacuccuucccacccccaggccagcagugacugccuccaagacucccccuccuuccagcaccgccucaugguuuccauggcaacagaaaauguuggugggaagcaaaaaugcugaacugcaacucguguuggggcugggaggaggaggugaaaugugggccucucuggaggcuguagaaagguggggagaaagaagccaggugagaagcccugagaagaaaggaccacgaggcucgaaaggaaggugcauuggcaagcggggaucacuuugaucagaaaaaucagcuaggaggaagaaauaggaaagaguuauaaaaaguaauagagaauccugggccgggugaaguggcucacaccuguaaucccagaacuuugggaggcugagaugagaggacugcuugagcccaggaguuugagaccggcuuagacaacauagcgagaccuuguccccgccuucaaaaaaaaaaaaaaguaaugaagaauccuauauauagugguugauugagggauuacguuagguauaaaacugggaauaggugacuuuauauugaaggugaguagugaaagucaacaaacauaguggccaaaaaaaggggggcuugagaguuuaacaauaauauacauacaugaaaaacaaaaguaauauuaacagaucugggcuuguaaauuaacuauuguccuuacuuaucagccaaguguuacuuaucuucucugagccuuagucuucuuuuugcuugucuauuaauauaguguuaucaauauccaccucaaaaaguuguugugaggaucaaguuuaaauaaagcacauaaaguggccacucauauagcagguaagguaggaauuuuucuuuuaaccauuguaugagguugaggaaugguacuucaaaugggucuuggagcuggaaacuuaaaauucauugaaaacugugccuugucauauauuugauuuuuguauuuauuucaauuuuccauaucucuuaaguauauggcaacaugguuuuuuuuuuucuuuuuuuucuuuuucuuucuuucuuuuuuuuuuuuugagacagaguauugcucugucgcccaggcuggaguacaguggugcgaucucggcucacugcaaccucugccucccagguucaagcaauucuuccgccucagccucccaaguagcugggauuacaggaacaugccaccacgcccagcuauuuuuuuguauuuuuaguagagacaggguuucaccauguuggucaggcuggucucaaacuccugaccucaggugauccaccugccucggccucccaaagugcugggauuacaggcgugagccaccaugcccagccagcaucaugugacuacgucccuaaguacauaguaccauggcaauauuuaguguuaaccccuucauaaaaaauaagaagaaccauccuuuccuuuuaaauaaccucccugucugugcuuuucaagaagccugugguguugacucauucucucuccuuuacagccacaauauuguuggcaucauaacuucucauuucuuuucucucucuucagugaaagggguugcugcagaaauuauguucuaaacccacaaucauguuuauaaugguccacgaauauuuuuugacugaaugucugugucaucacuuccuucagaaguccaaggcaagaaaagcuaagaaguuguggcccaacuagagaugcccauaagccuauuuacuccgggcugucucuuugcaaucuuagaagaugucaaguuacugcagaggcucuacuucaugccuccuuuuccugaaauugggacaauaauagcaacgaugauaacuagcgccugaacuuguuguuccaaagugccugacaugaauggaaucauauaaacuucaacucaacccaauggaauuagcauguuguuaccgugacgguuuccacauguggaaacugaagcacagagacauuaaguaauuuucuuaagguaauauaccucguaaguuucagggcuggaauuugaaucuaggcagaaucuaccuccuuaaucaucuccacugugcuacccucuagggaagaaauaucuggaacuguggcuugaugauauuacuacugcuuuuuauagacaacgauuuuuuuccucacuugguaucaucuaaugaauaaagaaggaacguguuacuguacuucuauuucaagauguguacugagcccauugguuuaucuuuuuucuccucuuagaucccaguaaaaaaagcuaaaaaaagaauucaugaucuaacaauaaugaggauaauuggagaaaagcuauauggaucugggagauuucaauaaauuuccagaagucagaaagagcguggaaagaugaugcaguggggcagagguagcuuugggcuaguguguuugcagaggguccugaaucaaaaaaagagcccaaguugcccaucagaaccucggaaguuucagucugagagaauggagaugggauggaggaggagauagagaagugaguagaaaaugaggaugaauuuaaaggucuguguauugaacagcugcccaccugccuguaacacacauauccccaccccaaucucucuuucucucucuguuucucucugucucuaucccuuucugucucucucucucucucucacacacacacacacacacacacacacacacacacacacacacacacacacacaccaggcauuuacccuccauucucaggucaaaaaggaaguaaggcuaacucucuaaagacauuuuaaaaagccuuucuggggagagcuggagcaacuaguacagugguguuugggacacccugaucauuauagggacauucugcucaccacaacacaaaaccuggaaauuaaaaaaaaaugcacacagaauuuccaguuugcuuuuccauugccucuuccugaaauaugaacagaaaaucacaaacuacagucauuagaggauagcuuuuagcacgagcgacaaagaucaaaugggaaauaaugcacagcagaaaaacuaacucaaaagacaauuccaauaaucucaauauaaaaauaacuaaccucuaacugguguuucuaacagguucaaaacaauacaucagaggaaaaagaaaagggugccaaaaaaggaauagagaaaaagagccuugagaaauugaaaauauuauugccaaaauuuuaaaaaucuauuuaaacauugaaagcaaucuccuagaguguaagaugaaaauacaaagaguugguaaaugugagcacaaggauaaaagacauggaggaaugauggaagaaauccaacaccugccuaggaagauuucacaaaaaaggcaauugaaacgaagagauagauagaaaugaucaaagaaauaauagaagggaauuucccaaaauguaccuuuauauuuaaagugccuaccaaguguggaacaggaugaaaaagacacccacucagucacaucuuagugacacaucaggacacugaggauaaagagaagauccugaaacuuccagagagggagaaaggucaccgauaaaagaaacaacgucagacuccucaucaaacacaucaaacacuguaagacaagagagcauugucuuccauacucagaaaaauuacauccggccuugaaugacauacuaagccacgcuauuaaucaaccacaggggcagaauaugggcauuuuuagauucacaaaggguuagaaauuaaucuuucauguauuucucagcuguuucuuuuauaaacaguuauuugaaugugugcucuggcaauaugaaaaaugacacagggaggaaagcauccaagaaacaguggauucaauggaggacugcaaugaagagagucccaaaaugaugaauguguggcagucucagagaacagguccagcuucggacaggaagacuaaggauuaauguguggcagucucagagaacagcccagcuucggacaggaagacuaaggagaugggucccaggaaaaauguagaucagaaaaacagauaguaugauggagacuaugaaaaucuuaaggauaaaguaaagauaggaaaugcaagaugaaggaaaaguaaucagagaugacaggaaagauuaaacaggguuaaagauuaaacaagauuaaaaaagguaaguucuaggauaacucuaauguucccaguaacugugcaaauggguguaaccaucauuaucaugggugcccugccucucaggacccagguaugggguuuucauucuugauacggcuucccacaccccacgaguuggcauagaagcagagaaauacuuucaggucccaaugcaagcuuggaugcugaggacuucagcagggaccaccauacaguacagauuucccugugugccuggcagcacuaaggucucuaguauuauggggugacaacaggagaagccaauccagauggcaauggaauuucaugcuggcuuugccauggaguaaaaacuaaguugacuugaaacacacacacaaaaaaauuauauuuugucgcacuugaauuugugggcuaagauucaguuugcaacuguaguguggguagaggaauuaggagagagaagagaugauaguauugacaauguaaauccucaucucucacaucagaaugucaguaaauaauaucuaaaguugauaaagccaaaauuaagggcauuugcauguuauauggagauaaccaccagaaggacuaagcacagaaauauugaaaguauuugcuuuuggagaguggggcugggaacagggagaagaaugcaggaaaugguuuguauuaaaguuuuauuuguauauuuguuugaaugcuugaaaauuauauauguauuauuucauuuuuuuuaaagugugcuccuuucugucaauuuuacucuccuugcuacaguguaguuaaguuguccuuggcaucauuguuccugugucuauguagaccaccuguuuuggaagaaggugagguuaucaaucaaacggcuaaccagucacaggcaucuacucauucacuugcuaagcuccuuccucauucucguuuccaagagugcuuucaaggacacaagagaagacccuauuuagugcugucauugucuugguugugcgguaacaggaagcagagaagccuuaauuuuuagcaucuagacuucagcuccaaauacugccauugaaaugggaagcucugauuacagcuucuaaagugcacuguuuucucugugcuacagaacugucuucugaauuaguaucaauaaaacgcuuucuaacaggaucuuugacaccagaagucaccacugaugccaauguaauuaccaucccuggacgcuaggccuugucaggcagcacagauaaucaccuacaaccaggggccaacgauuacccagucagucaacgacauugacugcucacugggagguucugcacgaguaagagagaggagaacugcaauguccuuuccucaaaguacuucaaacuaaacagggcugaggguguggaggggaaggaaagcagagauucacacacaucaaaagacagaaauaaacaaaccuauccauucucaguuacacagagagggcuguggagaucugaguuggcgcagaauaaaaauggacuuuugcaucgccuggccccuguuugguaaaaaccuccuugguuuuauguauuuccucuuuucauuuuuuuuaaaugguguuauguauuuccucuuuucauuucuuccccugcccacuaacugggcucaacuacugaauaaccccugugugccaugcuuuuucugugcuuccauacuaauuauaugcuguuccgcuugccugaaagcuguuccuaucacucagcccuuucagcuugcaaauuuuucuaaucuaucaagagguaaaccugaccucuucuguggagccuugccugauucacuccauuuuaauuccaaucaguuacagugcugugagcuuugugagaggagggacagaguauauuaucauuugaaaauaauuaaaauuguuaauagauguaaaacacuuagaauaguggugccugaaauguaagcaaauguguuuauuauuauuauuauuagcaucauuacuaugaucaauguuuguauuuagaagcccuagcauaacaucuggcauaugaaaguggaaacuaagcaaauguuucuuuguuugaauucuuggaacauuucagacaaacugaguuuuauugaugagaagguugauggguuuucuuggcaguggucauuauuccaaggugaaagugaggauuauugcuuuagcuauugcaacugagaacacagaauaucuuuuaagaagcagaagcucuaauaggugaauaaaucauuuuggaggauaggaggauauuccagaugauaugaaacuauugaaaacagauuugcuguugguuuucagaaaauguacuagcccucaggaagaugggcuuguuuggagagauaccuaauguaacacaaauaacuucauuuucuucagcauuaucuggaauagaugguuaauuagucucagacagcuguuuccauacucacccgccuuugcugucugugugaugugcacgugugugcugucaucugggugagccuaucugggcacagugacgggucauuaagcugucuucucauauggugcauguauagugucugaagcacaguuucaggagacagguaacacuuccacucagagaggcauuacaugaccccuaggguugucaauagauccguagcucuuuugcucuucaaacacuacaugcauuuugacaucucaccaucuuuguucauuguuccauucacuguuauguccuucaccccguucuuuacugcuuacauaaauacacucaagcccacuuccuccagagauuucaccaucacuccagcucauagauaucucuuccaucuccaucauauucagcuugcuuucuucuuucuuugucucucccuuucucccuuucucucuuucuuuuucuuucucucucuuuuuucuuuuucucucugucucccucccucccucccucaaccucucucucucuauuuuucugaaacagaguuucacucaguuucccaggcuagaaugcaguggugugcucagaguucacugaagccuugaacucuugagcuuaagcaauccuugcgccucagccucucaagcugcugggacuauaggccaccaugcccagcuaaucaaucuuucuuucuuucuuucuuuuucucuuuguuuuucuuuccuuccuuccuucucuuucuuuccuuccuuccuucucucuuucuuucuucuuccucucuuuccuuuccuuucuuccuucuuucuucucuuucucucucucuccuucuccccuucucuccuuucucucuuucccuaccuucccucccucccucccucccucccucccucccucccuccuuucuuucuuucuuucuuucuuucuuucuuucuuucuuucuuucuuucuuucuuucuuuuucuuucuuucuuucuuucaagauaggagucucacuguguugcucagacuggucuucaacuccuggucucaggcaaugcuccugauucagccuuccaaacuggcugggauuacaggugcaagccacugugcgcagccagucauagauuucuaacacuaauuucuccaauaguuacauuuuauauugugaaaacacuuacauuguuggcuuuuauuaacauuugaaugugauuugcuauuugcuguuaaguaugcuagucuuagcucccugaguagacuguuggaucuuuaagcagaugcuguacuauggcucuuuguaguuucuaccacauuuagcacaguuagaugaguauauagguacuuaauagguguucccuuaggaaugaauggauaacccuccugggauccauucaaaaggauucuccugagaacuccuuaacaaaggcuuaucuacuuucuaguuuagacugucaacacaugcuaaaggauaaaagaugcagauuugaaacacauagauuuacauuuuaaaaugcuguggcauauuuguuaauauacuucacagucugaaugcaaguuuagguuaguuacccuugaggacaaagcuacuagacucucgaggauucaaauagucucauaaaaaucaucacaauguuaucauugguaguuaagggaacauuuuauaauaagugggugucuuugagcauguuuccuagggaaagugcuaagugcaaucuaguccauggaagucccacaguacucugcgaacaaccugcacuacuucauggccacuucaccugaauggcucaguucuuugaguguccauguagucaacuaaucagucuguggugaguaagaguaaauuaaggugacuaacuuuccaaaguccuuuaaaguuauuugauuuaaggucgcugagcuaggugguuuauggauauuucaguauuccuggaauaauucauguaagcuuuuuccuuguauccaauauauuaugaggguaagagcaaugaagcccugugccaauuucuccauuucacuggcuaaucaguaauucuaacauuguuugccagcuaaauggaacaggcacucuugucaccaucaugauucauugccuacugaaagcacagagcuggccuuaaucuaauucuuaauaaaaccuugcgaacuagguauacugucucaauuugcacacggaaaacagauguucacgaagguugagggacuggcccacgaucucacaccaaguagguaaagaaccauggaagcaauucugugccuuaaagugcaauugucuuucuaauuccuguggagcaugauugucuuuuccaugcugaaucuaaugauuacaaauaucaaaugagcccuaagcauggcccuguaauccuacuccauucuccuaguaaacucuccuucccacucucugaaacaacuuuuuaauaucuucucuauccuuauaucuucuacauccuuacagcauuauucacuagaaaacagaaaccaucagaagaaacauauuuccauauucucaaugccucauauaccagucaugaugguacccacucucucugucuucccuccuguuaucacaggaauguccccauuagcaaccaacucuccacuuggcucuggaucccaaccucucucaucuuuauucuuuccauccuucuuucuuuuccaauaucaauaccucuuuuucuaccuaaucauuccuuucaguagccaaacaugacuccagucucuccuguuuuaaaaaauucuucccuuugccccacaagucacccuuuagcuauuaguguauuuccguacucccauuaucagaaaaacuucuuuugacaguugucuacuacuucuucuauccaaugcaacauggcuuccguggcucucauuucacagaaugugcucuuguuaaguucuccaggagccucuguguugccaaauucaguggcuacuucucuagucucauuucuuuuuuuuuuuuucaccuucaacuuuuauuuuaaguuccuaggguauauguauaggaugugcagguuuguuacauagguaaauguaugucuuggugguuugcugcacagaucaaccaaucacccagguauuaagcccagcauaccuuaacuauucuuccugaugcucucccucccccaacccccaccccugauaggccccaguguguguuguuccccaccauguguccauguguucucaucauucagcucccauuuauaaaugagaacgggcaguguuugguuuucuguuccuguguuaguuugcugaggauaauggcuuccagcucaauccacaucccugcggagaacauguuaucauaccuuuucauggcugcauaguauucuauggaguauauguacuacauuuucuuuuuccagucuaucauugauaggcauuucgguugauucucauuugaucucucaucagcauucuaccuaacugauaacuuucccauggagcaaguuuuucccauggagcaagcuuucccauggagcaagcuuuugguagcauucuaccugauaacuuucccauggagcaagcuuucuaaacacuuugaguuugaggggucaguagaauauauaggagguagaaaacuuugcuucuguugaguaucggugaaguaaccuaaggugaaagugcagagugagaagagaagagacucaagggcuaagccugaggguacaggcggaagcagggagggcuacaaggaagacugagaagguaggaggagauaacagagacaagguuagaagucaaggacaaaaagaguugucauaaaaaaaaaaaaguggucagaaucaaaggccagagaaagaucggguaaacagggacuaguaaaaguauauugucuuuggcaauugagaguuuauugguugccauuuauaaauaauuucaggaugaugacagaggcugaugguauuaaggccugauuguauuuuucugaagagcaaaccagcaaguguaggcauuauuuugggaggcuugguuaugaagggaagaagaguaaguggauagugucuagagcagaauaagaauugaggaagguuuugaaaaaaaaucagguuauaucugaguuugcucagagaggguagagaagaaggcuucccuaauaucacagcauuaugcaagaacuaaaaauagaaucuauuucuucugccuccaagauaauugagauaauacauguguaagaguuuaaaaaacuauaaaguacaauaagaauuugauauaguguucuucuuuccacuauauuacaauuaauuaccaggaagucaauggauugcauuuuuaacuauauaacacacccuuuaccccacucccugcaacaagaaccucacugcuauuuauucagcaguucuuaaaugauugauuuguuguggaugaucuuuugcuugcuuccuuuugaaacagugagggauuucuggauguuugccagccugaauauuccuguuuacuugucuuaggcuaacagauaacuggaugggccauauuguuauacaggccugaugaaugccaaauguucagcucuaucucuacaggauuacaccuuucugaaaaaagaauguauaauauaacuucugucaaauaaacuugagauacauuuguuucuaguccucagauuucaagaucucccuuaagacuuuggaaggacaagccuaauucucuuugccaggcaugaaaccagacauuagcuuauaaacucaagauguuccauaauucuuucaauaugaauucuaauuaucuuugcuccuucuaagagaagguaaaaguauaacaaugugaaaucuaauucuauggacucaaggggcagaaaucagugaccugauauucagaggccuauauuaauuauccauuuuauuuuucucaccucuguaauuuguaaguagaguugcaagggcucuuguucuucaguuacuauuuuagaucauacacucucaaaugaauggauaguucucaaugccugcgaugcgcuugauucacacagacuagccuagguugucugaaaugaagucagggagacgcaugcaaugaccuguaagguguuguuucugugucuuuguagccugaguuuucuuguggauaaaaaucuauagccuuuuauuaugacagcucauuacaccacagaaaaaacuaaacugaaagauagaucaugucuuccaugaucacugcuacuguuugauguggugucuccugcaugaaugaaaugacugccacucagaaggucucauggucugagaacaaacuugaccuggaaauucaucuguauuuuuacaacccuguguauggugagaaaguuuccuuagucuagacugcuuaauaucuguauaaggccauuuuuuucuucucucucaccucucuuguugauacuccucugaaucaucauccacccaagaucaaggaaugcucacgcuacuuuuguuuguccagggcucagaucuuucucagcucacucagauauguugccccaguaucucuuauugaaaacuuuucccuauggacucagauugaccucaguuuaaaucuucagugcuuuggaccauauauuuagucuuucuauaacuaaguuuugcccuuguaaaacuggaauaauacuacauacuguguaacauuugugaggggguaaagauaauguaugugauaaucauauaacaaguucuugauaaacaauaguuauauuauuaaauuggcuauauuuuuuuucuuucuauaaaacauuacuugccuaaucaucaauuuccuuggagugcuucuaucagguaguuaucaaguguaaggauggaacccaaauaaauauuucuuguaagugugauuuauuuagguacuggaagaggcugcaaaauaaaauggaaagaguguagggcuagaaaggugacaaguuccugguucugguguugccaguucucauauuaaauagcaguguuaucuguauaugauuacccaucuaugaaaaacucuaaguuauuagaaagauugaauucaucauugaugaaagagauccuucaggcaucuggaaucuuauguaaaccucacguagacugaguuuaauucaauuaaauaacuauuuauugaaugaucauuauggacugugcuuggcaaugugggggauaauaaacaaaggcuacacauauacacacauuuauugagaacuguuaugaguugaauugugucaccccaaauuuauauguuggaguucuaaccccuaguagauauguggauauagauacacauccuaguagauauaguaggauguggccuuauuuggagauagggucuuuacagacauaaucaaguuaaaaugaggucauuagggugggcccuaaucaaauaugacuggugcauauucgacaugcacagaggaagagauuugaaacacaaggagaaggugaccaaggagauagguccagaauggcuccuucccuuauagcccucagaggaaccaacccugcuggcacuuuggucucagacuucuggccuccagaacugugagacaauaaauuucucuuguuucagccaccuaguuugugguucuuuguuguggcagccauagcaaacugauaugaagaccuacuaugugcuaguaacugggaaacuaacacugaacagggcacuguuauuuguuucaggggaagaaguuuggaaaagaagcagauacuucagucccauguaauaaaccugcuccaagagaaguauguacaaggugucaugggaggacagugaaggacaguugaguauuaccaaaggcuuguuuaaggcuccucagcagggacuucuaagccaggccuuugaaguaagagugcaagaaugagugcaagaagcaagaguucugggcagaaaacaguguuuauaugaggcaguguaugcaaaggcacagauaucugagcagguguggcacuguuguagaacuguaaguaauccaacauggccagagcuuaagagcagugaaagauaaggcuggagaggugagcaaguuccaggucaguagcggaaggcucccuggagcaaggggagcaccuagaaccuugagguaggucuuccuugauuagcaaucgcgaggacauaggcuauguuagguaggagggaaacuguaaacaaaagugaaugcguauauuuauuuggcagugagcauucuggucugguuaaagcagacauccucuugacaagcagagcaagcaagugagaagcuaagagguaagauaaagucucucaaaggaccagaaguaugacaaacggagugcuuugagggcagggcuaguaucuuguuuagugcuugcaguauagcaguggcucaagaaacaaucacugaauaagugaagggagaaguggugaaauucuguccuuuuacugaauuaagcagggacuuuuagguuacagagguuugguuuugaaaucuaggcucugcuggcaauuuuuuuaaccuuguugaguuucauccucuuuauuucuaauugugaguauacuaauauugaccguauuggugagaauuauaugggauaauuuauauggaacuauauagaauuauggguauacuaauacuuagcaugggauaauuuauauggaauuuuauagaauauauggaacuauauagaauuauaugaaacuauauagaauuauggguauacuaaugcuuacaguauauggugagaauuauaugggauaauuuacauggaaauauauagaacuuaaaaauuccauuugaucaauauuuauuaagaagcuacuauaugccaagcccugugguaggcuuuaggacuagaaagaugaacaagacccaaucucugccucuaaggaauuuacuuucuguuagggggauggggaagcagacaucugaauagauaaaagaacugugaugcaauagaauaaggacuagcuuagggcuaagaacagagcaccgugggugcacagaggagggacaguuacgccagccagacggcaggauaguguuggggaauacuuccugggggaagugaugcuuaagcugauucaugaacaaugauacgcaauuaggugaagaaggaagaaaaaggaauuccaaacagagggaacaacaggcuuccuuugcagcuguguuuuucuaguuccugugccugugcaauuccuugcugaaaauauacucuagucggcuugguuaaagcaaaaacacccucucuagcucucgucagacuccugaagguuggaucgugcucugaacagccucagcuauuggcuggcuucucuuuaaacuaaacaggccuucagaaacccuucauguagccaccugccugaucuccucacucccuuucuccugcuuucuuucuuuucuuccuguccuuccucgguaucugcuuucuuccuccucucauuaaacauuuccuaugucuacauguguaaacuaugggcugugccuggagauacaggggauaaaagcauacaucuaacucaugaggagcucgaaacugaaaguagggucagcgagcuauggcccauugaccagauccgccuguuuuuguaaauaaaguuuuauuggaacaugcccacgcccauuuaucuauguacuggcuauggcugcuuucaugcuacaauagcuguguuguguaguugcaauagagaccauguggcuugcaaagccuaaaauauuuaccaucuggcccuuuacagaaaaaguuugcuggccccuguucuaguguuuauauauggcagaagugguggggauagauggacaaguaaagagguaauguaccccuguaagauaaguuuuucaaaaggguacuauagaaggagaguuccuaacccauacuuggagauugagaaaagaacugagagcuaaaaaaagugacaaguacgcuuagagcuaaaggauaaaaaggaguuaagagggaaaggaagaucauucuuggcagagacaguagcaugugcaaagccaggcaaugaaagaaaaacaugcaguucucuauugcaaaaagaggaagcggugaaagauaaggcaggaaaaucaguuugggccaggucauuaaggauccuaaauaugaaaaccauauuaaggauuuuagaaaugcccuauaaucucucccauagguaacugagaaccuuugaaggauuuuaagcagaguagugcuaaagcaaaugugugcucuagaaagaucacucuggcuguaggauaguuaacauuuacugggcauuuauucuaugccaggucugugcuaaacgcucuuugcauuuggaaauaucuauugaguagcuggacagcacugggaaccagguagaaagaggugaaacauggagaacagauauggaucuaugagaaccagggaucucccuaagggaugaaaagguguagagcaccacccuuauuuggaggcaugaggagaaguagaagaacaggggugauugcaaaggggaguauacugucauggaacacaaacggggaguaaauaacaaggaggaguggauagugaaaaucagauauuguaaagagagcuaagagaagaaaaguggaagaacaagcagggggcagggaacugguaagaagcagaucagagcugacuuaaaagagagcaauuucagcagaaaaguugagaaacaagcuggauuauaggguuaaggaagugguuggaagugagaaaauggaggucacugccacugaacacuuguuugagagauuugucuuuuuaaagaagaguagaaauaugacuguggcuggauuucuuaaaauuaggcuguaauucagcagcuuugguaacuuuucugauucaugagguaaauuucucaucucaaauaucuggucauuugaaguaauacuggagaucaaauuacgcaaauaugcugcaugacuaaauuaaaggccuauucaugugagcauuaguuaguaaugggaguuguauuauauacugcauuauuagaaaauggggcagcauauuuuaaugcuuaaaaauuuaaucagagcaacuuccagaaggaggaaaaggcuccuuuuuaacacaagauuugaaucauggcaauuuuuuuuuuuuucugaaagccauucuucuaagauggucaucccugcacaugcccucauuucugacuuucugcugcacaagcaaucaguauucgugcaaggcuaaugggauauacaagaacaauuaguagcucugccagcgccaauauuguacuugccucuuuaaagagcucaaaauauuaaauaacaauuggaaagaacauuucuucuagacuacucauuagauugauuuuacagaugaguaaacugaaucauagagaaacaagauaguggaaaugagaagucuuacuuugguucuaucucacaccacuguaaggcugugccuauuauaucuguaauuaagcuguuguccagauaaacaauaauuccugcuuggcuuugacuuuuagauaccaacagauauuuaaaugccggcaguugaaaagguuauuuuuuuuucuuucaaaaguggguuuguaacuauuggcuuaaauuauuuuagaaaacuauagcuguacuuucaacauaaggccacccacucaacucugagccuagacuguuugagaaauaagaagguauaggaaauuuggcagguauuuuucucuuguaucuuuaaaucucaguaaguucacaaaauuuuccuaaccaauauuggaacaagaaauuaucacggggggaggggggugacuaaucucaccuuuuaaggacaauuaauuuuucuacuucacaaguuuaacuucuuauuuggaucacaauaugcuacuaagauacuuaaaaggucauuuuuucaggccaacugcaaaugauguuuucauuauagaaaaguuauguaaaaguggaaaagagauguaaguccauuaacguguaaaaugcaccauagcaaugggaaaaaaguuuuaaugaaauacguaugagcucuaucaugcgcaaauguuuuguugaaauggaugacuccaagagcucugugguuccacuucagugucuaauaggcacuacucacuuuaaccuucagcaagcccuuuaugaaugcuauccacccaaguguaugaaaaugccaauucauguagggcuaucaguauuauuguuauuucuuauucuguaaaggcugcauuuugaacauuuuaauaagggucaaagcauuccaagucaaucuagauggcaauuguuagaaaugcaggaggugcuuuaaaaaaugaguugguaauaauuucauucuucucccauuuugauuaguuuauaaauauaacugucagcuaguuaucauggugagguuauuggucaguccuccuccaaguaauauaaacuccuuaauacagucuucagacuaugaaucuaccauaacauugccaguguuuugauaucaucaguaucuucaucuuccuuuauuucaagcuaugauagauuuuaccucuucuauuaucuacuguaauuugcugcugacacaccaauugcuaguaaauacauauguugagcgauggugauuaugugaagaaugaggggcaagaucccugugguguagugugugugcacccaugugugcaugaagaaacguguguaugugugaugugcaugcaaauaauauaggucugagggaaauacuguacuccccuugaagguaagggucaugucuuauucacuguuacaucccuaguacuuaacacugucucuggcacagaaaugauaucuaaggagugcuugcugcaugaaugagugaaggguacuaaugguccauguucccauuggcaaaauaaggcuuccaguuuaaaaaugagacuggagguccaccuacaacaaucuguugugcuuucaguuuuuacaggcugauuucuacgcacacagcauuaugcugggacuugugaggaaagcaaggaaacugaauacacagaacuuggacuugagaagcuuucagucuaauuggggagacaagauacauacaagugaaaacuuaacuccuaauucuagagagagaaucauggcaugccaaauguauuuuuuucaugucaaauguaaccacugcgugaguucaggagaaaagagccuguucuguacugcagccauuaaagaaagcuaccuaaacuaggcaagaauugaguuauaccuuugaggauaaaagacagcagggaaggaaaggaaaugucuguccaggaggagcggguagagaauacagaugagcaaaguuauuaagauaagaauagauucuuugggacuuaaaauuuaggaagcagucauuagacuuugaaaaauaaauaugaugguagagacaaauauaacaaggaaauaaauaagcaugcacauuuuguauaguaaucacuucauaccuaaacuccuuggugaaaaaaaaugucgaaacuuagacacauucucuauguugcaaacucaggggaagugagugaaaugucagaaggcauggcagcauucccagagguuagugaguaucagguaggcuuugccaagcaggagggaggugaugauauuugacuucugaggggauaaacagguaaggugggaucugggcagauuuucagacaaaagauucuguugugaaggggcuucugguuuuaacauagaugugacucuccuuaagucuuaggugaccugauguacuucugaaacuauucauugauuguacaaauuucuauuuauuuuacauuuuuaagggcacagaaggaucuaaacuaugugcacaacuauucuacaaaccaaacugaaaaucaaaaugaaauacacaaaggaaaaguuguuugaaauuuugucuuuaagauacagggaaaaaaucacacaucaguaaaaucaaggauaaauaucagccugaaggaggagcaauaauugacaaauauuuaaaaacaauugggggccaggugugguggcucaugccuguaaucucagcacuuugggaggccaaggcaggcggaucauuuaagaucaggaguucuagaccagccuggucgacauggugaaacccugucucuacuaaaauuacaaaaauuagccgggugugguggugcacaccuguaaucccagcuacuugggaggcugaagcaggagaaucgcuugaacuggaaagauggaggcugcagggggcugagaucacaccacugcauuccagccuggguaacaaagugagacucccacucaaaaaaaaaaaaaaccaaaaacaaaaaacaacuggggucuuucuuuucuaaccauaucuagacauuggugaaaauaguccuuauuaaagauaauaauagcuauggagauaaaucauccaaguguugcauuuaugugugagaguauguauguagaacagauuuagcaaauaauuuuuaaagcuuucaauaaauacuuuaagugacuuauauggacacuuuaaaugcacauucauuaauggauucuugauugaauaaaaaauuaacuccugaaaauauuuccuaaauaaaguacaucuaugcauggaugcacuaugauguuucaaccaacauuaauuauacccuuuugauuucuacugucuuguucaaaaacacuaauaagacaugcacuacaucauaguuaauaggaguguggugcuuguugcuuaggcaacaggaggaauaaaugcaggucagaaugugcuucaagaaaaacaaaagcuagaauaugauacugaguggagacuaagcaagucuaacagauuuuucaccacauuaaagaaauauguuucuuagagcaagccaaucauauucauguguuuaacuaaguuugcaauuacauaaauuagauuauguagaucaauaaauaauuuuuauaaagguagaaauuaaucgcuuaugauacuaguagcaaauaaaugguguauaacagcauguaaagcacuaauugauuauaccacuucaugauuugcuucauuuucauaauuaauuaacuccucuaaauggcaauucaaaguuuuuuuaaaagauaauucugucucaugaagaaaguauuugauuggcccaucuaaguuaauaauauuuucuuauuuucuagaaaauuauaccaaauacuuugaauuaaacaaguaaagaauauaaucuaugauuagaccuugguuacaucauguauauccaggauuuugccuuccauauaaauuuugaagugcuuauacaugauucauucaugaauaauuuuuacgaucucucuuugaaugcuuauuugaaaccuguuugauuaaccuuucaguucgaggcuuucaaaaagguauuauauuugcucauaaguguuuaacauucagaggaaaaauaagcugaauuaaagucuuucagcuuggccaaaugauccaggaaauccaaagaccuaacuucucaugggaccagaauaaauuuggacaaggguuucaggguugggaaugagaaacccuuauuucaaguagacauagggagaaauaauuaagauauugaaauguacaguaaacauaaauaauaaaaaaagacuucaauucuguuugauaguucuucuaauucuuaaugccaucuguuuaguguccuaagucuguccuaaaucugcccaguguucuaagacuuucauagcaauugaagaacuuucacuuuuuuccauuucaauacccaaauaucuugucuauauaaccagugacaguacuugauaaacacaagaaaaauaacaguagcugcauauaucaguauaaaaaaaccaacaaaucacucauaaagcauucugugcaugcaauuacuuagagcucauauaucuuacuauauuuaugucuuuuuuauuuuuaaaaacucuugggcauacauacuuuuggagaaggagcagaaguugaauaauguuaauaaucuucaaaucuauaauauucaagucaaccucagagaaaaauaaucuaagauagaaauuaaaaaaucuaaucagcugucacuauuguguuaucauuucugguacuaguaagcugcaggugucagcccuauuacuguauuuaggcagggcuauuacuuauuuccacaagucauuuguguguuacaugccuguguuauguaggucucucuaaacuuagggaucagugauaugugugauggguacuuaaaagcaaggaaagguaauagagcugugacguagcuuaacaaggggaacugaugagcacugggggagguaugggaaugauuagaaagcugaauugucgguuugcacaguuccccauccuccuuccucaccuauaugcaaaacgguggaaaguuagcacaugccagguuuagauugcauguagaccagaauucagaaguacaugacuauacuuacuccaccaaccuuucuuucuaaauauugacagcuaaaugaccaaaguguuuauuuuccaccuaaaguaauaaacaauacuucaucgcucuucaaucagcaaguggaaguaaacgcucuccauaauugaccaucugaagcaguuugcuaaugaacugaagguuguccacaugauuuaaacugcuuauugaacaauuaucaggaaaagaaaugaucuucacaccauaaacacaacaaauugucucauuaaccacuaaaugcugaugcucaagugaaauaauauaagaaucaagaauuagcugaagagugauauaauccgaguauucuaagauuacaaauuuauuuaaaaaaucauaccaagaaugacagggagaauaucaauauuaaucuucuuucacugccuauaaauagcacucucaccaguucauucauauaacacauauguauauggauacauacagaucucauuuuuuagcaagagucuauauguacacagcaaguucaguccuaagggcauccaauuuuccaaugcaguuacauauauaaaucugaccaguuuuggugcaaaucaggcugccucugagccauguaagacacauaagaagcaaagacagacaaaaggcagcuccguggacacagagagcuucuuaccauaaacugcacauugucaaauccauuagccaucaggugguucucguacugagguagcccaaugcuuuccaaccauugucccacuguuuggacagggcaucuggguccuguaagaggaugaagagggaagcguuuaagcagggaguagccguccacgggguaauagcgguaguccugggcugagagguggcauugccacaucaugccccugggaaaguugcuaucaaaggagcccgccagcuugacagauuaauguucucagcgagagagcaaagucagaaguaaaacauaguuugccaggcaggcuguggaguaugacuugauccuagcuccacauuucuuacauauuaaucuuuacuaccgaccaguacgucauacagcccccaaaaccaggcagcagaagaaggcauaucaagcugucagcuugggcuggucugcguucuaugugauuguuggaguacuccacaaugagcaaugcacggccggcagccagaauucuuuuuuaucaaguacuccuacacucaucaguaugcagcuccaugcuccuugcucccccucgcucgcuccccuucauuacccagcccaggcuacaccucgcauuuucaauaauagccaucagauaaggcagauuuuuuuugucugcaagcuguaagccugcugcugcugcuuccuccuacacacccauccaagcgucaaucuugaaugaugagagcagucaaaacaaaugcagaaaauagcaagauucaaaagcaaaccaaagugcuuaaaucugaauugaaucuucauacugguuauacguuacagagcuauuuguuguggaauuuuacguuucaaaagacaccaggaaaugcgaagcuugaacuauagcuuauaacagagcucacgacagguucccuuucuccuuuuccuuucuuuccugucuuuucuucuuccuuuuuaaauggagcacagauaaacguuucugaucugaagcuuugcaguguuuggagaauaauuauucuguuucuuuaccaugcuauagcaaaauaagccucuccgagauauauauuuuuuucuuuuuugaaauacugcaaaauacagaaacugcaucgcaaucuugaagucaagauaauuuauuucuuguuugcaugguuucuuccaaacaaaaguauuauuaggcacaagaaauccuuuuuccccucugauauuuauaacccaaucuaccaggguuaccauucuaaauuagcuauaaagguaacauuaacuggauagauuuuuuuuuuaauaaagaagaugagcccuaacccaaaauaauucaagaauaacagauguaaaugugugaguuuuacugaauggcagauagacugaguaauuuauuuaauaauugggagaaaccagggauuaagaauagaacccacaggacuagaucaucagaagaaacagacucuuaagauugggagagaacuugcagaaagguuagucuaaccuucuuccuaacguaggcaucccuggcuaaaauguuccuagaggaauaucuuccaacuucuacuugaauacugccuguaacagagcucuuacuacuucucacgaagccucaauuuauuagaaagauauuucacuuccuaccuugcuucuacucacugcuccagcucugccuucggagaagcacagauugagaacagugccucuuccacauaaagagcuuuaaaauuuaaagauaacucucucauccccccagagcagccgccuggcacauaguaagugccuaauacaaauuuauugaauaaaugaaacaucgcuuuucuuuuuuccucaaaccucaucuuucucuguuuccuuucucuuuuuaagggcauugucaacuuuccuggcacacagacauuaaaccucaaaacaucuucuacuccucuuucacuacugaaaucaguccccaaauucuaucaucccucuucccagugugauccauucccuugauucuauuuccuguuuuaaguuuacagaacugccaccuacauugauuuuguucucauaguucaggcccaccuagccuagugaaacaacgacuucuauauugaucuuucuaccucuaauauuuaaaaaaucaauuuuaugcauggugucagaauaaucccuuuaagacacaguuuugauuacuacucccugucucaaaacccuucugugguuuucuguugucuucaaaaucaacucccaacuccucugaugacauuuuggggucuucaugauugacugcaguucaucuaacuuuauuuccacuuuuccacugccccagacaggcaggauuacuugcuggucucuaaaggcagcccauaaugggcuuugguugguuuuauuauguccccacauuucuguccauuuguuggcuuugaaucaguugcuauuuccauuaugaaaccucuucuaaucuucucuaccacgaauaaaucucuuucuucucugucuuaaauggcauuuuuagacccucuauuguaacagauauuuucugccuucaauuuuaguuguuugugucugacuuauuuuuugaaagcaggcaauaugcuuugcuaauauuucacauaguaaagauucaguacauaccugcuaaacaaaauaauguaauuucaugauccaaaguacaaaaaauucuauuuucaaauuuaaaaaaaguuuuaacucuaucccaagucucuaaauuauuuauuuaaaauaagauaacuuguuuuuuaaacagauuuuuucaugucugucuuuuagcucaucauccucauccacuuuuugaauaagcagcccuggguggacugcauaguacuugauuauauuuuguugcugauugguccuggaucuuuuaauaacaucaaagaguuuguaguaguuuaugaaucaauuuuaauagauucuaguugcucaacauuaccuauaggagaagcuaaaaacaagauacuauuugucccuggccagcucuaaagcuguuacaagguggaagaaaaggaaagucucaauuauagcuucuccuaggaucacagccacagugcuucaccuggucauuuugaauuauaaauaguugaauauacuacauggaaauugagcaaacacgacaaugacacuuuggcuuggcaaggcacaugcugauuggccagcucuucaaaccuguuucaucuguuaaaaugcaaaccaggggccaaguaccuggcagagcacgauacacauccugcuuauuaaauaaacuuuguuaaauaaaugccugaguaacuaaaugaauaaaugauauuggaaaugccuuucuugagauucucauuucuuaguacagagagagggaaagagggagagggaagaaaaaaugugugugugcacaaaacauagagaguggacuaauagacacuggagacucagaaagggggagggugggagaagagugagggaugggagauuacauaauggguacaguguacacuauuugggugguggguacacuaaaagcccagaccucaccacuuuggauauauccauguaacaaaucugcacuuguaccucuuagagcaauaaaaauaaauaaaauuauauauuacaaaagacaguauauuugugguggggauuauuucaagguucagacugcuauauaagaacacaacucagagaaaauacugguuaugaacuacuuuacaaaauuuauauagacugccugaauuuuauucuuuuagguauucaauccuucaauuuuuauucaauaauuuuuacauguugacaaaauguuauaauauauggaggaagugagcugggagaggauggggugaggaagguauaaaagagagggaagaaggaaaaaaaagaagacccugagucauguuguuuguuugcgguuuuguugaaguauuuucucaugagucaaaucucuaaaagaaucuugguucaggucugaagaucacucuguaacagugcuuaaauauauuacucucuuuaccuaaaauacuuuuauggagucuuaaaauucuuaaagcauaacaacacacuaauuaggcaggaacuuuuauucaacuagaaugucuuuaaguuccaaaagugagacaagaggagggaaagaagaaacugaccauuauucugggcuaccauguccuaggcaguguggugugaauuauuauccugauuuaccguaaggaaacugaagcucagaguauguggugaaaacaggaauuuucuuugucauagucuuuuaaaaaauaauaauucuagggguuuuacucccauaauggcagugugaggagcuccacagguccaagccccagucaaaaaacuuaacuugaaaauuauaaacaaacaaucaaaaaacccuacacaaucagaaaccaaaaacaaugccaacaaaaaccaaccaucaaagucuuugcaaaguguccuaagagcauauaauguaaaaauguuuauuccaaagacagacacuaaaacuugguaaaaacagauucugagauucuguagcacuugagccauagcucccucuggccccuccuucccugcaacucaucuccauagaugcuccacuuuggauggauguguccaagagaaagggcuccccuucuccucaaaucccaaccaagcggcaugggaucucaucaaaaggagcaggccagcauuuccaauuuccucuaaaucuaagcuguagagguucaauuccuggugaguguggcugagaggucaggggcuccuuucuuccacccagaccccauucauagaauagaaaguucaucccagcugggucaggccaaaaauacugggaucuucacugcccucgacugcuuacauauaggguagagguuccaugcccagaaagguaaacuaggaagaccagaggcuaucauucuugccccaugccuggaagaguggcucaacgauuuugcuuaaagggagagucaguuuauaagaacaaaaagcucuaaagcuuucccccaagagguugacuuauuuguuuguuuucaauuuuuguuuuggauuuagggaguauauguucagguuugccacgugcguauauugugugauguuaagguuuggggcaugaaugaucccgucaccagguacucagcacaguacccaauaguuaguuuuucauacauugucccccuccauccuucccuacuccaguaguccccacuuucuauugaugucuucuucaugcccaugaauacccaauauuuagcucccacuuauaagugagaacauacaguacuugguuuucuguuccugcauuaauuuccuuagaauaauggucuccagcugcaucuauguugcugcaaaggauauaauuuuuuuucuuuuuuuauggaugcauaguauucaaugguauauauguaccauguuuucuuuacccaauucaccauugaugaguacucagguugaugccgugucuuuguuauugugaauagugcugcgaugaacauaugagcacagauaccuuuuugguagaaugauuuauuuucuuuuggauauagacccaguaaugggacugcugggucaaaugguaguuuguuuuaaguucuuugagaaaucuccaaacugcuuuccacagagucugaacuaagugacauucccaucaacaguguauaagugucccuuucuucuguagccucaccagcagcuauuauuaugccucuuaguaauagccauucugacuggugagaaaugguaucucauugugguuuugauuugcacuucuccgaugaucagugacguuaagcauuguuucguauguuuguuggccacuuguaugucuucuuuugcgaagugucuguucaugucuuuugcccauuuuuaaugugguuauuuauuuuuauuuguucaauuguuuaaguuccuuauagauucuggauauuagauguuuguuggaagcauaguuuguaaauauuuucucccauucuguagguuaucuuuuuacucuguugauaauuucuuuugcugugcagaagcucuuuaauuuaauuaggucccacuuaucaauuuuuguuuuuguugcaauugcuuuugaggauuuagucauaaauucuucccuaaggcugauguccagaaugguguuuucuagguuuucuucuaggauucuuuuuuuuuuugagauggagucuugcucugucacccacgcuggagugcaguggugcuaucucagcucacugcaaucuccgccuccuggguucaugccauucuccuaccucagccucccgaguagcuggaacuacaggcacccaccaccacaccaggcuauuuuuuuuuuuuuuuuuguauuuuuaguagagaugggguuucaccauguuagccaggauggucucgaucuccugaccucaugaucugccugccucggccucccaaagugcugggauuacaggcaugagccaccacgcccagccucuucuaggauucuuauaguuugaggucuuacuuuaaaucuugaauccaucuugagguaaguuuuguauauggucaaagguagggguccaguuucauucuucugcauaucgcaagccagcuaucccagcauaauuuguugcauagggaguccuuuccucauugcuuauuuuuguugauuugucaaauaucagguggcuguaggugugcggcuuuauaucuggguccucuauucucuuccauaggucuaugcaucuguguuuguaccaguaccaugcuauuuuguuuauuguagccuuauagcauaguuugaagucagggaaugcgaugccucuggcuuuguucuuuuuguuuaggauugcuuuggcuauucaggaucuuuuugguucaacaugaauuuuagaaaaguuuuuucuaguucugugaaaaugguaguuugauaggaauagcacugaaucuguagauugcuuugggaaguauggccauuuuaaccauauugauucuuucaauccaugagcacagaauguuuuuccauuuuuuugugaaacugagguuauuugacacagagugugcggaaguuuaagccuaaacguguuaucaaaaucaauggagguuacacaguggcucauuccuguaaucccagcaauuugggaggcugaggugagaggaucacuugaguuugagaccagcuugggcaacauagcaagcccucuaucucuacgaacaauuaaaaaguagccagagaugauggcaugugccuaucaucccagcuacucgggaggcugagaugggaggaccccaaggcugcagugagcuaugauugcaccacugcacuccauccuggguaacagagcaagacccugucuguaaaaaaacaaaccaaaccaaaacaaaaaaaucccccccaaaacccaguggagauauucuggugacaaacaaucaaaaaguggcuaauagcuacaguagggaaauaagcuaaaugguagguuagcuaguuuuaaagaaacagagaaagacaguuaugaagagcccuguugaggucaaaagaaacuucaaauacuagcuucaaaaauuccuccuucucaaauuuaauuggagcagacucuggagcaauuuauagcugacggauugucaaaaacaauagagcaaucagcaggcaauuacuggagucuaauaucuggaugugauaucaaaugagauagacaacagaaagauuaggaaaagagacaaagagagcccugcuauaaccacugccaucccaaaacugugcagauggccaaggcuacacccuugagaggauaaauacaacgugaugcauccauacuauugacuauuacuugacaauaaaaauaaaugaagugcugauauaugcugcaaauugcaugaaccuugaaaacaucaugccaagugaaaaaaaaaagcuaguuauaaaagaccauauauuguauaauucuguuuaaauaaaaggucaagaauagacaaaucuauagagacagaauguagauuagggguuuccuagggcuggagaagugaacuguggaaagugacuauuaauggauuuaggguuucuuuuuagagugacgaaaauguuuuaaaauugugaugaugguugcacaacucugugacuacacuaaaaacaacugaauuguaccuuuuaaaucaguuacuuaaauuauauauauguauuuauauaguauaucaguagauuuaaaauuauugaaugaugauauaaaauaauaaaaacaaaucuuaaaauuucuuuaaauuuacaagaacaaaaugcacauacauaauuguauauaaaacauugggguuguuuaauauauauugguaguuuuagugcucuggguuuuuuuucuucuuuaguuuucuugguuaccccuuccuccauucuuguccugcaaucugcaucauccauccucccugcaagguuauucauguuaauaaacugguauguauauucauauauauuuacccauuuucaaauaacacacacacacacacaaaggcagauauguucggauauauacguauaugggagaguauuuuuggcaugguuucaucaaaaugaaauuauaccacucacuuuucugaaccuuaguuugcucauuuaacaucuuauaaaaauucuacuggccgggcgugguggcucacgccuaaucucagcacucugggaggccgaggcagguggaucacaaggucaggaguuugagaccagccuggccaauaugguaaaaccucgucucuacuacaaauacaaaaauuagccggacaugguggcaggcaccuguagucccagcuacucuggaggcugagggagaagaaucacuugaacccaggagguggagguugcagugagccaagauugugccacugcacuccagccugggcgacagagcgagacucugucaaaaaaaaaaaaaauucuacuaaguaaaugaguuuuaauuuauuauuuguugguuauuuguaaaaaguuaaaauaguuauuuuuaguuauuuucaacuuuuuaaaaauaacuacauaauaguucauaauguggauaaaccacaguuuauucaguucuuugccugauaucucuaggauaucuuugccugauauacauccuuuuauuuucuuuuuuuaaagauuuuuauuuugaaauaauugucaauuugcaugaaaugauagagagagugauucuggauagauuuucuucaguuuucuccaguugugacauccuguaugacuuuagcacaguaucacaauaucacagccaggucauuggcacugaaaaaaauccacugacccuguuuauauguccuguguuuuacaugcacucuguguguguguguguguguguguguguguguguguguuuaguucuguacaauuuuaucacacgugcagaccacguggccaucaucacagucgagacaccgacagcaccaucauaagaaucccuccuggaacuuuuuuuuauggccauagccuucuuccucccuuucccauuuuuugaccccuggcaacuacugaucuguguccaucucuaucauuuuaucauuucaagaauguuacaugaauaaaaucauauauuauguaacauuuuggaauugggauuuuucauucagcagaauuccucugaaauccauacaaauuauucagugugucaguagcuuauuuuuucauuucugaguaguauuccaugauauggauguaccgcaccauuuacccauucucuuccagaguggcuguaccauuuuacauucccauuaauaguauacaaaugaugcaguuucuuugcaucuucacuagcauuugguguugucaauuuuuuuauguagucauucugauagguauguacuaauauuuccuugcgguuuuaauuuguauuucccucauggcuuacuauguugaacaaaaucuuauugccuguaucuuuuuguuaaaacgucuguucaugucuuuugcuguuuucuucauuggauuguuuuucuacuguugaguuuugagaauucuuuacauagucuagauacuaggaauuuguuggacuuuuuaucaauuuuuuuauggaucauguuuuuggugucuaucccauuauuuuuaacuuuaaaaaaugagcauuuaaaaaugugucucauaaauagcccagagcuguaauauuuuaaucugaaguuuuaaaauacaaucucuaauggcuuacauuuuaaugggcaaauacaauuuggaguaaugacaaucaugcuugauuuuauccauuccaucuuauguucuuauuuauuuacauuguuguuuccucauuuuccuuuucuucauuuuugguacucugguaacauucuuauucauucuauuuuucucuuuuuaacuuugugacucugagauacuucucuauuccuuucaagguuacuuuauuuuucccugcucuaaugaucagauauauacuuuucuaugauuauuugaaaauaaguuaccaauuauuucccucucaaaaacgcucuauauccuucauacuccaguaaaauuagacccucagaauguuuuccuuucuucguucucuuuuuccuacaaccacaugugaucucuggaaugcuuuuccuuuacccaucugccuuauucccaaccaguuccuagguuuugcugauaaucauuuaguaaacauuuuccuagucaauuacuagaauuuccucacaguauauuccuccuauuuaaagagucuuuauuuaauauuuauguugcacacucccaguugguuuauacauuucaguuuagauuuaauuauuguaaagauucauuggucaccacuauuucauauccuuauaaccaucuuaaucuugagguuucuguuuccauuuguuuguaguuuaguuagaauaguuucucauauauucagaaaauauuuuaaacugauuaaucauaaaagcagagugaaucacaauuugugagaugcagguaaaaugguacuuggagauaaauguauagcacuaaaugccuauauuagacaggcagaaauacucaccacuauacuaguaaggaacaaugucuaccuuagaaaugacaagaauuucaaaucauuuaucucagaauucacuuuaagaaaugaaaguaagaagaaagauaacuccaacaaaaauaagcagaaguaaggaaauaaagaucagaggggaaauaaaugaaacaaaagaucaauagagaaaaaucaaugaaaccaaaagcuguuuuuugagaugauuaguccaacugguaaaucucuauucaggcugaccaggaaguaaaggagaauaaagaaguaaucaauaccgggaaugagagaagugacagcaaaagaguuuuuauggauauaaaaagaauaaagaaauguuaugaauaacuguuaguaucaguaaauucagcaacuuagaugaaaugacaaauucauuaagagaagcaagguaccaaaccucacucaugaagaaaaguucauaacugacuagcucucuaccuauugaaguaauuguauuugcaguuaaaaucuuuauacaaaacaaaacaaaacuccaggccucaauggcucuaguguuaaauucuaccaaacauauagugaaagaaauaauagcaauucuacacaaacucuuccagaaaguugaggagagagaauacuugccaacuuauucuaugaagccagcauuauuuugauaccaaaaucagaucaagacauuaugagaaaagaaaacuauauguauuagugucugucauaaacauagauguaaaaauucuuaacaaaauuuuggcaaauaguauccaacaauauauacaggaugauacaauaugacuaagugaaguuuaccccaauaaugcaaggucucuuaaacaugggagaaucaauuaaugugauucaucagauuaacuaauaaagaaaaaccauauaauccucuccgcagaugcaagaaaucauuugacaaaauccagcaucuacuuaugauaaaaacucucagcaaaauagaaagaaauuucuuaauccugauaaaaaggcauuuauacacaaccuacaguuaguaccauacuagauugugaaagacugaaugcuuuucuguuaaguuuagaaacaaagcaaggauguccauucucaacacuucuacccaacauuguacuggagguucuagcuggugcaguaaguuacaaaaaagaaauaaaaugcauucauauuggaaaggaagcaguagaacugcuucuugcuucuauucccacaugacaugauuuucuauguauaaaauccugugagaccuacauaaaaacuacaagaaauaauaagugaguuuagcagaguugcaggauauaagaucaauauacaaacaucaauuguauuucccuacacuaacaauaaacaauuggaauuugaaauaaaaaccaacauaauuuacaacagcaccaaaacuaugaaauucuaaggaauaaaacugucaaaagaugugucaagaccaauuaaauauugcugggaaaaaucauacaggaccuaaauaaauggaaagauauacuauguuaaugaauuggcacagucaacauuguuaacauaucuguucuucccaaauauaucuauacauucaauuuaauccuaaucaaaaucccagcaggugcuuuguuugguagaaauugucaagauuuuucuaaauuucauaugaagugcaaaugacccagaauaaccaaaacaacuucgaaaaaaagaacaaaguugacaaagguauacuaccugacuuuaacacuuauuauaaagacaugguuauccacauauuaggauauuggggucaagauagacaaacagaucaaugaaacaaaauagugguuucaggaauagugugacacacagagggucaacugaguuuugacaaaggugaaaaaucaguucuguaaagaaaggagagacuuuuaaugaauuauucugggaaaauagaauaccuauaugccaaaaaaaauuuaauccauaucuuucaucauauauaaaaauuaucucaaacuguaucauaggccuacccauacaaucuaaaacuacaaaauuucuagaagaaaacuuagaaaaaaacuuagggaaagucuuaaccuuacaguaggcaccagaaguacaauuauaaaagaaaaaaaugauaaacaacuaaaauuuucagacucuucccuuugaaagacaauauuaagagaaugaaaaacaaaaugcugauuagaagaaaacauuugugaaucaugugauaacaaauguauauccagaauauauaaagaacucucaaaacucaguauuaagaaaauaaaucaauuuuuaaaaaugagcaaaagauuugaacagaaucagagaagguauauggaagggaaacaagcauuugaaaagaggcucaacaucacuagccauuaggaaaaugcaaaugaaaaugacaauuagauaccacuuguuagaaugucuaaaaucauugccaaaugaugcgaauuaagagaaacucucauucccugcuggugagaauagaaaauguuacaaccacuuuggaaaaguuugaugguuucuuaaaaagccaaauauacauccacuagaugacccagccauuuuacugcugaauauuuacccaaaagaaauaaaaacauaugccauacagagacuuguauaggcauguuuacagcagcuuuauuuguaauagccaacaacuagaaacauccuaaaaguccaucaacagaugaauggauaaacaaauuguggcauaucuauacaacugaauauuacucagcaauaaaaaggaauggauaguucauacacacaagacauggaugcaugucaaaaucauuuugcacagugaaagaaaccagaccaaaagaauacauucuguaugauuccauuuauauaaaguucuagagaguauaaacuuaaauauagugacagaaaacagaucaauggcuccuuggggauaugacaagauugguaggauuacaaaggggcaaaaggaaacuuuuggggcugaugaauauauuccuuuucuugauuguggugaugguuucacagguguguauacauuucucaaguaucaaaaaggguacacuuuaaauauaugccguuuguuguagguuaaugauaccucaauaagccuacuuuaaaaaguuaagcugggugcaguggcucacgccuauaaucccagcacuuugggaggcugaggcggguggaucgccugaggucaagaguaugagaucagccuggccaacacagugaaaccccgucucuauuaaaaauacaaaaaaauuagcugggugugguggcgggagccuauaaucccagcuacucaggagguugaggcaggagaaucacuugaaccugggaggcagagguugcagugagccaagauagugccauugcacuccagccugggcaacaagagcaaaacuccaucucaaaaaaaaaaaaaaggaaguuaaaaaaauaaaguagaaaaagaaaauacagaaugaugaggagggaagcaacuuauuuuagacagaauaaucagagaaugacucucugaaaagguaauauuuaaacagagacucaaagguauugagggaacaagccauuccagcaucuagguaaaagcucuaggcagcgggaacaguaaauuugaggaccaaugaccugcucuauauuguaaugccauggugauccugagggggugaaacucagugguaccucaauuuuggcauguucuuaauaucagucuucuuguguauugcauagccauugaaguccuaggagauugagauaaauguguuauuucaggacacugucugaaaacugucauaacugcauuaaaauaaacccauaauauuaguuuagguaucuaaaauuaauuuauucuuuuaaaaguaaaaggcagcuaauauucugauuaauuucagacaucucuuaauuagguucgaguucauuagggggaaaauacuucuuuuuauacuuuauucauuucuucagcauucacugauuucuucaauaaauauuuauguucuaagcauuuugccaggcgguggggagauagcuuugaauauccauguacuuguggaauuuauagccuuguggagaaaaugaguuuaucauuuagagaaauguccuuugagaugagagaaauuaaaacuuagagacaugacuuccuauugugaccacauagagaugagaaauacauuagcaaaaacacuaccugauuuaauagguguuacuugguaaaacucugaugaaacaguuaaggugaguaaaaugauuuggcagaggcagcaguuaauuauguuugcuaagcaggaaaaugacauuuggaaaggaugaaggaaaacuucugaacaagaguuuuaaaaaaaagaugaagaaacuggcugaacccuccaaaauguaauaacuaucuguuuaugcuagcaucaaggugacugacauaaggcacauacuuuucaaagaaugugagucuuucuagugaucaaagccauagaaaauagaagguagcuaauauuuauugggcaccuacuaugggucuggccuuuuauauauguuaucucauuauguaaaacaacaucaaacacauauugagcauuuauuuacugggagucagcuucuauucuaaacguucuacauguauuggcucacuuuauuuuacaguaaacuaguaguacuauuguuaucaucuccuuuuauagggaaugaaaauaagauacagagaaguuaugaauugucuaaagcugcccaguuaaaacuugaacccuaaguagccuggcuccagagccuaacuaagcuuucagccacuacucuaugccgcuucuguguuccaggugcacaggaugggaaacuuguccuuuugcaggagugagaaugcucauccauacacgugccagcaaguuuguuuuaaaagggcuucuugggguuacuuuguuguuguuuauucuccuuccccccuucaccuuacauucauuauucuuggcuucuaaugugaaaagccaugagaaaaggcaggaggaaauaacaagaggugggagaauaguaaagcccaucaccuggauauuuuuauuucaugucagcaaagggcucugcugugauuuugaaauauugcagcuucagugcuguuuccacaugggugcucagcuggucugcaaugcauggaugccugugcuauguguccagaagacagcugccuugaugagaugggggacaguguggaggucgguagcccagacucucgagccagacugccuggguuugaauccuggcucuuuuccaugauuuaaauauuugcugcuucuauuuuuaauauacagcaauagacuuguuucugggggcuuaguuguucuuuggaagagugaggggggacaccucaccccaucuaucucaugguuuuauuugaagcugaaaugaaauagcacgugaaaaaagcacuguaacuuagagcuaucucaaucguagggauauauuguuaucuuuacugccaguaaaauauauaccuguguuguucauucagucccucgaccaagagacugguccugcgccaucagugcauuuccuugcccaguucucuuuguuuccaacagacaaaaaugcauggggugagcagucuggccaaauaacaggaaagcuaauuguaccgugaagugaucagaauucccacacccaugauguuguugaaggcuuugucuuaucuaauaugcaccaauagccaggucuucagcacuaagcagccuggucuuugcaauuuaucuaaaaguaaaaagagaaaaagcaauguggggccaagaguggcaaagacaggaugauucuuauuucuaccguaauuagcaaaagggacaauuaguuauuuuaacauauuuuaaauaaagguugguuauuuuugaagguacugguuuaaaaaaagcacauaauuucuuaagaaggcuaugcccacauuggggaaagaaacuguguauuccacuaauaacuaaagugcuggugucuaugugagccugccuuucugucuuuuacaucuugugauacagguauaggagcuaggagugaauaguauucauuucuguaggacagaauaagaaagaucucgacuaacaaaucuauuuuuaacuaguaaguagcaguaucucauuuuuccaauccuagguguccucugaucugagaauuauaaacuacauguccuucuuccuuauggagaaaaacugacaguaagaauuagcaggaaaagagacaacccauaagaacaaugcuuccuccugauaaaaggauagccauucugaaauucaaaaauagaaaugcaaagcagagguagcagacaacagaaaaaugaaagggauugucauuccaagaauuggggaaugcuauaggucaacaaaguucuggaucauaacgccgagauuuaaauaggaaaauacuccaagauuauggucugauguuaaaaugcuaagggaagucaggagcuuggauucaauuuucccuaaggccuugcauuuuauuucuaacuaaaauuucauggagcacuuaagaaauaccagccuuuacaaaacagaucugacaacuuaugugcugggguauggucuaaaauaggaaaugaaauuuaagccuaaaaugcuaaaaucuuuuggcagacaacaaaauuauauauauaggccauaccugauuggaaaaaaauaguaauuccguugauuuuguucuuguuuucccuucuuuuaagguugcuggcaaguguuugaauccccauugagaagaaggugaucagagaauuaagucauugagccagucugugugacagccuuuguguuaggaccagggaggaaagggaacaugucccagccucaaagauuuuagaguuuagugaggaggaaauuaccauaaagaaugaucaguauuauauuaaagaugugugcaagauauauaaaauguugaaggaaggggaggaugcuuaacuuggcuuggauagagagcuuauagaggagaccaucuaaucugugccuugaagacguaguaggaauuuuugaggcaaaaagaaggaagaugguguuccaggcagagggaacagcaugugcaaagguauguuugaggaacuacaaaugauucauuauugcuguacuucaaagguuauaugugcauguaugaggagggaaaucugcacagaaauggaggcaggauaaguaggaaacagacaaucaagggacuugugugccaugaaaaagagaacucuuuucuuuccugagaacagagagauuugaucaaauuguuguugcacaaacauccccuggaggaugugggagauagacgaauacaggaaagaaacuggaaguggaaagguauagaaaaccugcaaggcucuuucucuuaaagagcaaauagacaaaaugaccuaacuaauuauuuuaggagacagucuuuaaugcagaggggccuccaaauauucuuaguuuccuagaacaaaguaagcccugguucaacagcugacuggacuuccugugaaagaaauuuagucugccaugccucagcugcagaagucagacaugagaggauucuucccauagagaagacuuggucuaauguugguucaaacuuagcuugauagccauggcaaaugaacacucuuuaguugcuagaagagcaauguuaaaauuucagguguuucguguaugcuuuacaaagugaugaaaaauaauaacaauuuuuuuaaaaaagaugauagcugagaggauuaaagauguugauaaauacagaaagugcuuagaacaguacuugcauauaugcacugaauaaauauuagugaaaauaaauauuagcuauaacaauaaauauugacuauauauuauuagcuauaauaaguauuuaccuauaauaaccauaauacauguaauaauguauuaauaauaauuggcuccugaaucagaaacaaauuucaaauagucaccucucugaauaaguuagguacuaucuaaaauccaugaaaucugugauuuugaaagaacucaucaggaaacucugguucaguuuuuacauccaucacucuucagcagauguauuaagauuaaguaugaacacagaagaggcacugaauuuauuuuuuucaucuuagccuauuuuaacuguuccgaaaucucaugauuagaguaaauaccuucugugauggaugcuuauuuaccuucuugauaaagucaacugguaaaucucuaauucuuauaaaucagaagccagaaaaaugucucaaccugaaaauuaaugcuuauuuccauuuucuacuaauauugugaaaauccagggcuaaaaacugguuucugcuucauuuuuccagcaaucguaaaauguuucuuuggguaaagugggauaaauuuucagagaauuugacccucaauucuguguguauuuuucacacuuaagacaaucuuagaaacuucacaugcaggaaauuuaauuuauuucauauagaagcauuggcugaaaauuauaacauaaaccaaaaacaaagaauagagcuggcuuaaaaauguugaauuaacagacuaaaauauauuuauacuauaauauaaacauauaauuagguaauuuaaacuaagcauugagauucauaaugacccaaagucuggggguagaaaaagagcuuucuuuucuucuguuuucuauacaacucagagccaaccugggaaucugucauggacaguuauauucaccaccaagcauguguccuucucuucugauaaccacaauuuuccuugggggauuuacccucucauuacucguaguuccugugcuugggaggaguuucuugccuaucaucuacugggauagguauaugaccaaaaucuggugcugucgguggcuucugagauggcugcauugauucuuaguuccuucuacugaaggcuuugugcaagucccucccacuugaauaacuuucuucuaauuaauagcauaccucaaaauugggaagaugucacuuccauuauuagauuacaaaguucugacuuugaucuuacuaagagauccucuuccuugcugguuuacuaggagauccucuuccuugaugaagcaagauucuauguugaggcccgugccaaggaauugaagaaaaucuauggccaacagccaucuaagaaaggaggcccucaguccaacagaucaaaaggaacugaauccuaucaacagccauguaaaugaacuuugaaguguaucucaggaugagccuucagaugagccccuugcccuggccuacacauugacugaagcuuugugaaagggccugaagcaaggacccaguuaagccaugucuagauuccugacccacagaaauugcgagauuauaaaauguaugcuguuuuaagcugcuaaauuuuguggugauuuguuauacaacaauagacaagaaaugcaucugggugcuuuuuaugcuccccuggccaaaauguuucauucagaguugaccacaugauccaacucaguacaauaaaaguuagggucucucucccucugcuguacacacagggcauaagauugcaaagacuuaaucuuggugguauuggaagucuuacuugaaccauuuggagucugaaaaggaagccaacauagagcauaauagaguagaaaaauggaaagaggcugguuccuaauaaccuuuuuugagaauccagaaucaagcugcaacugaaacuugaauuucccuuggauuuuuggauaugccccuuuauauuuuacaaauauaaaaaaauuauauuuucaagguauauguuuuugcuuaaaacaauuugaguuaugaacuaauauacuacaucaugaaauagucauugaauuccucuucuugcuuuugucuugcaaauaauauuuuauucucucuauaaaacagugauuaauuguuaauagaguuaagaaaacugaugcucaaugaaggaauucucuacuucaguaccuguggagucuaagauaaauuuuuaaaaauaaagugcuaaaaaucagcucaguagcauuuacauagcuagcugauguuggauauaagaacauugacauggauuugaauuguauagucacaugcauuuuguuuuuuaaaauaauauagagacaaaauuuccaacauguugcuuucuacuguguccacagaacccuucauucuaugcugaauucuacucaaagccaaauaacaucuuuaaguuuccauggacauugagcaaaguuucccagauucuaccgugguuguguuacaaguuaaguauuccuuauccaaaugcuugagaccagaaguguuucaaauuuuggaauauuugcauauacauaauaagacaucuugggaaagagacccaagucuaaacauggaauucauuuguguuucauauacaucuuguacacauagucugaagguaauuuaacacaauauuuuaaauaauuuugugcauuuaaauaaguuuguauaucuugagccaucagaaagcaaaggugucacuaucucagcugcccauguggacaaucugugguuguuuggcaucaucauaauuccugauucugaaauuauaugcuacugauaagcaaucuuuuuuuauacuuacucaacacaaguacuucauaguaaaaaauaggacauaccauuaauacaggaaaaaauaauguguucagguuagcuaauccgcauaguaccaucaccagaauaccugcaucagcuguugaagaagagcaacaacaaauaguugcaggcuuccaggcuccaccuacgaugcuguguuuugauugaaagguuucuguacacuguguuuuauuuuuuauuuauuuacuuauuuuuaauuuuacuuuugagaccgaguccugcucuguugcucaggcuggagugcaguagcaugaucuccauugacugaaacuucugccucugggguucaagugauucuccugccucacccucccaaguagcugggauuacaggugcccaucaccaugcccggcuaauuuuuuuguauuuucaguagagaugggguuucaccauguuggccaggcugguuucaaacuccugaccucaggugauccgccugccucagccucccuaagugcuaggauuacaggugugagccaccacacuuggccuguguuuuauuuuuuuaggugggaagaaacaucagacacaggugagagaccaggaaguggguccuccagggaucaggaggcauucuacugguuggcuuuuuaaaauguuuccuccagagucauuugccucauuuacaauguuuuuugucuuuuaaguuucucuuugauuucauaaacugacaugauuucuuguuaugaaugcaugcugcucuagaccuucaacaaguccaucacacauuuucaccaugucauuauaggcacuuuuuccucaguaugaaugucaucuucaucauuacuacgaucaugaucaccuugauucagaaccauuucagcugcuucaggauuggucaaugaaugcacaaauggagccucaauguuaaaaaaacuucauugauaugcacuucuaccagcuuacugauugauauaguuugaaugucaaacuauaucauguugagguguaaucccuaguguuggagguguuuggaucaugggggcagaucccucaugaauggcuugggccauccccuuagcgauaagugagcucucauucucaguucacaugagaucuggucauuaaaaagugucuggcaccuccuccuaauuaucucucucucgaucccauuuucuccgugugagaugccugcucccccuuugccuuccaccaucaauaaaggcucccugagagccccccagaagccaagcagaugccagcacccugcuuccuguacagccugcagagccaugcgccaauuaagccucuuuucuuuauaaauuacauagucucagauguuucuuuauugcaaugcaugaacagccuaauauacugauagacucugaaugcauauuuucugcauaugagaggagguccaaaaucauuuuuuucacacuugacauaugggaauccuucaaaguaccaauuuguucaucaucaucacugaacacagccauagacaacagguuguaccaggcaugcaaaacugucuuuagucacuauguuccaagucuuggcaacagcauauacaguauucuucauguuaaacuccuuuacgaaaacguccaugcccauaccucuguucccugacgcuagcaugcuguuuaauaaaguguuuuuauauuuccuuuucauugacuuaaggguacccuaaucacauagcucaaugaaugaagucacauuugaggaaaauugcaugacauaaacuuuuuuuuaugagaauuucaccuggaggaugagcagaacaguuguuaaggaauaacaaaauauugcaguuguuauucaguacagcuuccaugcagugagcaugagccgcugguacaaaauguuugugaaaucaaucaggaaacaugucccugaugaucuaugucuuucuguuagcauaauaacagaaugguaagaaauucacuccuugaaaacagcagggacacaagcuuuugcuuaaaacagcaaguuuacacuuauguaugucugcugcauuagcacaucccagcagagguauuacccuuggccuccuuaauuccugucuaggcugucucaucagcugugguuagugucuuccuggggcaauaauggcaauaaugccaaaacagugauguuucaucagcauuauagacuuguucuagcaucagauuuucacaagugaugaccuuggcaaacuuguuacuaaauuuuuuuuucacugcuuuguaaucagcagaugcuuuacuaccacaaucuuuacaagucuaaugcugugucucuucuugaauauucaugguuaacuucaauuuucaguucauugugauagaucuuuguuuguuucauaaucagaauaccauuaaguggcacguguucacugcaacaccaacagauccauuccuuccauacacaauugagauauuccauuuuggcuuuaugcaguguuuuucuauuuuucauuaucuucugcucaucacuuucaguauagaacuugaacaguuuauccugcuauuuccucaggucauauccagggucauuccaacgccauacucuucuguaagaugcuucacacauucaccaauauccaauuucuccaacagcuuggcuuucuguggcauagacaaacauuaauucuuccucuuuuuaaaaucaugauuauccauacccacaggggugucuguaggccauuuggacucuuucaacaauaucuuuuuaccacgaagcagagauuaagcaaaaaauccacaauggguaaugcacaugucuuggccccacacaggacaucauggcaccucauggggaaccugcuguuggcauauccaauuaacacacaugcuuucuuauuaccuuugacuggcaggcuuguugggggagaggaaucugggcaggcaugugaauauguugcaauugaagagggcugggggcccuuuuuacccuuggggaugcugaauaaauuaaaauaauuucaggcacuaucaacuuuguuguuguauuuauaacaaugcagggaauguuuccccaaccuuuuaaauguuuguucccuauuguuauuauauuuuucugcuuuguucauuauuuauuuuauaucaaauaugguuucauugaaaauaacuuuauaugcauaauuugccuaauagaucauaaauaacuuaagaccauucauguaauaagauaacaaaaauaacaauauuuuuguaguuuuagacgugcuuuaaauaaaauaguaagaacaaaaguucauaaaaucuuaucgaggucaaaugcuagcccaguuguugauccaaaaccagauaucucuucaacucacccuaaugaacuaucaaugacuaaucauaaaauugggauaauaaaaauaaugcuuuagcaugauaaaggaauaccaaauauagagacaauguagaaaaaaagguuagcaguaauaaaauaaaccuuggcuauaacauucauuucuauaaacuauaguaauuaucuagaucaaauacauauuauggauugacuaagugugaugauagaaaaugggcuuaggaaggauauaaauuuaguugaggccgggcgcgguggcucaugccuauaaucccagcacuuugggaggcugaggugggcggaucacgaggucaggagauugaggccauccuggcuaacacggugaaaccccgucucuacuaaaaauacaaaaaaauuagccgggcgugguggcgggugccuguagucccagcuacuugggaggcugaggcaggagaauggugugaacccaggagauggagcuugcagugagccgaaauggcaccacugcacuccggccugggugacacagcgagacucugucucaaaaaaaaaaaaaaaaaaaaaaaaaauuuaguuaucuauuuuaaggaauaaacugaaaagacaugcauugugucauuuaccuuaacaaacaguuuacaagagugccaugcauucucuuuccugccauccuucuugacuucaauagcauuuuguaaaagaugaugguuuagggccauguaacagcuggcuuaguauauuagcucuaggaaauuuucuuaacaaagagcagacuccuaauuaugugaccaugggaaaaacucucuaugaaucuccuuucucaucuauaaaauuaggaaaaucuguaaagugaguaccuauauaauaggguuguugacagauuaaaugugauaauacuuaacaacagugcugacauaugauaaauccucaauaaugcuaacuguaauuacuauuauaauaucacugugacuauuguuauuuauuauuaguaucaucaaaauuauuuggcauuuaagguucuccaucauuugggcuuaaucaaccccaacugcauuuauaauaaacccuaggcuguaacauucauuucuaugaacccuuuccuccuuguuaugagaaugcuuccuucuauuuauucauuaccugccucauggcuucuugcuucccuguuuuuguucaugcuauccuuucuaccuauaauaaucuguggcucccucauccuuuuugccaauuuccuccuggcuuugugcuacugauccuuugagguccuuucaucuccucagcaagaauuucuaggauacuuccaguuuucuucuucuuauaaacucccauaguacauuauuuaugccucuuacaaggcauuuuaaacuuuugauacuguuaaaaauguacauauacauugcauauuuuucacaagacuuuaaacaccuagaugauggaagccaugucuuaaccaucucugugucccacacaguaccuagcagaaugccuugcacaaagggggcuaaacagauauucuaaauaaauggugauuauaggaaucagacauguaauuuuugcuucauuagaagaaucuucuaauuaacuggacuaagcagugcuuacuuucccaaaaaguugauuauagagacucacuguuggagguuuguuucuuagguaaucaaggcugaucacuggauuucuuugauuuucccaagauuggggcuaaugccugaaauuggggaaaguucuuugagggaaaggguuuuuuuuuuuuuuuuuuuuuaaucugaacgaaauuucaaaaaagggaaugcuucuuacuugaccaaaauugaaagcaccaugggauaaaaauuucugaguuaugagucucagggguccaaacacaaaaccccaaagcauggccucuugguuugcugacuacuuugaacugaaggacacugaaagugccucagaagcaaggucuuucugauccucuccugccuucuuucucccucuccacuuucucccccaaagcaagccauaaaaccuaggaaggucucugaccuccuccccucccuacugacuguccucauaugacagauguccugucccauaucuggggugaaucugaacaaacaggccuaaguuucuccccaguuuacauccauuagaguauacuguuuucuccaaccauacuucuacaugacuauccauucuucaucaaaucuaagcauaaaaauauagcuuuccuuggguuuguggguguucauuucugaagccuugugugucacauaaacuuugguuaaauaaauucguuaugcuuuucucuugucaauccauguucuguuauagggauguuaaccaugauccuugcgauaaguuaggaaaaagaagccuuggcuuuuuuuuuuggcucccaauaccuugcucacagaauaaaacuuuauaauuucucauaauauguuuuucuuuugaaagccccaaccauccacugagcuugaaaucuauguuuuauuucugaaggcucauuauucuagauuuuagcuuucauuuggacaaugaucaaagagaaacaacuuucacagccucaagguaaaagauuguaaacagcaaauuagugaacaaaaguauuuuucuuuaguuuuaucuuaaauguauaagaacaaaaaccaagauggccuucacaagagaaaauauuccuuuuccaaauaauauuggcuaauuugaaauuuucauauucaaacaaauuuaauuuugugagugggaaaaacauuuuuucaagagaaaguuuuagguauuuucuuauuuuuuauuuuuuuguggguacauaauggguguauauacuuaugggguauaugagauuuuucauacaggcauacaauguguaaugaucacgucagaauaaaugggguuuccaucaacagaagcauuuauucuuuguguuacaaacaguccaaguacacucuuuuaguuauuuuuaaauguauaauuaaauuauuauauuuaauuauauaacuaaugauaguuacccuguuguacuaucaaacaccagaucuuauucauucuuucuauuuauuuguacccauuaaucaucuccccuuccuccuuauccucccacuacccuucccagcuucugguaaccauauguauuaguccauuuucacacugcuauaaagaacuacaugagacugaguaauuuauaaacaaaagaggcuuaauugacucacaguuccacauggcuggggaggccucaggaaacuuauaaucauggcagaaggucaaggggaagcaaggcacauuuuauaugguggcagggcguagggacugccacacacuuuuaaaccaucagaucuugugagaacuugcuaucaugagaacagcaugggggaaaccacccccacgauucaaucaccuccuaccaguucccucccccaacacauggggauuacaauuugacaugagauuuggguggggacacagagccaaaccauaucaucaucuuacucucuaucuccaugaguuaaauuguuuuaauuuguagcucccacaaauaagugagaacaugcaaagcuuuuccuucugugccuggcuuauuuuacuuaacauaaggaccuccuguuccaucguuguugcugcaaaugacaggaucucauucuuuuuauggcugaauaguacuccauuguguauauguauuacauuuucuuuaucaauucaucuguuggacacuugguuuuuuccaaaucuuggcuauuaugaauagugcuacaauaaaugugggggugcagauaucucuucaauauauugauuuccuuucuuuuggguauauaccuaggagugggauuacuagaucauaugguagcccuacuuuuaguuuuuucaggaaccuccaaaccguucugcauaauggugguucuaauuuacguuccuacuaacaguguacgagaguuccuuuuucuccacgucuucaccagcauuuauuauugcuugucuuuuggauaaaagccauuuaacuggggugagaugauaucucauugugguucugauuuacauuucucugauaaucaaugauguugaacacacuuuuauaugucucuuugccauauauaugucuucuuuugagaaaugucuauucagaucuuuugcucaguuuuaaaucaaauuauuagauucuuuuuccuguagaguuguuugagguccuuguauguuaugguuuuaauccccugucagauggaggguuugcaaauauuuucucccacucuauggguuauuaauuauaugaaauauuuagaaagaaaacaauaguugcauccauaucugaaaaauuuagagacacugaugacaugaugaccuucauucccuaauguuuuuauggaugaucuagauaucacaagacacauuaaagaaacuacacuguagggaauauucaacaguuggauugagcuuaugcagcguuucccaaaguuuuagaaauuccaucagauaacaaaaggaauaauguccaauaagaaucauuggucuuaggugcaguggcucaugcccguaaucccagcacuuugggaggccaaggcgggcggaucaugaggucaggaguuugagaccagccuggccaacauggugaaaccccaucucuacuaaaaauacaaaaaauuagccaggcguggugguggucgccuguaaucccaccuacuugggaggcugaggcaggagcaucucuugaaaccagaaggcggagguugcagugagcugagaucgugucacugcacuccagccuggguaacaagagcaaaacuccaucuccaaaaacaacaacaauaacaacaacaaaucauuggucaaggaaguuugggaaauagagggcaaagcagguuaaacagauuucuuuaauguagaucccugagacuuugacauacuaauuuuccucaugaaucuccaauaaggguuauacggcauugauguuuccugaccucauauggccaaggauuacucuugacuuuuuucugucagagcaccuugaaggacugacaaucuaugaagcacauuuugggaaacucaugucuaauauuauauacaaaggagguuaaugacaauaugcaaugaaaaauuaaucaaaaugcaguuucauauaaaucaaauauacauuucacuuauaauaucaaauauaaaaaagacauagucuugaaguaaaaugagccuuaucaucucaaauggguaaucuggauauuaauucaccuguuguuuagaaucuuauucauuaaacaagcacucaguuuuuaccuucuuugugacaagcacuguguucaguaccaagauaauaaaagaugauaguaacacaauauaucuucccauuuagauugcaauuccacagaguucuaaagguacuuucuuuggcaaaauaguucaaaaaauaugucaagagacuauaucaauaaguuauugagccauagacuauuaaagaagugggaggucaauagaggagagauaagaagguuucauggugugcaagauuggaauuuggccuagaggacugauaggagguacaguuuagcuccauuuggguucaagcauagaacauguacagaauaaagaaaagacuuagggcuacaaguucauauuagaaacauccccuagaccuagaguuagagaucuagauuccaauuccaguucuaaaagucacuugcuaugugaccuuagcuaucuugucuaucuauagauuauggaaaauaaugccuguuuugucuauuucaaaauaucauuaggagaaaacaccuauagauagcauaguauguuguuaauuuuuggaguucaaacuauauuuaucuaaguucgucaagaguuagugcaaagcauugcuuacaauguauccucaaugaacauuuauuucaugaaagaaugaauggauaaaagaaguuagaccugaauuuccucugccacuuacuaacuaggucauacaugaccuuaguuaaauuacuuagucacccugagccucagguuucguauuucuaaaaugaggguuaaaaauuaugcuuauaucacaagauugcucugguuaaauggaaauugaugaaaaauucuuagcacaguaguuaguauauacuuuucaucacauauacauccuauauauuggauaauuaaagacaauucaucaaauauaaaguacagugauuguguuuaugauaaaaacuaucacauagcagagaaggagaagugaguguucaacauguaguugugaacugacacuuuugguccaagagcugcaucagaacacgaugagugacacacaaugugcaccauaacaucaccaagaaugugaguuuaaaaaguaucagaucauugacugauucuucagaaggauccuagauuaccaugccauuuaaaaauauguguaagaaaagcagagcucaaaaauuauguaugagaggcuuuccaguguacguugagccucaaaggaauaaaauaaacugaaauuuagacauuuacucacaacgauugguauagcucagaggugauaaucucuggaaagaguauugauaauguuaaucauuuuauagauuuuaaauugguuuguguucuacugggaaccaaagaagaugucaugaagguggcuggcaagauggacgaauaggaauagcucuggucugcagcucccaguaagaucaaugcagaaggugggugauuucugcauuucuaacugagguacccgguuugucucauugggacgguuagacagugggugcagcccauggagggcgaguagaagcagugugaggugucaccucaccuggaagugcaaggggucgggggacucccuccccuagccaagggaagccaugaggaacugugcagugaggaacggugcauucuggcccagauacuacgcuuuucccauggucuucgcaaccugcagaccaggagauuccuccagugccuaugccacaagggcccuggguuucaagcauaaaauugggcggccauuugggcagacaccgaguuagcugcaggaguuuucuuucauaccccaguggcccuggaacaccagcgagacagaacuguucacuccccuggaaagggggcugaagccagggagccaaguggucuagcucaguggaucccacccccacagagcccagcaagcuaagauccacuggcuugaaauucucacugccagcacagcagucugaagucaaccugggaugcuccagcuugguuggggaaggggcguccgcuaugacugaggcuugaauaggcgguuuuccccucacagcaaaacaaagcuacaggaaguuccaacugugcacagccuacugcagauugguaaagcugcuguagccacacugucucucuagauuccuccucucuggcagggcaucucugaaagaaaggcagcagccccagucagggccuuauagauaaaacuucaucuuccugggacagagcaccuggaggaaggggcagcugugggcacagcuucagcagacauaaauguuccugccugccagcgcugaagagagcagcagaucucccggcacauugauugagcucugcuaagggacagacugccuccuuaagugggucccugacacccaugccuccugacugagagauaccucccagcaggagucgacagacaccucacacaggagagcucugacuggcaucuggagggugccccucugagaugaagcuuccagaggaaggaucaggcagcagucuuugcuguucugcagccucugccgcugauacccaggcaaacagggucuggaguggaccuccagcaaacuccaguagaccugcagcagaggggccugacuguuagaaggaaaacuaacaaacagaaaggaauaguaucaacaucaacagaaaugacauccacaccaaaacccuaucagaaguccaaagguagauaaauccaugaagauggggagauaccacugcaaaaaggcugaaaauuccaaaaaucagaaugccucuucuucuccaaaggaucauaacuccucgccagcaagggaacaaaacuggauggagaaugaguuugacgaauugacagaaguaggcuucagaagguggguaauaacaaauuccuccgagcuaaaggagcauguucuaaaugaauugcuaacuagaauaaccaguuuagagaagaacauaaacgaccugauggagcugaaaaacacagcacaagaacuuugugaagcauacacaaguaucaauagccaaauugaucaagcagaagaaaggauaucagagauugaagaucaacuuaaugaaaucaagcaugaagacaagauuagagaacaaauaaugaaaaggaacaaacaaagccaccaagaaacaugggacuaugugaaaagaccaaaccuacguuugguugguguaccuggaagugacggggagaguggaaccaagcuggaaaauacucuucaggauauuauccaggagaacuuccccaaccuagcaagacaggccaacauucaaauucaggaaauacugagaacaccaugaagguacuccuucaugagaagaacaaccccaagacacauaauuguccgauucaccaagguugaaaugaaggaaaaaauguuaagggcagccagagagaaagguuagguuacccacaaagggaaucugauaagacuaacaacguaucugucugcagaaaccuugcaagccaggagagaguaggggagccaauauucaacauucuuaaagagaauaauuuucaacccagaauuucauauccagccaaacugagcuuuaaaagugaaggagaaauaaaauccuuuacagauaagcaaaugcugagagauuuugucaccaccaguucugccuuauaagagcuccugaaggaagcacuaaacauggaaaggaacaaccgguccagccacugcaaaaacauaccaaauuguaaagaccauugacacuaugaagaaacuacaucaacuaaugggcaaaauaaccagcuagcaucauaaugacaggaucaaauucacacauaacaauauuaaccuuaaauguaaaugggcuaaaugacccaauuaaaagauacagacugacaaauuggaaaaagagucaagacccauuggugugcuguauucaggagacccaucucaugugcaaagacacacauaggcucaaaauaaagggaugggggaauauuuaccaagcaaauggaaagcaaaaaaaaaagcagggguugcaauccuagucucugauaaaacagacuuuaaaccaacaaagaucaagagagacaaagacgggcauuacauaaugguaaaaggaucaaugcaacaaaaagagcuaacuauucuaaauauauaugcacucaauagaggagcacccagauucauaaagcaaguucuuagagaccuacaaagagacuuagacucccacacaauaauagugggagacuuuaacaccccacugucaauauuagacagaucaaugagacggaaaauuaacaaggauauucgggacuugcacucagcuguagaacaagcagaccuaauagacaucuacaaaacuguccaucccaaaucaacagaauauaaauucuucucagcaccacaucacacuuauucuaaaauugaccauauaauuggaaguaaaacacuccucagcaaaugcaaaagaacggaaaucauaacaaacagucucucagaccacagugcaaucaaauuggaacucaggauuaagaaacucacucaaaaccacacaacuacauggaaacugaacaaccugcuccugaaugacuacuggguaaauaaugaaaugaaggcagaaauaaauaaguuauuugaaaccauugagaacaaagacacaauguaccagaaucucugggacauagcuaaagcacuguuuagagggacauuuauagcacuaaaugcccacagcagaaaacgggaaagaucuaaaaucaauacccuaacaucacaauuaaaagaacuagagaagcaagagcaaacaaauuaaaaagguagcagaggacaagaaauaacuaaaaucagagcagaacugaaggagacagagacacgaaauacccuucgaaaaaucaaugaauccaggagcugguuuucugaaaagaucaacaaaauagaccacuagccagacuaauaaagaagaaaagagagaauaaucaaauagacgcaauaaaaaaugauaaaggagauaucaccacugaucccaaggaaauacaaacuaccaucagagcauacuauaaacaccucuacauaaauaaacuagaaaaucuagaagaaauggauaaauugcuggacacauacuuccucccaagccuaaaccaggaagaagucgaaucccugaauagaccaacaacaaguucugaaauugaggcaggaaugaauagccuaccaaccaaaaaaaaguccaggaccaaacggauucgcagccgaauucuaccaguggugcaaagaggagcugguaccauuccuucugaaacuauuccaaacaauagaaaaagagggacuccacccuaacucauuuuaugagaccagcaucauccugauaccaaaaccuggcagagaaacaacaaaaaaagaaaauuucaggccaauaucccugaugaacaucaaugcaaaaauccucaauaaaacacuggcaaaccgaauccagcaacacaucaaaaagcuuaucuaccacgaucaaguuggcuucaucccugggaugcaagguugguucaauauauauacaaaucaauaaacauuauccaugacauaaacagaaccaaugacaaaaaccacaauugucuuaauagaugcagaaaaggccuucaacaaaauucaacagcccuucaucuaaaaacucaauaagcuagguauugacggaacuuaucucaaaauaauaagagcuauuuaugacaaacccacagcccauaucauacugaaugggcaaaaacuggaagcauucccuuagaaaaugggcacaagagaaggaugcccucucucaccacuccuauucaacauaguauuggaaguucuggccagggcaaucaggcaagacaaagaaauaaaggguauucaaauaggaagagaggaagucaaaugccucuguuugcagaugauaugacuguauauuuagaaaaccccaucgucucaguucaaaaucuucuuaagcugauaagcaacuucagcaaagucucaggauacaaaaucaaugugcgaaaaucacaagcauuccuauacaucaauaauagacaaacagagaggcaaaucauaagugaacucccauucacaauugcuacaaagagaauaaaauaccuaggaauacaacuuacaagggaugugaaggaccucuucaaggagaacuacaaaccacugcucaaggaaauaagagagaacacaaacaaauggaaaaacauuccaugcucauggauaggaagaaucaauauagugaaaacguccauacuacccaaagcaauuuauagauacaaugcuauccccaucaagguaucauugacuuucuucacagaauuagaaaaaacagugcuuuaaauuucauauggaaccaaaaaagagcccauauauccaagauaauccuaagcaaaaagaucaaaacuggggacaucaugcuaccugacuucaaacuauacuacaaggcuauaguaaccaaaacagcaugauauuguuacaaaaacagauauacagagcaauggaacagaacagaguccucagaaaucauaccacacaucuacaaccaucugaucucugacaagccugacaaaaacaagcaauggggaaaggauucccuauuuaauaaauacugcugggaaaacuggcuagccauaugcagaaaacugaaacugcacccccuuccuuacaccuuauacaaaaauuaacugaagauggauuaaaaacuuaaauguaagaccuaaaaccauaaaaacccuagaagaaaaccuaggcaauaccauucaggacacaggcaugggcaaagacuucaugacuaaaacaccaaaagcaacagcaacaaaagccaaaauugacaaaugggaucuaauuaaacuaaagagcuucugcacagcaaaauaaacuaucaugagagugaacaggcaaccuacagaaugggagaaaauuuuugcaaucucuccaucugacaaacagcuaauauccagaaacuacaaagaacauaaacaaauuuucaagaaaaaaaaaaacaaauaaucucaucaaaaaguaggugaaggauaugaacagacacuucccuaaauaagacauguaugcagccaacaaacaugaaaaaaagcuauaaucacuggucacuagagaaaugcaaaucaaaaccacagugagauauuaucucaugccaguuagaauggugaucauuaaaaagucagggaacaacagaugcuggagaggauacggagaaauaggaaugcuuuuauacuguuggugggagugaaaugaguucaaccauuguggaagacaguauggugauuccucaaggaucuagaaccagaaauaccauuugacccaacaaucccauuacuggguacauacccaaaggaguauaaaucauucuacuauaaagacacaugcacacguguguuuacugcgacacuguucacaauagcaaagacuuggaaccaacccaaaugcccaucaaugauagacuggauaaagaaaauguggcacauauacaccauguaauacuaugcagccauaaaaaggaugaguucauguccuuugcagggacauggaugaagcaggaaaccaucauucucagcaaacuaacacaagaacagaaaaccaaacaccauauacucucacucauaagugggaacugaacaaugagaacacauggacacagggaggggaacaucacacacugggccugucagggaguagggaacuaggggagggauagcauuaggagaaauaccuaauguagaugacggguugaugggugcagcaaaccaccguggcacguguauaccuauguaacaaaccugcauguucuccacauguauuucggaacuuaaaguauaauaaaagaauuggcugggugcgguggcucaugccuguaaucccagcacuuugggaggccaaggcgggcagaucacgaggucaggaguuugagaccagccuuaccaacauggugaaaccccaucucuacuaaaaauacaaaaauuagcugggcgugguggcaggcaacuguaaccccagcuacucaggaggcuaaggcaggagaaucgcuugaauccgagagguggaggcugcagugagccgagauugugccacugcacuccagccugagugacagagcaagacuccaucucaaaaaaaaaaaaaaaaaaaaaaaaagucacauauugugaucauaacagagguagguguuugagcugguacucuuauucugagaagcauccauuggcuuugauacaaauuuuauuguuaaaaaugauuugaaaauugaaaauugucuugcuugauuucccuacuaucuuugaaguauuuucaguucaauacuuugaaauauuucaggguucaauaaaucaaugagacauauggauuaucuagggagaaucuauuuguuucucuaggccauugaacuguuggaagcacauuaauuauucaugauuucuucugauuaacaaauuuguacuaucugaaauacauguucaguacuauucaauacuuuauuaaaaguuauauuauuuacuccuaaaaaccagaguuggguacauaauuauuucuuuuguuagcauuuuagagauauaaaaggggcuuauuucuaauaacaacgaagauuaaccauuacacaaggcauucuagaaaugaguggucauaauaucacauuuuaaauaauugaaaaacguauacaaauauauguugcccaaaauaaagcaugacgucaaccaucuguuauaauauaacacugcauuuucuuacauucucuagguaaacauuauagggacuauuauguaaaaaaauuccaaauuauucuaauagcucuauucuuaaaaccauuaagaagauuaucucuguuuuuaauauucaauauaauaaauacaauuugagugcaaaaguuuaaaaaguuuuauacuauauuuuauauaauaauaacuuaugcuacuuuacucuccuaguauugcaagcuaaaaucuuuuaauaccaaaguuacugaagaagagaaaaauuuuuaaauuaacacuuuaauauauucugucuuccaucucuuagacaaccuguugucaaauucuggcaucucuuccuacuucuucagauuugacuuuucuuuggauucauauugcauaccuuacaccugcaauaaauuauauauaccuuuaauaugcuuauuccuuguacauaacagcuauagcuacuguugggcucagaacaugauacccugaaauauggcacuuuggcaauugagaagacugcagaagcaggaagguugcuuuuacuuucuccucccuuuuucuucuaaagaacauucauaaagaguuaucgaccuaucucaccugaauguaggucauaagaaccucacaccacacagguccuacccuauacccagaaacuaagaaaaaucugaacaaagagguccugguaaguuccuuccaguuuauuacaaauaguucauauccacuuuuuguccaauuauacaucuacacaacuguucauucuucauuaaacuuaaguauaaaaauacaauuuuuucugguucuuugggucuucauuucugaaggcucuugugucaugcaaaacuuugguuaaauacauuaugcauuuuucuuguuaucuugucuuauguuguaggagugucaguugugaaccuugugaugggugaggaaaagauacuucuuuuucuuuccuagaauacucaauacauguuauaugaaugaauugcucaucugacuuucuuccuggccucucuacucagccacugaaucucuggggaccuaguguaagaagacagauuuuccauguauuucuaguucuuuuuuuuuuuuuuuuuuuuuuuuuugagauggagucuugcucugucacccaggcuggagugcaguggugcgaucuugguucacuacaaccuccaccucccagguucaagcgauucuccugccucagccuccugaguagccgggacuauaggcgcaugcccccacaccuagcuaauuuuuguauuuuuaguagagaugggguuucaucauguuggccaggauggucucaaucucuuuaccucgugauccgcccgccucagccucucaaagugcugggauuacaggcaugagccacugcacccagccauauuucaggcuuuaaaugaaauggaauauauauuuuuuaaagguaaguuuaaccagaauacauuuauucaugggaauuuuuuuauuuacacccauuugaagacuaagcuacauuugaaauugauaucauauugcauaaacauaugaauacauguauuugucuaacauaaagucuucaauaaauauuuagugaaugaauaaaaguauguuauacucaacauaaaugaguuuaggucauuuccugaugacuuugaggggucacagaugugcuggugcuuuccuugacacaacuuucucuuaccccuuuaguuuaaauauauauauuuaauuauuuuaaaaauagaguuucauauuuugaguuuuauuuaauaaaacagaucaucaaacucauaaaugaagcuuguaaaacauuuuggaaugacuucauccacaaauuuugaggaaugaaacaaaaaagaaauggauauuaaaacucuuaagaggccaaucaaccauuuguguuuugauauuauuagcaccccaauucaaacacacaaaagguuaaaaaauaaauuauaaaacaacuggggacauuuggacaucaagugggucuuggauaauauuaagcaauuauuguuugauauuccauuagguacuguaaugguauuuugguuauuuuuuaaaguuguuauuuuuacaugcaauauauuaacagaugagaugauauuucuuagacuuucuucaaaauaauccuguguguauauggggagugaaugcuugguauagaaggaaauaugguuauuuguugauagguuuugaaguugggugauaggaacauggauguucauaacaccauuuucuuuacuucuguauauauuugaauuuuucaaaaauaaaaagguuuuuuuaaucaugcuaauaaaacuaucagaggaacuuugaaaacauuggauucuugagauaaaguggcuuuccagaaaaaaaguggcaugaaauaaaaugcucucauacuuuguuuaacugauguacuuuauuuaaauaucuuuacuauauauuauugguuuccuaguuagcuaugccaauauauuagaugguggaaucaugaccuauagcuagcugagaauuuuaaauuuuacugacuuuauugacuccauacucuucauggacacuaauuuagucagacaaguuacagaacuccaauaacguaauaaacauguuaagugccuaguguauuaaaucucuucugaaaaucuaccuuuuugaugauuuugagcauggauuucuaauaacugaaugccauagugucaaauguugauuuggucaaagauacuguuuuugacuggaucaagcaaaaacacuucccaaaaugcagcagcagcacaaucuguuauauugcaaugagaaaaaaaaauuggcaaggacuauaaaaguuacuuaagaaagaacuucacaaggagaugaagcacaaauggaaaugccucagaaaguagaauguagggcaaauuucuaaggagaucacaaagaaauagcaaaagcuuguaggaguugggucaaaaaagcucagcaggaaacaggaugccacaucuaagaaacaugaaaggaaacagaaaaaagaauucuuuuacuauuucaggaacaaaagaaagcuaaaugacacacuuugcuccuucagugaagagaaaaggaaaucuaaugguccaugauaguaaaaaugcacaugcaauugguaauuuaaaaaaauccuccuuaaaagaaagauaaaguagaauuaucgagcauuuauugagaggugcaaaauuuaaggcgcaagaaaauauuuaaaaaauuaaucuaacauaacuuaaccauuaugaugugauuuauaugcaaagauaccuaaaggauucaccauccacauauaauggaauauuaugcagccaauaaaaguuauuauuaauaauauuaaaaaaguuaauaauaugauauuaaguaauaaaugccaaaucauguuguugucuggaagagaaucgucaaauugucaacaguaguuuuugcugauaauauuacuggugauuuuuauuuuugucaucuauuuauucauuuguuggauauucugcaaugggaauuacuuuuauaaucaggcauaacaauaaaaauauuauucaaaguaccuacuguagucuccaacaguucaauuccaaguaguccauuuaaaggacucuuguuaaguugccaauaaucacugcuuugauaaaucaaauggauacuugcucuuauuuccuggcucugugaagcaucugacuuuuuucaauguuccaugcuaaaauucucugcucccuuggcuugguaguucuaauuuaaccaugcaucagcugucaccuggaagacugcaauggcuggcugucuuuacuacaagccauucugucaauuaccaccagggcaauccugaccacauuacuccauugcuuuugccucuucaaagacuuaucuuacagaacauagagggugaguugcucuggaugcuuucuguuuuuuuuuguuuguuuuuguuuuuuuucuuuuuuuuaaauuuuauuauuauuauacuuuaaguuuuaggguacaugugcacaaugugcaggauaguuacauauguauacaugugccaugcuggugugcugcacccauuaacucgucauuuagcauuagguauaucuccuaaagcuaucccucuccccucccccaagcuuucuguuuauuagugacccaaugaaaagaaaaggacaacuuuggguccagggauuguaaauuguguccucaaaucucuauuucuugcuucuguucucucuuagguaguuguaucucauaagcaaaagagcuuccucucagugacagggaugagagggcagggccacagauaauuccaggcuuauaucauccuaccuagcaaccccaaagccaagggagauauccucucucccauucucuguguaugaaauccaaaggaaagucucugguugacuaacaguaccacaccuaauugcuaaggccaagaaugugggccugggucauagguccaaucugaacggagagauauuguacuaugauugguagccugaucagaacuacagcacuuggaagguccaaggguaagugcuucaaagaaaaucagggauaauuaauaacagaaaagaguaaggaauauuggaaagaugaaaaaccaaauauccuuuauaaaaaguaauauucaaucuccuuagcccaacacucuuagaauuucuuggauuggccucugcucauguuucuugccucaucuuucgccauucccucccaagaacuccaguuucuaacuaugccaaacacuuggaucuuuucugaauaggcagugcuaggcagaauaguggcccccaaagauguucaugccuuaauccuaggaacguauaaacauguuaacuugcaagacaaaagauacacugcagaugugauuaagauuaaggacuuugaaauggaaagaucauccugguuuaccuaggugggcccaaucuaaucacaugaguccucaaaagcagagaaucucuuccagauucagauaaccagaaauauggcaaugugaaaagaacuccauccaccauugcuggcuuuaaaaauggaggaagaggcuacaaaucaagaaauguggguggccuuuagaagcuggaaaaugcaaggaaauggauuuuuuuugaaagccuacagaaaguaaugcaauccuguugguauuuugauuuuagcucaaucagacuuuugucucacuuuggaucuauuacagaacugaaagauaauaaauuuuuaucguuuaagcuuccaagucuaugguaauuugucacagcaauaagaagaauuauacaggccauucuaugucaugcuuucuugauuuuguacuuucuggucauuucauguaaaauaucuaucuuccacaucuaucuuccacacugaugcaccccgcucaaucccagcccacuuggugaacucccuacccuuauucaaacuauaacucagguuucacuccuucucuaaagccuuccuuagcaucacuccuaggaauaugugacuccuaggaauacuuuuuucuuauggccacacagcacucugcauucuuccgcuauaguauuuaaagugcuguaugaaauuugucucagacuguaaauuuauauuaggccagggacuauauccuauuccucaauguauaucacagguaaagcauguugagcacauaguacauuuuaauaacugcuuguguaugcaugaaaaaucauugcacugguuacucacuuugagauuuauauaggaaugagaaagaguugaaaacugaaaaagguccagcauauuuuaaaaagagaacaugaauauagcacuagggauuuaacuucuacugccacaaaaauguuggaaaucaacgaguaguaggucaauugucaaauaacuugaggauagcagguacauuuuuauuaugagcaaaucuugucuaaauuaguugucuaaacucuuccuucuacaucaguaacugaacugauaaauuugggaguaagaaauugguuguaaucaaucuuucuugaugugacaaggcuuuagauugaauucuaaagaucaaugaacuuggaaaauguggucucuucucuaauggcauuaauuaauaacaucuaauauuaucaccuagaaucuggccaauacauuuacauagaaucagccugcaagaggguccucaaaugauucuuggcuucucauauucacucccuuauguagucccucccaauacugaauaggucuaaccugugugaccaaugggauuuugaaaaaguaacaauguaugauuucugaagauagaucuuaaaugaauugcugguuccaccuuacuuuuuugaauugcuccuacuucuaggggaugauagauaccauguugugaggacacucgagcgguccuguggaggggcccauuagagaaaaacuaaggucuuccagcaaaagcuaguacuaaauugccagcuguuuaagugagccacuuucaaagcagauuccccagccccagacaaacuuucagaugacugcaucccuggccaauuuuuugacuacaaccucauaagagaccuugaacaauaauuacuuagcugauccacucucaaauuccugaccugcagaaacugugagaaauaaauaaaagucuauuacugucuuaagucaugcaguuuuagauaacuaguuuuagauaacaugcagcaauagauaacuaguauucugccuauagaauaaaauagacaaaagucacuauaaacuauuuccuguguuguuagccgugguuuuuuaaaaacaauuauuauccuuucacuuucagcccuagucuuccaaaccaauaaacaagagucuuagaaggaagauaacuucaaggcacaucugcuccuuuuagauuuuauacuaaaaacaaaauaaagagccagucuuauuacucuacugccaauucucgguaauaagugacauuuccuccucccuugugucuguauuuuuuucuacuauugaggcaccugaaauuggaugaugagauuuccaaugugcccuuagaaaaugagaaagacaugacacacuguaacucuccuccuuauaaggcucaggaaagaaauauaccuuuuugggccucucuauuuuccugacagaaaaagagagagagauagaagguagaaaagcuaucugccauccuucagcuaugauauuccugaggcucaucauauuuuucuuauuuuagagagucuguagagggacacguacucaguguguuauauuugcuccuuuaugugugaccaucacagagcaaaugucuugaugucaucucaucaaaagcaucagagaugcuuggagcagggagaagaaaggggguaggaagaagagagugaugaaaaagggcaaaggaagaacaggagagggccaauuguguagaaacagcaaacagccugacuuguucaggcacaggccagaacugcuccuaggcuguugaguuaacacagauacacucugguuaaugcucuuaagaagaugaauuaagugaaacauuucaguucuaacaaaagugguuccugcaaaaaggagagauggggcacaacuagaagaaaaauacuugcauucuaguuuaguucagucucuucagagaagguaacauauuacaguggaacuacaucauaagguaaauuucaaaucagauaaaauauuuaugauuuugagaaaacauuucacaugaaucuauaaauaccuagccuaagguuuacugcuaccaucguuuacagguuaauuagcgcauuuugcagccuugccauaaaucugcuuccauuuagauagaauggcuagaugguugucuuuagcauccugaaauuuaauaguagaacuauguagcagauucuagucuuucuaagcaggaaugacaaaauaguuucaaauuauuauuuuuuugucaucauaugacugguaacaugucauuggcacuuaaauuuuaugagugucuauuuauuaggcuacagaaauaauuuuguucuccauugcucuauguauagguggggaagcuagugaccucuucaggggugguuucagaaguuaaggggguguagccaaaaccugguguuaucuccuuagcuugucuaaauucaggaaagucacuggagaauaaaaaagaaccaauuuuacuauaagacaaugaagauucuaggcaguucuuagaaauagguaagaaaucuaagcuccacaagggcagaagucuuugcucuuuuucuuuccuaugcacucaacaagaauuucuugacuguaugaaggagccagggaaugcucagaagaaucugugacucaucaaaagguaagaggcacugcugaauaaggaaauagaguggagacugccucucuauggagugccauuugagaagacaucugaaagaaaguggagacacaggcuaccuggaggaagcauguagcaggcagugggaacagcagguuaauggcccugguguggcagugagcuugacauguucaaagggcaauaaggagggcuuugacaugcaacagaguaagggaagagagaguggcaggaaauaagcaagagaggcaggugagggccugaucacgcaugguguaggaggucaucauaagaauguaggauuuuauucugaaucauaguaaggugucauugauuaaagaauguggucaggccagcagaauaaguauuaauaguccaugacagugacagacugucuuugaaaaacauuauuuccugaguggaaaaaaaaaacccuagaaacugaagauacagucaaguauccuaugaguacugaauaaauacucuuaacucacugguagguggauguguuugaaaaugauuacuaaggaacauacuguguuauuauucaagcuaucaugauggguauagauuuaguuuuuuaaagaaagcuucuuauuucuggaacaguugaauaaauuuauuauaauuuccagagacccaguccuuaagcauggaguuauuuuaguguaaugccaacacgcuccugucuugguuuaggugagcuuucaggugugcaggcaauuugcaugauaaauuuugcauguauacaucuccucucuccuuugcugcaaaggaagccaaguaguaaacagucuuucuuaguaaauguuuugcugaaagaaaacacacauuuacaagucaaaucaugugaaaucuuugauaaggaaaggaugauagcaagguuuauuuuacaguuuaugcugaaaauuuuacugggaagaaauaacuaggcugguuauuuccaguuacacaauaagcaguuacuuuuuaagagcuacuguguaaaauaaacacugcuaagugguuguaauauuugacuucauucauucauucauucauucauuuauauuaacuaacaucuauuauauauguaccauguaccagggcacuaugcuaggagccaaaaauaaaagaaaaauuuuaauuacagcuacaaauaauccacagucuagaagaacucaacagaguacauuggcuucuucuaauuccaaauaaaaauagggucagcauaugucuucacacuaugacaauuggcaauagacuguuaagcuucggcuuucucuuucuauuuccucuucugccuuucugcugugacuuuguaaucaauaggacuauuagcuuaacuggauacaucagcuaauaauccaacaggacaaaugcauaauucuuagaaucaguuuagaugguugcccgcagcccccuucuacucauccucugaaaaugcuguagaguucacuccagugaccuaccauccauaaacccucuguggcuguucagauguuuacacacauuggcuacuucacagaaaguccuaucucucuguuaaaagagaaaguauauguggcugaaaugaugguuaguucucauuucaguacuuggacgucaagcaguuaguuuacuguugcuuuuguaacuuggaggcauuccauucuauacugaacacuucuuuggauaaaguucucaucuuucuaacacauuguuagauuaaaauaguaauggaaaaguaauaaucucuccagccuacagacagcucuuaugccacuacaugucuauaguauugauauaacauuuuuauaacauuucuguuucaguuaucuauugcuguauaacaaucaaccuaaaacaacaaacacuuuauuuccuugugauauuacaauuugggcuaggcucagccaagugcuucuucuguuagucuugucugagguuacuggugugguuguauaccaccagucaugccacuuggggacacuaggacaucuguauuugucuuuauuccuguagucucaggcuucucccucuccaaguguccuacauccucuccacacucucuuucugcaaguuggaugagccucagacuucucaagaguuccaagacuuguuaaagcuuagccccagaauuaaaauacauuacuucuaccacuuucuauuggugaaagcaagugaaagagccagccuagauucaaggugaggaaaccacacaggaaugugaauacuuacaggcaugguucaguggaggucucuaauguaacaacuacaccuaccuugacucaaauaaucuguaaaccugcauuagaucuuuagauugauaaagaguuucaggaggguagggugagcuccuuaccaaggggccaugaucagaguccuaccucuuuugcguugcaugguuccaacaacacuucauuucuagaagucaucuuaccuuuacucauccugggcccuuugucugggacagcuuuucuacuuucugacaucuauugaagucuuucuucucaaaacuucaagcucaggcuuuaucuccugccagaagccuuuccugaugcuuucagguucuguuaagaccugcuucuuucuuuuuuuuuuuuuuugagacggagucucacucuguugcccaggcuggagugcaguggugugaucuuggcucacugcaagcuccgcccuccgggugcacgccauucuccugucucagccucccaaguagcugggacuacaggugcccgccaccaagcccgacaaauuuuuuuguacuuuuaguagagaugggguuucacuguguuagccaggauggucuugaucuccugaccucgugauccacccgccucagccucccaaagugcugggauuacaggcgugagccacugcacccggccaagaccugcuucugagauucuaaaauauauccuguguuuaucucuuucacggaacuuauuauauuguaguaaaaugucugggcauuuguuuaugaguuuguuucaccagcuagacuguuuacaaucugaagucaggccugagucuuauuaaugugauuuugucauucuguaagugcccaguaauaacauguuaaaagggaacuggaacaggagaaguguauguuguauaaucugaugucaccccaaauccagcauaauucaaugcauauauuaguggcuuaauaaauauuggacgguugguugaauacauaaaucuauuucuguuagucacuacauaagagauauaaacucuuauuuugguaaccugguaaauuuucagcaagcuucauaaacauuucaauuccuagcuaggaaagaagcaauaugccuugggcacaacuuuucaaguaauaucaauguuuagcagcaucaaccuuucaggcagguguaaauagcuaaaaauaaaaauucauauccuucugaaaugcuggcuaaauuucugaaggaauguauucaugcucugaaacacaaaaccguucucuugcuucuauaaaacagaacaaaaccugugggaaaccaaauuacuuugcuaagugugacaaauccaaacugcuacagagcaagagauaacauaaauuaaugggucuuggaggcaaacaccaggaguuauuuugaggugagugaaauccgaucuccauccuaaaaccacacuguguuuccauggaucaaguuuuuaguuuuaugcuuuuuagaaaacuauuuaugcacaauaauuacagccaccugaaugcccuaaauaaacguagcccaguaaaugcaggcgugugcuugaauggugcccuauugcuuucaaguacuuuguagugggcugcaugucuguuuugacgauuccccccuaaaaccuaaaggcagagaugcuggaaggguuugcauuaccaggugacacagugcuugacuuugauaagccguugcuaaggcaaagaaacuccuaaagccuuauugaggguagcccguggaagucugucacacugucuuauauuauuuuucuuuggauacaagccauuuuucuaauuuaacccuugauuuucuugagggcaguaaaguugucuuagguucuuuucacacagagaguguuuagaaauguuugugguugaaaugaguacccuucuggauuauguuuaccccaaaggagaugcauuauuuuauuuuaaucaguguuaaagauaauguauaggaggccauuggauaccacugagcucuuguaccaggccccccccaaaaagaaaaacaaaccaaaauggagucacucaugcuaaaguuccacaucaccaagcaaaaucuaaguuguuuuucugaccuuccaagaaaccaagagagugcgagaugauggccaaaucucuaaacaagccaguuuuagcuggcaggauuagaaauuccccuuuacuuuauccuuuacaaggaaaguaacauuuaaacaaucagucugcuuuuuguuuucuauuuuugcuuuccucagcccuuuucuguguauaaaccaauguccucuugcucaccucaucauaauggucauuuuauuuuagagaaugagguacugccuguccagaacugcaaauaaaagcuuauuaagaucuuuauacuaaauuuuuuuguuguuguugaaacuuaaucuuuugacaauucuggcaaccaacaaagggacccaaaugacacugcugaugaaucccaagaccucuuggggaacgcaggagagauguuacugagcccuuuucagguccccugucuuccucacggagccccagucuguuccuuucagguuggacuccggucuuuuugcacugaaucucuggagcuuaucagcuuucauuuggggguuacuuugugcuguaagagagcauuugaccuugaggugccaaggguuagucugugcucugagaaggugcuugaccuuuggguuugugcuggcugaugaguuacuggcaggagcugcaguuuuaaaggugacugacaacaguugcaguaagugguuauuacugcagggagucagaacuccagcuuccaaaauucguagagauuugguuucuaucuucuuaauugcuuugucuugagcacuuaguugaggcaugccucaggugucugacagggucaggcagaaacuggaaaauuauuggcuaaguuggucaaaggcaucucagugccaaagccacaauuugaucagugggcaugauuugggcacuugagagcuauuagagcaacccaccaccaaaagauaagacuaccaugaaaggauaagcugcauguaaaauaggguagcaccuaucagccucuagaaaauguccguucaacaagguacgcugugaaagcauuauauaacccaauguggcacuucccucuuaggcuuugauuuagacucugagagacucaacauucaauauaaagauaguuccuaauuuauaaaaaaacugagcacuccaccuuucagccacacuugccuuuuacacuuuauuaggccccggaagcuucaaauacuuacaaaaauggccaaaucuuacuaaagauacuuuagaaugacaauggccauuauauagcauguuucagaugaacaacacugcauuuaagaugugcauauaucaaugaggguucucaaauuaggccaaacccagaugugcagaaguuucuaaaaagauuucaaaaaaaaaauuuaaugggcucuuuucaaagauuguuuuacagaaaucaagugaaaaguuuaaugauuaauugauaagaaaaauuaaaucuacuauccuuuucauuuaguuacucuuccaccccgaagguaaaaagaaagcuaaaguguuucuaaagguuaggaucucaggucaagcagguuugcuucuuuuuuagagcuauccauaccgaguccaggcacagagaauguuuucuuugccccauucucuaaugggcuccacucuggagucaguaauguaguuaagaaacaagcuaaauggaaaauauagccuauugaacuagaucagucucugaaguacacccuucuggcauuuagcuggcuauuuggaaacuuuuuguaaaaaauuuacaucuauaaagaaaaaucacuagaaauucuuaaagugagagagaguacuggucuaaacaagccugaccuuugaugaguuugucuuaacugggcuucccaccuacaucuuucuuugucuagggugaauggacucuuagaagaaugaugguuacgacaaggucugucuggauuuguagauuuccucuccugugacaaauguuaaucuucccugguugcuggaucugucuuuaggcaaauaaggaagaauauucagaaaacccugucuugcauugugcuauucuuuaagugccuucaguucaaaguaaucaauauaccaaagugacauauuuuggggugcgauuuucugaacuacuuuaauggcuauguaguuuaagaagcaauucgagcaugaauguuaagaaugaguaaauuuacauaaauguaaaugguauaaaaguuuauagcugaacuugucauaguuuaaaaagucuuuuucaguaacuuuaacucuuaaagucauguuaaauuaauagauauuuaugaaauaucagucauucuuaacaaaacuaaaguauuaaaauauuaauugcugaacauaagcuuaaaauguauacacuuugauaucuuguuuuuauaucauauagaagagcucaacauauuuaagucuguuaguaaacaugaaaaaauuguuauaugaggaagcacauguuucuagaaaguauaaaauuuguauuccuaaaauguuuuugacagacagcucaaaauugcuuacuucuuaagauuccacuggaaguuaaacuuacuaaggguuaaaaauuccaauuaauauaugaaagcuaaaacuagaaauaauaaaggaaguaacuccaaauaugagaaaaauaaguaauauuuuugcuaaauaaaacuaugagguaugaaagauguguuuuuguuaaggaagaaagagaguaauuuuucuccuaaguagaaugacuaguuuuuccaaaguagaaaaaguauugaaaacacaacugaaugaauaagaaauuuguagacaguuuguugaagaugaaucuugugaaaggaacucuauaagggugaucaagcuggcuaaaaugagaaaaaauguuauccauauguuuuucuaagaauugaguauuaauaucaaaaguauacugauauaaaacuagaauuugaucuccuguguuaaaaccacaagguuuucuggaauuauugaucuguucuuaauaggaaauaguaaaaaguuuuucuuuauuuuuuuagguaacuugccuagaaagcaaagagucuguacuuuaucaagaugauucugugugcuuuguauugucuuuauuaggucuuugaugacugagaaaacugaauccucucuauuaaagagcuaagaguuuuuccuacaacuagguaacuuacuguauuugccuuuagagucuuuuaauuauuacucugguuaaacuaaugacuauaacuucacagugaucugugauccuauuuugaucaaauguuuuaaaccauuugacauuuuuuauaaacuuuccaaaauaaacuaaauuaagucuucuugaccuugaauuaacuuugggaaaaccucaaaggacgugucucucaccuuuuaaaagagagauauuaaacuaguuaggcuuauuucauauguuaaauuauauggggaguguuccaacaauuguauguaaucccuagaaauauaucaguccuaauucugguuauugugcuaaaauguuguaugcuacgggacauugaauauauaaguuucugauaauguuaaggucauaccauuggacugggugagaaguuccagaacucuggugaagaaacuggaggcuucaugaaacugccaaccaagaucaagcagagcgagauuuacuuauguaagacugaaaaacugaugaagaagaguuaugguuuuuuauggcuuuuuaauuugaaacauuacuuguuauuuuaauguuuuauuuuacagauuuaagaaaagcuuuuuuuuaaaccuaucuauagcuuucagcaaugugguaaaguauacuuuugugaacaaaaguuaaaacauuuacuuuuuccucucuauuugaucuuuccagaauucagaaacuauuugugaggauucuuguuuuuauggcaauaugguuauuugcauaaauucaauaagaauuacucucuuuauaacaugauacaauuggaaauacugguugcauuacuaaagcauugacugggaugucauaccugagaaugcacauagaaugacucuguagguacuguggguaaagucugaagucugccuugguuugguuuccuaucuuccagagguuuucaaaaguccaauuugagauuccuuauuaaagguuccagcaaaacaaaacucggaaagagcccaaguggucacuacuuuuucugcauuuauguaaauaaucaggccaaguuggaugagauuaaacuuauuuugccaacaaauuagucucacuccauuuuuuguaacaaugagggugacucuagagagaaaaauugcuuuagaagaaaaacuguaguaccacuguuacuagauuguagccucuuuaacuauuuuuugaguuuuuacuaucugccuguggacuggacuggauccugaauuugucuaguuuccuccaauaucuggcucugaaaacaagaccugcucucuuucuuaagcccuguaagaugaagcuagacaacucaauauaaauuucaagaaacaagucucaugcuugaugugugggccauacagagaguucaccaaaaugcccaauauuguaaccagagacauucaaacuauaaacaaggaugagaacuugaugauuucauguuguggacagugacagagcaggagcaucaccaucuuggauaagcacugucauuuuaaaguucaccuugaucaaaaacugccuaaauccaaaggacaucagccuaauggcuaaggucagccugaucacaaaccacaaauaacaucucugaccaaaaacauuccaaaccccuucccggcaagagacaugccagcccucauauaaccuccccucuggccagagagauguuagccccaagauaaccuccccucugaccagagacauuccaacccugccauaaacuucuccccuacacagaaacauuccaagccugugauaaagcucucucacccuaaaacuaauaaauacucuuagucccuaagagagaaugcuccugaccaaaauuggccagaagccccucucagguuuagucuccaaaauaaaccuuugacuguugagcuacuuuucguguuucuuuccucuuucuuuaacucuuauauuuggugccaaaucuguaagagagaauguuccugaccaaaaucagccagaagccccucuccaaaauauuuauucuccaaaauaaacccugucuuugacaguugagccacuugucauguuucuuuccucuuucuuuaacucuuacagacagcuugugcccagaugccaaaacaagacucuguaucauaaugaaacucuuagcccucuuaauuuuuuucuuauuuaugccuaccauuuuuugcucagcaggauagacuuguaguaauuuuauaaucaguagcuucuucaaguaacuuacaaaauuaaaucagauuggucaugucaaacccagaucuuuacaaaaccuaagggauccuuuaguccacccaguggguaacuuuggcaauaucccuaaugcaauugcuguucaaauuguacuaguguucccuuuuauaggguaaaacuucuagacucacauguuuuuacucccugccuugcugacacuucuuauugcacauguauaaauauagaaaguauuguagagacuccauugcaaaaaguuagcaaauuggcuacuugguuaaaauggguagauuccuuuucuggcucauucuuuguucuauucaauuuuaguugguuugguucauuaagacccuggcuaaggugcauacuccaaacucuuggcauuccuaauauccuuggcauuaucgccaaaauucagaaacuauuugugaggauaauagcagucucccugguauacugcauucccucaaaaguuuuaaauguuugcaugcagccaucucucaaacuucaaauggucucuauucagcuauucagucgguguauaacacuaaucacgguuuuugccauuaaaagcaauggcaaaaaccacaauuauuuugcaccaaccuaauagaauggcaaaaacucaaagaaaugcaugauuaugaggacacuauaagcuaugaauggcauguugacuucagaaacccagaauggugguaacuuagggcuaaugccccugggggagcaugaccaaaagggggaaauuguuaaagaaaauguauaggaagccauuggcuagcacugagcuccugaacuaggcccaacagacccaauuaaaauggagucagucaugcuaaggugccacaucaccaagccgaaaguaaguuguuuaucugaccuuccaagaaaccaggagagugagagauaauggccaaauccccaaacaagccaguuuuagcuggcaggauuaggaaguccccucugcuuuaaccuuuagaaggaaaguaacuuuaaaacaaccagucugcuuuuugucaucuauuucugcuuuccucaacucuuuucugucuauaaacccaucuccucuugcuuagcucaugggaacacugauucuacuuuauaaaauguaguauuaccucauccuagcauugcaaacaaaagucaaauacaauuuuuaaacugaauuuguuauaauuuugucuuuugacaccaggaaggacccgcuccaguucugccuacuacuugaucauucuccucuuuggauuaaagcugugugaaacacaagaaugauguugaacacaugacaucaaguggagggcaagccaugcuaauuuuuguggacuggcccauugaagugguauugagcuagaauuauagccuguggccagaggagaccuggagcuccuuugccuuguuauucuucuuuuccugggggauuagcaacccaagcagacaguuucuuuccuuccaggaaaaccccaaaccucuuggugaagugacaagaaauauucaccccagcgcacaucuuccuaagaaggcccaaggcagaaugcuagcucucucaguaguucccaggcaauucaaucugccacaaaguacaauguagagcacugugcuacagggaaaaacaagcaaacagaaaaggaaaaaaguccauucugcauacugauuuugucuaauguggcauuugcacacuugggcggcuacaguacuuccgugcugcugccagauuaauucuucccaaacacugcucagaugguaucacuccuuuggccccaaaccuucacuaggguuaucgccuaaaaaagguagccugggaguuaaaaguuugccaugguuuggcucaaacuuauauuuccaugugucaguccuauuauuucaaauuccaaccaacaaucuucuauaauuuuuuucguacuuuuccaugccuuuacacguguagagauuuuuuuuuuuucacuuguaagucaaaagccuagcuaggcaucaaauuccaacagcugacuuucccccuaugcaaacauacucugaccuugccagcugacagaaguauuucccuccccugaacucugcuaacacugcuuugucacagcauugcauuuucuuucuugucugguccauguuuguucaaucugcuggaccuauaccagugccuacuguauuauggguacucaauaaauguucauugaaugaauauuaauuuuuacuuauuguggucuuugcauugaugguuucuuuguaagccaaauauaacauuuauacuaacuuaucauuuuugagggucaaagacaauuuccagguuucaagaaaugagggcucuggggucucuucaacacuugcaggccuagagcuggacuuguauaccuugagacuucccugcuauaggcagaugucauugaauaauauuagugugcucuauuuacagagugccuacgcuugugcuaaaucacuucacauucauaucccuaguucuccuagugacauacugaugaugccuaucucauuuuuagaggaaacaaacaauguucaaagaugaagguccuuucccagaguugaauguaaagugaguaccagcgucaggauucacaccuaggucagucuggcuccaaaucuagcuuuuuuccuaccaucccacauuccuucuuugaauugcuucacaguuucuauggaaguuucugcuauuucucugucuuugucucugagguucauuuccacuccugcagcuucacaaaagcccaauuacaccugccagugaccugcuuugucuaacaggauuuuugauggcuauagcgucauuucagcauccgcacggccugcuucucucuacccagagcacagcucccaggaggugcuggaagccuggcagcgggucauuucagcagcuuguuuuuaccacuuuucagcacaaacugcuuuauuucaaacauugcucaucacucaccugccugcauucccccuucaucuucccuuaagucugucucauaggccuguaaguagaaauuguggcaacucccgaagucuagcagcacuggggaagaguagaaaccuuacugucagacuugcuaauugaaaauuuggggagaaguccacucagacgugucuaaagcagauuaccuuugaaguacuuacaaagaaagguuuucugagccuugagguccauaauggggauguguauauggagagcgggaaaggagcucuuuauacucagagagcugaacuauuugcaagugccaaggccuucccuugaguaugguuaaugaaucaaauagaaauauuauuucaccaguucuaacaugcccauuuauuuuucaucuuaacauucuguaaugggaauguggcuuacauagacagugguagaaccauuauuugccaaauagcagucaucauaguuguuucugccuucaccugaguaucaaauacaccagcaauaacauuugcagaauaagcaggagcagggguaggcuagcucuauguaauuacaaagcucaccuaauuuaguuuuucauaggauuuuagggaaugcuucacaucaaagcuguugguggcacagaggacaauacuguguggaaaaacuugggccucaaugaccgagcgaaaauugagucuacucagaagauucagauuuggacccagaagaaguuuuagaaaaauuugaaccaauuuacauuacuuauuuuuuuaugugugcccaagaauggcauaagauucaaaaaaaaaaaucugucuaaauaauauguuagcacucuuucacuauauaugauauaaaaauucuagcuuauguaauaguuaaauugauguuuuccucugauguaguuuaaaaaaaguuuaagcguacaugggaaauaacuuauacuuuuacaucagauuggcuuggguuuaaauuuagguuucauuucuuauuagccuugugauaugguuuggcuguguccccacccaaaucucauuugaauuguagcucccauaauccccaugugucaugggagggacccaguaggagguaauugaaucaugggggcaguuuuucccgugcuguucucaugguaguuaauaaaucucacgagaucugaugguuuuauaaggggcaguuccccugcacaugcuuucuugccugccaucacguaagacaugccuuugcuucuccuuugccuucugccaugauugugaggccuccuguggcguguggaacugugaguccaugaaaccucuuuugcuuuauaaauuacccagucucauagcaguaugaaaaugggcuaauaagaguaaacugguaccaguagagugggguacugcuauuaagacaccuaaaaauguggaagacacuuuggagcuggguaacaggcagagguuggaacacuuuggagggcucagaaaagacaggaagaugugguaaaguuuagagcuuccuagagacuuguugaaugguuuugaccaaaaaguccaggcugagguggucucagauggagaugaagaacuuauuaggaacuggagcaaaggugagccuugcuaugcuuuagcaaagagacuaguggcauuuugccccuguccuagagaucuacggaacuuugaauuugagagaaaggauuaggguaccugguggaagaaauuucuaagcagcaaagcauucaagaggugacuuuggagcucuuaaaagcauucaguuuuauucauucacaaagauaugguuuggaauuggaacuuacguuuaaaagggaagcaggcuauugcuucagagggugcaauccccaagccuuuguggcuuacaugugguguugggccugcaggugcacagaagucaagaauugaguuuugggaaccuccuucuaaauuucagaggauuuacggaaauacuuggauguccaggcagaggugugcugccggggcaaagcccucauggggaacuucugcuagggcagucuggaagggaaauguggggucagaucccccacacagagucccuacuggggcacugacaaguggagcugugagaagagggccacccuccuccagaccucagagagguagagccacugacagcuuguaccgugugucuggaaaacccacagacauucaacaccagccugugaaagcagcugggagcggcacuguauccugcaaagucauagggcuggagcugcccaaggccaugggagcccaccucuuguaucagugugcccuagauaugagacaugcagucaaaggagaucauuuuugaacuuuaagguuuaaugaccgcccuauuggauuuuggacuugcauggggccuguagcccccuuguuuuggccaauuucuccaauuuggaacagguguauuuacccaaugccuguacccucauuauaccuaggaaguaacuaacuugcuuugauuuuaugggcucaugggcagaagagacuuggcuugucucagaugagacuuuggacuguggacuuuugaguuaaugcuaaaaugaguuaagacuuuggggaacuguugggaaggcaaaaugguuaugaaaugugaggacaagagauuuggaaggggccagggguggaaugaaaugguuuggcuguguccucaucuugaauuguagcucccauaauccccaugugucaagggagggcccuggagggagguaauugaaucaugagggcaggauuuucccaugcuguucucaugauagugaauaagucucacgagaucugaugguuuuauaaagggcaguuucccugcacaugcucucuugccugccaccauguaagaugugccuuugcacuucguuugccuucugucaugauugugaggccuccccagcuauguggaacugugaguccauuaaaccucuuuuucuuuauaaauuacccacauaauucuucauagcaguaugaaauacucagguauuucuucauagcaguaugaaaauggagucauacacccugggacccugggcauauuacaaggucuuaaugagagaauaacauuuguagcauguggcuaauaauugcuauccugcaagcuuuauuaaaucauuucuuuuauuuguuaaaacguuauaaacauuuaguuuuacuuuaguuuuuacuagaaaguuguaaauacacauuucuuuuuuuaaaaaaaucuauaauuuucuuuucuaguugauuuugaagcuucaguauauaaaguagcauguauuuuacacaugagcuuugcugucacuuaacugaguaggaaaaaaccaacaguacaggaaguuugauggaguccaaaaucuuaguagagaucuguggguuuccccuuaaauauuggugaaaauauaggaucugacaaggcccugucuugucucuuuuaagaaggcauaguuugauacaacaucaugccuuccaggauuucauaacugaauuuucauacuagaauuuuugauaggcauauggcuguccagccaaagacuacaucucuuagcuuccuuugcagcuuggcguggccgugugacuaaguucugaucaaugguaugugaggaggaaugagcuacgcaacuuugggucaugcccugaaaaugaagaugcaguccucauccccugucuauugucugaaauauggauggauggacauagcugaagacauuuuauugggucaaagauggaagcuguguguuaaagguggcagaagagcaggacaaaaauaacaugggcccugaugauuuuggagccaacauaucaccuuggaccaaugacucagacuucaaugugagagauaagcaaauuuuuaucuuguuuaagccacuauuauuuugggccucucuguuacagcacuaaaaaauguacguuaaccucuccauuuucauguuucugucccuuucauucacuccucccccugaacaacacgacuuaaagucacucaugugugccaaucucauaaaaaggcuucuucugaguuccuauucugagaaccugcuaaauuuccuugaaaucuaguugccuugaaguugcuaguccuccucccuggugaauggugucuugcccuaaagcuaagccccaauacccauggaaauguuuucucaaaaucugguuccuguucauucugacugccuggauguuccauuauguuuccuaccuccucuuaagauccucagcuuccuuaaguuggacccaauacuaauuauaaccuuauauuggcuuuuccuuuccuugccuaugugaucuuuuuuguucaucacauuccaccagcaaaguccagaggcagcauuuugaauagaccuggucccuuuucucaaucucuuucaguuuuuuuuuggccccagaaaauauaacugaucccuugucuccaucucuuuggccuuugagcugaaauaacuagaagaagcuugccaaagcauacuaauauauguaaguuguugagugacuacuguguaagugucccauuuuagggauuaccuccaauccuuauaacaaaucuaaaaagagguuguauuauuccccuuauacagaugaagaaacugaggcucagagugaauaagugucuuguccaagaugccucaucuaguaaguaaugaaucuucaauuaaaacccaaucuauaaucuuuucacuauauaggcuaucuucuaagcccaauguuaagacaagggcacagagauuagggcucaugaaaaagaagacauucucuuugugagaauguccuaccauggguacacagauuccaaggaugugaggggacuaucuagcaccauacucuagaggccauauuaacaccaggaugcuaauaugaaaguuucaaagcuucuuggaugaaaagaugcucuccuucuaacuucugcuuuuugaauuuaaaaaaagucauuuuucucaccuuuucucuccuaggauucuucuguuucccugaccuugauugacauuucucccuaaguccucugaauuauuauggaauuaaauggcuuauuuuaauuucccuaggugucuuuauugaauucuuucacaguguuuuauggaaaauaucugauuacgaauucauagaacagaacauuaugagauucuuugcuaaguggcugccacaguaguauucagguccugaagccucugcaaucucuguuucuguauacaggcucagaaacaaggaggcaagcuaaguuccagcaucuugcaguugacucuuuuauaucaccuccugaacaauuccuaaacagaaaauacuguccccaacccccuggaaagauucaugaaauauuagaaagcaaaucauuuuaacacagaaguuaagaucuuggguucuggaaucaaacuggguuugaaucucacugcuucuguuuaaaugaccuuggguaaguuucuuaaucucacuuucccuccauuucauggucuguaaagugggaguaacaccuaccucacagaguauucaugaggauuacaugaacuaauagugccaagcucauaauaagugccaaccuaaaaguuaacuaacuauaucuuuuauaauuaagaaguaggagagucuuguuaaaccuaguacaaaauaccauagcaugugaaagauucuaugaguaccugcaccuccuaaccauuuucugaccuauauacguauuauacauaaacaugaaaucauaugaaaccaugcuauuuagcagaauuccucuaauucagcuugauugacacaaauaauccacaauguggagguguccugagagaucagaugauuccuucagagaagagggugaauucucauuagagaucugguaguuccagucuagaugagucaccaaugaauagauuugcuauggguuaauguuccgcccagcuugacuaaauuuuaggcagguuucuuccugacuauuggcuccuaaccucccuuuucuuagagcauuuacuuuacaaaacuugcaauuauaaauuaggucucuggcccuuugacauguaaaucuucucccagucucucacugauuuuacauccuaaaaaugcccuuuccaaggaccuagaaaccauccuuuugaaauaugauuaucaaaaaagauaauguccuuaucuucucaucucuguggaaggauaggaggcugauuugauaagcaccgacaaagaaacaagauuuuccuucaaaguaaggaaguaugaagaaguggccuuguagggagugacagacauggcucagauucaagcagaucauuuagucauuauagagaaguuaaauauuccucucuuacagguuagcugggcuuuaaaaucacaagaaaaaagucaaagguuacaggcuuuugugaaaaaguacacaaaaagaugccuuucacaaugacagucaacucaacucuccaagcaaugccuaguuucuagaaacuuccagaugaagaccagccauuucagucucugaagucccaggggugugcugggaucuuccacccacucagaaagccucuuucuaagaauucagucuuugagcauagcuguuagcuagaaagaaaauuccaguugauguaugaaucuauagaaccagucauucucaugcccucuagggauaaacuaggcaucuccaaacccugaaggaacagagugguggugagugguguucaaauauuuuaaaaguauuggaguaccaacaaggacauacugguuaggagaauaugagcucccaaaauggauauuagacacauuauuauuacuuuuugagauggaaucuugcucugucgcccagguuggagugcaguggcacgaucuuggcucaccacaaccuccaccucccagguucaaucgauucuccugccucagccuccagaguagcugagauuaaaggugcaugccaccacacccagcuaauuuuuguauuuugaguagagacaggguuucaucauguuggccaggcuggucuugaacuccugaccucauaauccaccugccuuggccucccaaagugcugggauuacagguguaagccaccaugccuggccuagacacauuauaaagguaaauaauuauaaccaugugauguugacacaugaguaaauaugaauaaauucagauaccuaaagggaaugcaguagaaauuaaguaaaaaacaaaauauaauuuggcaucaagcauacaauaaaaguagcauuucuuuuuuuuuuuuuuuuuuuugagauggagucuugcucuguugcccaggcuggaguccaguggcgucggcucacugcaaacuccgccucccagguucacaccauucuccugccucagccucccaagcagcugggacuacaggcacccaccaccacccccggcuaauuuuuuuguauuuuuaguagagacgggguuucaccauguuagccaggauggucuggaucuccugaccuugugauccgccugccuuggccucccaaagugcugggauuacaggugugagccacugcgcccggccuaaaagcagcauuucuaaucagugaggaugacaaggacuauuaauucauucaauaauacaggaacaauuaaauagucaucuaguaaaaauaaaguuugauucauaccucauuccuuauacaacaguaaauuacauagaucaaauauagaaaaacccaaaccauaaaaguacuagaagaaauuauaauaagauucuuauauaaucuggaagugagggaggccuuuuuaauaauaauacaacauuuugaaaccauucauuuaaaaaaggcuugauuaaauaaacuacaaaguaauuuuaaaaauuugcaugguggccgggugcgguggcucacgccuuuaaucccagcaccuugggaggcugaggugggcagaucacgaggucaggagaucgagaccauccuggcuaacaugguaaaacccugucucuacuaaaaauacaaaaaaauuggccaggcaugguggcgggcaccuguagucccagcuacucgggaggcugaggcaggagaauggcgugaacccgggagguggagcuugcagugagccaagaucaugcuacugcacuccagucugggugacagaggaagacuccaucucaaaauaaaauaaaauaaaauaaaauuugcaugguaaaaaucaguguaaguuaaguugcaaguaaaugaaaaacugaggaaagauaauuacaacuuguauccauucauggggcuauauggcuaauaagaaagagcuccuuugcccuucacaucaauagaaauagaccaacagcagcucccagaaugggccaaggcauuuugaacaggcaguucagagaaaaggaaauacaaauggaacuuaaacauaugaaaaaaagcucaauuuuauucauaauacaagaaacagcacaaagauacuacuuuucaccuaccaaauauguaaguuccaaaaauuugauaauaugcuauauuggucaggacauaacaaacuuuuccuuauauugcugcugaugguauaaaucauuguaacugcuaaggagggcaauuuggcaauacuuaucaaaaguacaaacaucccugaaccagcaauuuaacuuuugggaauguauccaucacacauaugccuucauaugugauguauaaauaagguuauucauugcagcauuguuuauaauaagaaaauauauaaaccauuguuauugauagggagauaguuaaauaaauuaagguauauuaauaggauuauuauuauuuuuuaaaauuuugcaggcacauaaaacauucacacaacuaaauaccagaaagugcucuauguucuacuguggaaauaucucuauuaaauuaaauuaauggguuaaaaaaacaagauaaagaacagaauguagaguaugcuaccauuuuuuauauagcuuaaaaaugagagauaaagagaggaaaaauauauuuuuauauuugcuuguaccucgguuaaauaucccuggaaggauauaccugacacugugugguugccuauugggaagagaaauggguaucugagguaauagguauuauagggagauuugcuucacuaaacauuguauaaacuuuuauacuuucuuacauuaaaacucucuuggccaggagugguggcucaugccuguaaugccagcaccuugggaagccaaggcagguggaucuccuugaguucaaaaguucaagaccagccuggauaauacggcaaaaccccaucucuaccaaaaauacaaaaaauuagcugggugugguggcccaugccugugaucccaguuacuugggaggcugagauaggaggauccuuugagcuggggagguggagguugcagugagccaugauugugccacugcacuccagccagcaugacagagcgagacccugucucaaaaacaaacaaacaaacaaacaaaacucucuuauaugacaucucauacuuugaaauguucaauuuaaucauuuuccaaaucuggaauauggcucauuuuuauugagauaugaauuguuguugaucucaugcuugaucuucccaaacagaacagaggcucuauaucuuucucugagaaacuuuggugauauuuuuagcacugaaaguggguaagaacacuucuaacacuggaaauucaaagucugcagcacuuacucuugggacuuggaaaaauucuuuuuuaaauuaauaauuguucaucaaugguuccauuuucuuugccuacaagcauguuucuuccuucaaaguggacaugggugugugcauauacucaucuguacacacauacauacacauguauauguguaagguauugaaaguaaaauguuuucuuuuaaaguauguuugcauuuuuccuagaauuggccucacaguuuccaucagacacucaaagcagugggugacauaggaaagguuaaauauuacuaaauaguggacauuacaauuccuaguuauucuuuuccccuuuccuacagcuaccauuuaaaucuagguuggcaacuucccuugggucuaaaucagcaguccccagucuuuuuggcaucagggaccgguguuauggaagacaauuuuuccaugggcagggcccaggguggaggauaguuuugggaugauucaagcacauuacauuuuuugugcacuuuauuucuauuauuauuacauuguaacauauaaugaaauaauuauacaacucacuacaacguagaaucagugggagcccugaacuuguuuuccugcaacuagauggucccaucuggggguaaugggagacagugacagaucaucaggcauuagauucucauaaggagcacacagucuaugcaguucacaaaaagguucgcacuccuaugagaaucuaaugcugcugcugaugugacaggaugcagaucuccggugguaaugcucgcucaccugcugcucacuuccugcuaugcagccagguuucuaacaggccaugggcugguugguacuggucuguggucuggggguuggaaaucuuuggucuagaugaccuugacagcaguauagcuggccugucugccuucaggcuuuccacacuccacauuauaugcccaaccagccagcuguuaguaaucauuuuaaaaauaauuuacugccuacuuuaucaaacuagcugugaagcguuugacuguacguugaacuauagccaagugugcuguauuucugcacucaugagugagcacuucguugucauacuucauuguccuggaauuucucuguuccuguuuuuauuaguggggaaaacucugcuguauuaauuuuguucacagaauaaacaaauuuuucuuuaauauauaaaaauaaacuagaaaacauguuuuacuggucacuuuucaggaagaaaugccuguauauauuuuuuaaauuuuuuuuuuuaggaacuuuccauagggugaaugauccauguuugaauauaaaguaaugauuuuauucagugcuuauaaacuguauucaauugcauggagaaaaaagaauacacugaccucuaauuuaaaaguaaagagcuuucuggagagguaacagaauaauaacuaauggagcuuuacaguuuauaagugcuuucauauaaaugaccucauuuguccccaccaaaaucucaugacaaauuguaauccccaguguuggagguagggucgacugggaggugacuggaucauggggggugguccuucaugaaugguauagcaccaucuccuggugcuguucuuacgauagugagugaguucucucgugagaucugguuguuuaaaaguaugcagcaccucccccuucucucucucuugguccugguccugccauguaagaugccuaugcuucugcuuugccuuccgucaugaguaaaaacucccugaagccuccccagaagcagaugccgcuauacuuccuauaaagccuggagaaucaugagccaauuaaaccuauuuucugaaaaaauuacgcagucucagguauuucuuuauagcagugagagaacagacuaauacaucaucacuguuauuuuaaagaauaaggaaaugaagacucagaaggaugaagcaaugaccaacccaggucauacaguagguaagcgaaaaaccagggccuuuaacuuaaacuuucugacacuguaucucauaaucuuucucauauggugaguggcucucccaacauuacuguuacauaaaaauuuaggucaugcguguaauuuuaucaaguaucccucaauuccugggacuuaaguaauugauacacagaacagguuaaauagagagccuuuucugaaaggguaaggaaaaacaacauugauguuucagaaccaauguguguuuauaucauggaaaaagcuagaaaucccaguagaaaagucuuuacagaagcacuacuuaucacuguauaccuggcuauauauaaaucauagguagcauacucccccuuucccugaauucuaaugaaagcauuguuccaaaucuauuacagcuauauaguuuuuauaaaaugacccauggggaaaauucuuucuagaguuuaaaagcuggaaaagaguuucuuucucuacacgccuugauaauauuguuaucaauauaauauuauauaauauuauaaugacaguucuauagcccacuuuugucuugauuaucaagaagcucagagucaaguuguagucuuaguuguagucauuuuucuuaauuuggguuuucuaaaaugugauuguuaauacugaaugucaauuugauuggacugaaggaugcaaaguauuguuucugggugucuccgugaggguguugccaaaggagaguaacauuugagucaguggacugggagaggcagaucacccucaaucugggugggcacgaucuaaucagcugccagcguggcuacaaaaaagcaggcagaauaaaguggaaugggcagacuugcugagucuuccggccuucaucugucuccugugcugaaugcuuccugcccugaaacaacagacuccagguucuucagcuuuggacucuuggaguuacaccagugauuugcuaggggcucuugggccuucggccacagacugaaggcugcacugucggcuuccguacuucugagauuuugggacuuggacuggcuuccucgcuucucagcuugcagacagcauauugugggacuucaccuugugaucaugugagucaauauuccuuaauaaacuccccauccauccuauuaguucugucccucuagagaacccuaauacauggauuauuuucuuuguucuccuuuuuacauuuuuccuuuuauacuaucuaguucauaccuuuuacuaccguuucaauggauuuuuauuuuacuguaauuauaucuuuuuuuauaagccuccucaaaucuguuuugaagauaggcagaguauaaacauacagaguccauucuaaggaacaugagcauuuaguccauugaaagaacuaacaauaguauaccaggugcaaaugaucuauuuaaucucuugaguagcuuccagagaagaaauuucugcuguaagugcacaggguaauagaguccuguuuucuuucuuuuauucuuauaauaaaaguuugacaucacuaucacaaccauuucaugugucaguaacaguagaugauagguauuugguauuauacaacauuugcuuguguuaaaaugagcccugguauuucacguauguuuuaugauugugcacauuuggugugauccaaagagauaauaguggaauuuucuauggaaauucuuguuugauacagaauuauaucagaaguugacacaagaaucaauguguauauugucuaggguauauaucuuacauauauaauuauaucacaucuacaguucugauuaucauaggaauauaauacacaugucacacggacaaacguauucauuuuccuaauugauggcuacagcagagaaaaccagugaguaucaucuuugagagauaaaaccguggaaauguccuuugugguaugauuaauacuaaaagggaaaggguaauugggugagaaguuagaaggugaaccaaaggaagacuaagaacuuuuuguaccgucaauaaaacaaauccagacuuagacacggugagacguaaaaaaacuacaucaaccuggagaauguuccucccuuaggauuuucaagccacucaaaaaucaaucaaaaagguuuuucuuuuauagggacggcuaaacagaacuagcagaaacuuagagguaaaauugagugacagggcggagcuaagcagacaucaugauggggaugauauaacaggaaauguugcugugaucagcuaauuuggaaugaacuguuaagguagggugauauagcuaguguuuuuguucccuaguguauuguucaguuucacauugaauuguaauccucaguguuggagguggggccuggugggagguuacuggaucaugggaguggauuucucaugaaugguuuaccaucauccccuuggugcuauucucaugacagugagugaguucucacaaaaucuaguugcuuaaaaguguuugguaccuccccccucucucgcuugcuccuacauuugcuauacaaagugccugcucccgcuuugacacccucuaccaugauuguaagcuuucugaggcuucccuagaacgcgagcagaugccaggaacaugcuuccuguaaagccugcagaaccgugagccaauuaaaccucuuuucuuuauaaaucacucagucucagguauuucuuuauaguaaggcaagaacagccuaacacagugggauguuuacauuuuaguguuugcucagauuuggggcaagccaaaagucaggagccuguggggaggagagaugucugauuaaaucuugaucaagccaagucagugggcaagaaaugggcaauugugagcaucuggccgggaucugcaaccucaugaaaaguauauaccaucaaaaggcuaacuacuuguuugucacauaaauucuuauaaaaagcuuaguggagccaagaagcaagcuaaguauaauaagagaaacucuucuuaccauuuguaucacuaaugagcacauaauugcagcuagucauguaagucuccuacaaaucagcguaagguuaauuaagagaguugagacacuuaggugaaagucacuuuugcuuauaguaaagaacuuaucuaucuuacagacacauaucacuuacauuauguauuuguuauauuaauauauuuaauauauuuaaaaaacauuguaaaaugaugaucuggcaauaucccuagaagaaccucauugaaauacuugagauuuauuggucauuugucuuuacaaaauugagauuugaaaagcuuuaaaggaggacauucuaccaaagcauaacucauaaaacagaagauaaaaguaugagccauggaauuauagagcuggaaaagaucuagcccuacuguuucauuuucaaaugaggaaauugaggguuauucuaagggguuguuuuuuuaagucauacaguaaguuggugcagacggaggaguagcaaucagaucucugagcucuuuuccucuuugacaaugaaguucacgaaugcaauuuuguuucauaaguuauuuacuuuacuaaaguaaaguaagguacagcuaugauuuauuguuaaaugagaagaaugagugucagagaacuguauauggcaugauuucauguucuuaaaauacaaacaauauuugucaaucuaucuaucuaucuauauugauuuauuuaucuucuaucuguaugugauugaaugaaauuggagaaaugaguggaagcauauacaccacacuaacauugaacauuuacaagaaggguaaaaaaaggaguaagaaaaaaggaagcaaaauagaauuugguaaaaugguaugugaaagugaagauugcaaaacuuuuauccauaaaauuauuaauacauaaaaauugaaugugcacauagacgaagacuagaaagucacuaggauauacauacaacaagaacauaaacaaaagaacauauuauuuugaccagggguuuauuaaaaauaaaaauaaaaacaaguccaaugacucccuuuucugaaaccacugaaacacaacuauuuugacucaaaacugauaaaaagauguaaucauauauucacaaacaguauucacuuaggaaauuuuaccuuauuuucagcauugauaccuauaaaguuuugugcuucaccuaugaauguauauauauguacauauacguccauauaaauauuuuauuugcuuaccauuauauuuguuuacuaaauuuggauauacuucuuuauuaaauaauuuagacaaugaaaauaaaauuaauguauacucacuguuaaaagcuuagaaaauuuagaaaaagagagagcagaaaauaaaaaccacugauaaucuuacucagagauauccacuguuagacuuuuugcauauguccuuucagauuuuuuuugcauguauguguauucaaaaaugggcuaauaucuuacuuuauuaucugcugcuuucauuuaguaacaaauuauggcuauauuucugugguaauauauauagauacaaugucauuuuaaauuagguguuuaacauuuuaucaucaggaauuaguguaauuucuuuuuuaaauuuucuauuaauggucauuugauuugauucuauuuuuuaaacaaccauaaacaaugcugaaaugaauaucuuuauaugugcauuuuuugcuccuguucaauugcuuccuuaggauauauuccuauaugugauauuuaauuauaaaauauuuaauuuccuaacucccuggaaguuuacacuucaguaucaaaaacacuaguggaugacaauuccuuugcuauuagaacagaagaccauagaaucaaccaauaacagauacaaaguuuuucucauggguaagugcccuacacuggucacuuaauucuucauuauauuuugggcaaauaaauuuguaucuaaaaaccaucuuuaugaugaucuaugacuuauaaaaaucuacuauuuaucuuacaaauuacuuccaauuacuuuuacuucuucuucuguugccgguaugaggucacuaaugguagauuuuagaaaaugcgcuaacaauuauauguaaaccauacaauuaguauuuuuuaagugucuacaaagaagacauuugcaagugguuucuagcuuuauugugaaugugcaagggguauauucuaucaaguaagcaucauuccuauccucaagacacuuauauauacuggaaauaugaaaucauuauccauaguuuggaaaaauuuuucuuuuaagaaaauaauagauggaaaagaaaagagaaguccaaggaaaaaaaaagucaucuguuaagaucugcuauguaccaggaauauaguuaacuacuuccuuauuaauuacagccucccaauaauauugaaguagauauuauuuauuauagcuguuuuccauaugaagaagugaaauucagacugaugaaaugauuugcacaaggugacacugccaauaauugauauagugagauucaaaccuaggugacauacuuuugacccaacaaaauaaguuuucaacaacuugagugucucagugauagaauauauuaucucuggaagcagugagcuuaucaucaugggaaguauguuagcagauguuaguugauguugguugaucauauaucagagacaugaaaaauauucuacuacuaaugggcgauuucacuugcucaucucccuaggccccuucuggaggguuagauauuuuguugaauugaaaacuguaccauuuuuaaaccauugauacgucauaagcaaauauuagaccacagaauaauacucaacuauuuuacacuuaagggaaaccaaauaucacaaugaauauuaucucuaauuuuagaauacuagagaaucucagcgguauuugaaagaucaaaauuuauauuaugcauguuauuuuugcuuuuaaacacuaguuagaauguauggugcuaaauacauuuuagcgucuguggugcuaagaacacaaucguuugauuaaacaagaucucuugauaaagauuaguuagcacaugcuagccuaacaauuacugaaauucacauuuuuacauggguauccuauuauuaagugauuccuuagauuuaaucuaucugaaaaaagucaguaaaauguuauauaaaauaauaauaaaaauaaauccucucuugauuuagauaaaauagcaugcuugugugcuaauguauucuacuaccuaccuuccccaguugcuucuauuaaaaauaguacuguaaaaagaaauaaaaaucaaaaauauaauaugccuguugcaaagcguuucagagaagcuuuuaugugaaauuuaacaguucauggaacaaagaauaugacuggaggcaaggaaaauuucuccucugaaaauaagugaaaccuaggucgucauuagaguuugugcauucacuuuugggacauaggauauguucagggcuaugacucauuuacauacaugacuauguggccuguguuuugggagggcugugggguguuagcugaagccuuccaugcugguaguuaugcuuugcuaagagaaggcugguucucuacuuacacccccucagauggcucucuuuagugcaugucuguaugauuugaccuaacagaaagaagaaauggacuagcuucuguuauucuaugucagcagcauauuuuauugaaaggaguauggacuucaggaaaagaaaaaucaggguuugaagcagcugagaagucaacaagcuacuuauucuucugagcucuucuucaucuauaaaaugggcauaauaauacuucacugagugaguuguuuugagaauugaauacaaaaaauguugacaguaguaaacugcacaucaucugauacacaguuaagaauggaguacauuuuagcauccuuuuuuuuaguucuguaauaaggagauuguaaauacauuuaaaaaaaaauguuucccuagaguuuggugggugauauugccacuuaggaggauagcuaucagcugcacuggugacaaaguaccuccugaugcagacccagagcuacauaagcaaacaugaggggcuuggaagcaacccagacaucaagcaggagcaguuuccagggcugugaagauguuugcucuccucuacuuagaaagaggcucuuuuaggagaaagggacauauuuaggagaaagagcucugccuguucuugcagacccagggaaagaggagcuuggaucaggaagccagagagcauuuacucugccuuagugaguuccuaagguccuagaaacucucuaugggugggucucugcugcggugagggacucugaacugugaccugccccucagaucccaggaagaagagaagcaaaagcuuagaaagcaaggcuguaggauaaguguuagccacugauuucagagcuauguauuuuccagcaaauugucuaagaacuaugcuuuaucuauccaauauagacaauguacucuauaauaaaauuccuuaggaauuaauuuuaauagcuuucauuuauaauuaaaaucuagauggcauuuauauauugacaaaugaauacaauuuaaccuuaaguauaagaagaaaaugccagccuuaaaaauacauuuuaacuacuuaacuauuuuuauacgaaugcacuugagauuaaucuaauauaguccauauaucuugcagucaguucaauguaacaagauuauuaaaacugguuuagaaauaggaggguguuuaugagauuaucugucacccuuguauugugaagccugagcgcuugauuacucugcauguuugcucuuguguaaugacaagcacgucccguggagccaauuacugccuccacuuuacuuaagugauccuccaucccaucaagaagauauucaaccugauucuuagaaaagugugaguauuugaaguaguuccagugaaggugguaaauuuccuaacuugaaagcacuuucuuaugauugcaaugacaaugguuaaagaaauaaaacuucagaaaagauuccacaugaaagcaacuuagaauaugaguaauuauaccuuaacuacaauccucagugaucaaaagauaagcaagguuucccaagcaucuuucuguggagcaugcacucuaaugagaaagagaagccaugcauacucugauaaaaaggcaagaaaauuauauuuaugaauuaccagcuauguuucaggcuauaaaguugagaauucccaaccugaaaaucugaaauccgaaaugcucccaaaucuaauuuuuugaacaccuacaugacaccacaaguagaaaauuuugacuguauuuugacaagccacagucaaaauacagucaaaauuuuguuuugugcacaaaauuauuaaaaauauuguauaaaauuacauucaugcuuuguauagaagguguauauaaauaacaaaugaauuucauguuuagauuugggucccaacuacaagauguuucauuauauauaugcaaacauuccaaauccaaaaauaauugaaaucugaaacacuuccggucacaagcauuucagauaagggauaccuaaacuguaguaguacaguguauaauuuaaucuugcuacagucuuauagggugguuauuaaaaaucugaguuucuaggugaggaaguugacaucagggaggucagaaauugcaaaacugggacuugagaccagguccaucuaacuucaaaaccuguuaucugaaaggauucuaaaaaugcaaaccugagagugcaugaugauguagaauauauuaucacaucacauauccagcuuugcugaagaacaggguguucugcacaauaugaggcauugaauauaauugaauccuacaccaauacugauuuguuuggcauuugagucugauuucaagugggaaaacagaaguguuguuuguaaaacuuaugaauuaauaaguucugagaaucaaaaggacugaccucaaacaaauucaggaaauuauauuuacucuuauuucugucuuaguccuggacaguugacguugcuagauaaguuucaaacuacuacacaauugcugagaaaauuggggugguaggaaaaagaggaaacugauuucuauuaguaaaacuaguugaugacccauagagacugcucaaacuuugaguggguucauauuuauaggaauaaagaugagagaccuccaaaucuuuuccugauccaauaaauauuuuguuuauaaaauaucugacauuagaaauguguagggguggggacaacaaaaaaaaugcugagacaaaauaggcaagagaauccaaauguaauguugaccuuugauccuucaucuccauugcuuaagauuuuauucucccaauugucuuaagaggucuuaagcaacaaacauaaguguucaaaaaacuacagagcucuguuagagcuaggcauagcacuugacuuaguauccucccaaagcaaaauuuugcagauagacaacacauacuacauaaaacgguguuuccucuugcucauuuuaaauuuaccucccauuaauuucauugccugucccuucccaauugucaagcaaaagcaguaugaucagauuucaucaaaauaacuuagaccacuuaaaucaauguguauuagacuuuucuucuuucugugccaggguacucuggaauuuuaugcucucuuuuaguaacugcucuucucugguaccaauugacuggugcauuuaucaugaccuguauuccaacugacacaccacaacaauuccugggaauacagugaauuuaacauuaagauuguaagaucagcugacauucuaagauucuuacagacagggcuuacguguauuuauuuugguaugaccacagcagcaaacacaaugucugcaucacaauaggacaaggugagagcuaaaauuuaauauguaucugcauauguuagacuuuuauguauaugccaucgugcaucucuacacucauccucuauuaguauucucauuucugucaauggggaaacugaguaagucaccuaagaucaagcagcugguaaauaacagagccaagauuugaauucaugucugucugacuuuuuuuuuuuuuaccaugugauuuaccaaccacacucaguacccaaaauauuacuuguggaaugccauuuucacaggguuguuuaucacaccucuaauuaaaccuacccuugagagggaaaaaacugcaacucagcaaaacuguaauucacaacuagccuaauggccaaguggaaugguacaugccauggucaaucacuuagcacguaaguagugugugaugaagagguaaaaauugaggcacacacagagccagccucuguuaauaacaaugauucuuuggggacugagucuccacuuucauuuuaacuaccacuguagaaaaaugauaaauaaagucaguagguaggauggcaauaugauagguagaaagagaagaaaaaauaauuuguguauuuguuuaccacuaaaaugcccuuaagaggcagcuuuguccaaguggcacuuuuaacauuuauuuuuacuuuuaauaaucauguguauuauauuuuuauggcucaauggcacuauauguuugaagaauuuuagaacauuaauauccaauguuaccuaagucuagcuguggacuucaugcaugaaacaccauuccagcacagaagcacuccuagcuugaauauccucaguauugaggaacuuacuaucacacggggcagccacucuaucuuugaauaaagauagaaugaguaaaguugauaagaaaagaaauucuuaccuucacaucaaucaaagaucuguauucuuacaauaucccugaaauuauucuguaagcaggccugaaagaauuacguggcaacauauguugcuaggcugguucguuggguuuuggcaaaguccucaguguuugucagcauuucuaugugagagaacuggcuacauagucuaucuuggagcuaauaucauacuugggucacuaaacauauguaugaaauuuugagaauuguuucuuaauuuuucaguuuuaaaaucuaaugcaaaccuguauuucagaaaaaaaguauugcuugaccuuuuuaaaaauuaucacuuaauuaacauggggcccagccgaguuagaauaacuucucacuuguuccaacauaagagaaacaagcaagguacuccuaccagggugucacuuagaccugcauauucuuuuuagugauugcaauguuacuucuuagccacccaggccaauccaccauaaaacaaucauucuccaacuuuccuggucuuaagagucacuuggauugcuuguuuaaaaggcauauuuguugagcucugccuccagaaauacugauuuaguagcauggagccgaggaaucuucauuuuucaccagcgcuggaagugauucugaugcaagugauuuguagaccacauuuugagaaaaauucccuaauguuagcaguuguaaugaugcagguaguucauucaguuuugcuucaguacaaaacugcaaggauaauacuauuggguuuucuagauauaggaucaugccaucugcaaacagggauaguuugacuuccucucuuccuauuuggaugcuguuuuucacacugcuguaaagauacuaccugagacuggguuauuuauaaagaaaagagguuuaacugacucgcaguuucgcauggcugaggaggccucaggaaacuuacaaucaugguggaaggcaaaggggaagcaaggcacaucuuacauggcagcaggagagagacacaguaaagggggaauugccacacucuaagaccaucaggucucgugagaacucacccacuaucaugaaaacagcaugcugggaaccaaccccaugauccaaucaccucccacuaggucccucccuugacauaucaggauuacaauucaagaugagauuugggugggaacacagccaaaccauagcagaugcccuuucuuucuuucucuugccugacugcacuggccagaacuucugauacuauguugaauaggaauaaggagggcaugcuugucuugugcugauuuucaaggagaaugcuuccagcuuugaccauuaaaaagaaugagauuauauccuuugcagggacauggauggagcuggagaccauuauccuuagcaaacuaacacaggaacagaaaaccaaauucugcauguucucacuuauaagugggagcuaaaugacgagaacacauggacacacagaggggaacaacacacgcugauaucuuuuggaggauggagggugggaggagggagagagucaggaaaaauaauggguacuaggcuuaauaccugggugaugaaauaaucuggacaacaaaccuccaugauacaaguuuaccuaugcagcaaacauacuuguaucccugaacauaaaauaaaaguuaaaaaagaagaaaauugcaaggaugguaagauuuggggcucuuucauaacuuuucaaauaugucaacugagaauaucaaaaugaaucaccagccuuuuuuguuugggguguguuccuguguguuugucacaaaauucacauacuuuucaacugugccugccuuacacuaaaauagucauuauacccagcuguauaggcccagcuauauacauauauauguauauauauguguguguauguguuugugugugucugggggcuccacacacauuuggugucaauacugaaguaaugcaaauaucucuguauuggcuacaaaacucaaacaagaaaaaugaauagauuuggaucugauauggccuuccacuuuggcucugaacuuuaguuguaaggaagaaaauaauacuuaguaagaguaauauauaaaauagugauuguaaaaccaacuauuugugaaauagucugccaaguauuaugggauacauaaagaugauuaacacacaguucuugcaaaauuggagcccacaacuuagcagaaguuguuaaucacuuuggucaggugaauguuucacugaauaagaaauauuaguguauuaagucaucagauucuuuaaugcuuugaagugcuucauacugagcucuacauaaaauagaaacuucgugugugugcaugugugucuauauauauacauauuugaagacagggucucacuaucuugccaaggcuggucucaaacaccuaggcucuagcaauccuuuggccucagccucccgaguaccugggacuacaggcacaugccuagcacauagaaaaacuucacugguguccaagguggcugaauaggaagagcucuggucugcaguucccagugagaucgaugcagaagaugggugauuucugcauuuccaacugagguaccugguucaucucauugagacugguuggacagugggugcagcccacagagggcgagcugaagcagggcgggguguugccucacccaggaagugcaagggguugggggauuuccccuuccuagccaagggaaacugugacagacuguaccuggagaaaugguacacuccugaucaaauacugcacuuuucccacagucuuagcaacuggcagaccaggagauaccuucccuugccuggcuuggugggucccacacccacggauccuugcucacugcuagugcagcagucugagaucaacaugcaaugcugcagcuugacggggggaggggcauccgucacuguugaggcuugaguagcucacagugugaacaaagcagccgggaagcuccaaauggguggagcccacugcagcuuagcaaggccuacugccucucuagauuccaccucugggggaagggcauagcagaacaaaaggcagcagacaguuucugcagauuuaaaugucccugucugacagcucggaagaaagcagugguucucucagcacagcguuugagcuccaagaacagacagacugccuccucaagcaggucccugaccccuguguagccugacugggagacaucucccaguaggggccaacagacaccucaaagaggugggugcuccucugggacaaagcuuccagaggaaggaucaggcagcaauauuugcuguucugcagccucuacuagugauacccaggcaaacagggucuggagugggccuccagcaaacuccagcagaccugcagcugaggggcuugacuguuagaaggaaaacuaauaaacagaaaggaauagcaucuacagcaacgaaaaggacauccacaccaaaaccccaucuguauaggucaccaacaucaaagaccaaagguagauaaaaccaaaaaaaugggagaaaccacugcagaaaagcugaaaauuccaaaaaccagaaugccucuucuccuccaaaggauugcagcuccucgccagcaagugaacaaaacuagacagagaaugaguuugaugaguugacagaaguagccuucagaagguuggaauaacaaacuccucugagcuaaaggaucauauucuaacccaucucaaggaagcuaaaaacccugaaaaaagguuagacaaauggcuaacuagaauaaacgguguaaagaagacuuuaaaugaccugauggaacugaaaaccaaagcacaagaaccucaugaugcaugcacaagcaucaauagcugauuugaucaaguggaagaaaggauaacagugauggaagaucaaauaaaugaaauaaagcaagaagacaagauuagagaaaaaagagugaaaagaaaugaacaaagccuccaagaaauaugggacuaugugaaaagaccaaauauacauuugauugguguaccagaaagugacagggagaaugaaccaaguuagaaaacacucuucaggauauuaucuaggagaacuucccgaaucuagcaaggcaggccaacauucaaauucaggaaauacagagaacaccacaaagauacuccucaagaagagcaaccccaagacacauaaucaucagauucaacaagguugaaaugaaggaaaaaauguuaagggcagccagagagaaagguuggguuacccacaaagggaagcccauuagacuaacaguggaucucuuggcagaaacauuacaagcaagaagagagugggggccgauauucaacauucuuaaagaaaagaauuuucaacccagaaucucauauccagccaaauuaugcuucauaaaugaaggagaaauaaaauccuuuacagacaagcaaaugcugagagauuuugucaccaccaggccuaccuuacaagagcuccugaagaaagcacuaaacauggaaaggaacaaccgguaccagccacugcaaaaacaugccaaauuguaaagaccaucaacgcuaugaggaaacuguggaauuaacaggcaaaauaaccagcuaacauaaugauagggucaaauucaaagauaacaauauuaaccuuaaauguaaauaggcuaaaugucccuauuaaaagacacagacuggaaaauuggauaaagagccaagacccaucagugugcuguauucaggagacacaucucacaugcagagacacacauaggcucaaaauaaagggauggaggaagaucuaccaagcaaauggaaaacaaaaaaaagcacggauugcaauccuagucucugauaaaacagauuuuaaaccaacaagaucaaaagagacaaagaaggccacuauauaaugguaaacggaucaauucaacaagaagagcuaacuauccuaaauauauaggcacccaauacaggaguaaccagaaucauaaagcaaguccuuagagaccgacaaagagacauagacucccauacaauaauaaugauagacuuuaacaccccacugccaauauuagacagaucaauaagagagaaaguuaacaaggauauccaggacuugaacucagcucuggaccaagcggacauaauagacaucuacagaacugcauaccccaaaucuucucagcaccacaucccacuuauucuaaaauugaccacauaguuagaaguaaaacacuccucagcaaauguaaaagagcagaaaucauaacaaaccgucucuaaaaccacagugcaaucaaauuagaacucaggauuaagaaauucacucaaaacugcucaacuacguggaaacugaacaaccugcuccugagugacuacuggguaaauaacaaaaugaaggcagaaauaaagauguucuuugaaaccaaugagaacaaagacacauuguaccagaaucucugggauacauuuaaagcagcguguagagggaaacuuauagcacuaaaugcccacaagagaaagcaggaaagaucuaaaauugacacgcuaacaucacaauuaaaagaacuagagaaacaagagcaaacaaauucaaaagcuagcagaagacaagaaauaauuaagaucagagcagaauugaaggagauagagacacaaaaaauccuucacaaaaucaaugaauccaggagcugguuuuuugaaaagaucaacaaaauugauauaccacuagcaagacuaauaaagaagaaaagagagaagaaucaaacagaugcaauaaaaaaugauaaaggggauaucaccaccaaucccacagaaauacaaacuaccaucagagaauacuauaaacaccucuacgcaaaugaaguagaaaaucuagaagaaauggguaaauuccuggacacauacaccuucccaagacuaaaccaggaagaaguugaaucucugaauagaccaauaacagguucugaaauugaggcaauaauaaauagccuaccaacuaaaaaaaguccaggacaagacaaauucacagccgaguucuaccagagguacaaagaggaacugguaccauuccuucugaaacuuuuccaaucaauagaaaaagagggaauccucccuaacucauuuuaugaggccagcaucaucuugauaccaaagccuggcagagacacaacaacaaaagagaauuuuaugccaauaucccugaugaacauugaugugaaaauccucaguaaaauacuagcaaacugaauccagcagcacaucaagaagcuuauccaccacgaucagauuggcuucaucccugggaggccagguugguucaacauacacaaaucaauaaauguaauccaucacauaaacagaaccaacaacaaaaaggacaugauuaucucaguagaugcagaaaaggccuuugacaaaauucaacagcccuucaugcuaaaaacucucaauaaacuagguauugauggaauguaucucaaaauaauaagagcuauuuaugacaaacccacagccaauaucauacugaacgggcaaaaacuggaagcauucccuuugaaaaccggcgaaagacagggaugcccucucucaccacuccuauucaaaauaguguuggaaguucuggccagagcaaucaggcaagagaaugacauaaaucaauuagaaaaagaggaagucaaauugucucuguuugcagaugauaugauuguauauuuagaaaacccaaucauuuuagcccaaaaucuccuuaagcugauaagcaacuucagcaaaaucucaggauacaaaaucaaucugcaaaaaucacaagcauuccuauacaccaauaauagacaaacagaaagucaaaacaugagugaacucccauucacaauuacuacaaagagaauaaaauaccuaggaauccaauuuacaagggaugugaaggaccucuuuaaccagaacuacaaaccacugcucaaugaaauaaaagaggacacaaacaaauggaagaacauuccaugcucauggauaagaagaaucaauaucgugaaaauggccacaccacccaagguaauuuauagauucaaugcuauccccaucaaguugccacugacuuucuucacagaauuggaaaaacuacuuuacaauucauauggaaccaaaaaagagccuguggagccaagacaauccuaagcaaaaagaacaaaccaggaggcaucaugcuaucugacuucaaauuauucuacaaggcuacaguaaacaaaacagcaugauucugguaccaaaacagauauauagaccaauggaacagaacagaggccucagauauaacaacacacaucuacaaccaucugaucuucaacaaaccugacaaaaacaagcaauggggaaaggauucccuauuuaauaaauggugcugggaaaacuggcuagccauauguagaaagcugaaacuggaucccuuccucacaccauauacaaaaauuaacucaagauggcuuaaugacuuuaauguaagaccuaacaccauaaaaauccuagaagaaaaccuaggcaauaccauucaggacauaggcaugggcaaagacuucaugacuaaaacaccaaaagcaauggcaacaaaagccagaauagacaaaugggaucuaauuaaacuaaagagauuccacacagcaaaagaaaaggcaaccuacagaaugcgagaaaauuuuugcaaucuacccaucugacaaaggguuaauauccaaaaucuacaaagaacuuaaacaaauuuacaagagaaaaacaaauaaucccaucaaaaagugggcaaagguuaugaacagacacuucucaaaagaagacaucuaucuagccaacagacacaugaaaaaaugcucauccucacuggucaucagagaaaugcaaaucaaaaccacagugagauaccaucucaagccaguuagaauggcgaucauuaaaaagucaggaaacaacagaugcuggagaggacguggagaaauaggaaugcuuuuacacuguuugugggagcauaaauuaguucaaccauuguggaagacaguguggcgauuccucaaggaucuagaacuagaaauaccauuugacccagccaucccauuacuggguauauaccuaaaggaucauaaaucauguuacuaugaagacacaugcacacguauguuuauuguggcacuauucacaauagcaaagacuuggaaccaacccaaauguccaccagugauagacuggauuaagaaaauguggcacauauacaccauggaauacuaugcagccauuaaaaggaugagcucauguccuuugcagggacauggaugaagcaggaaaccaucauucucagcaaacugucacaaggacagaaaaccaaacaccacauguucucacucauaagugaacaaugagaacacauggacacaggguggggaacaucacaugcaagggccucuugcgggguggggagcugggggagggauagcauuaggagaaauaccuaauguaaaugacgaguugaugggugcagcaaaccaacauggcacauguauaccuauguaacaaaccugcacauugugcacauguacccuagcacuuaaaguauaauaauaaaaaaaagacuuacaaccaacagagaguuugaaauauauuuaaauuaaaaguauuauuaaaaaauucuaaaaaaaaaaaagaaaaacuucacuggcauaguaaaauagcacaugggaaaaaauccucucaauuugcuaagucaauauucuuauaacugauguugcuuauaugucauuguuguuagaucugagaguggaaggaaauaauuuguaguuauuguuauaaugaaaaaaaugcaauuaucuaaagauuccuaucauuuucucacuacuccuuaagcacauuuauucauuauaauguagaggaagguugccuuacuuguggucucaccauucaucucuuuaaguucguuguugauuccaacaucuauggaacucauuauuuugucaaucuguaagaaacaaaaaccauuuaaauggauuguuacauucacuuuuaacauuguauuuuaaaauaaguuucaaaugaagggagcaaauauuuuugauguuauuaccacaguguuccacaguuaagagaugcauagcgaaauauuuaaaggaaagcaaacaucuuucggauuguuuuauuaaaauguaaaguauguuccccuuucuuaaacuuucaaaauuaguuugccuuuucuuuguguuucuugaaauaaacuuuguacuuggauagauuggucauuuaggaacuguguauucuucaaacucagaaggacuguagauaaauucaugugacaaagucucugcucucuggcacccuucuucuucugccuaagaacaugcaucccaucuaacugguaaaggagcagguuucaggguguggagagcacggccacaggagcaaaguuuucuguuuuuuguuucgacagaaucucacuguguugcccaggcuacagugcuguggcaccaucucagcucacugcaaccuccgccgcccagguccaaaugagucucgugccucagccucccaaguagcugggauuacaggcauaugccaccacaccuggcuaauuuuuguguuuuuaguagagaugugauuuugccauguuggccaggauguuucugaacuccuggccucaagugaucuaccugccucggcgucccaaagugcuaggauuacaggcaugagccaccauucccggccuggagcaaguucuaaccaaaugguuugaccaaccacaagcugauuacugacauccaaucaccagcaucuagucaugaaaacaacuuaauuauaagaucuaaguuaaauguuaauuaauccugccucuacaaaaggaucucagauguuauucacuaaauuaauaaauauaagaaauggcuauacuugaaaaacuaaccaucuacuaguauggaauuuaaaggaagauaugauggucuaagcuauagcaauuuauggcuuaaugacucucuugauguuagcaaccugaauaagauagcagguuucagaaaggacaaugggcauuacuuaaaugucccaguuuguucacccugaaacagaugcagagauauuaagugauuuucccaaacagcucaguucagaauaucacuaucagaccauauccauuucuaguucuccaaauacuauaaugaucuauugugcuucuaaaccuaauccaacugguacagucuuuucagagacaauaugugauguguuagaaugaaauaccaagagagacuguaugaaauuaaacacuuuaaguagaacugaaauuggugauauuugaaccucaaacauuuuuuucuuuauuucccugauagcugcaaaagggaaauaucaaaugauguguguuuauuguaugguggcuggagaagagcuaggaaacuuuauuuacuaugaagauucuaaggagcucuucugaaaauauaagauacuuuaaagaagggagacaaacuaacaaagaguuuggcaaguagcaaaacaacacagagcaaaauacugagcuuuuucucgauuugucagcugcagugcuugguaggacgagaugugaauauucucuuguaccucauagcuaguuauuacuucugcuugauaucaauuucuauggaaacaauagauuaacccacauguguggaacaguguuuguuuuuauacuugcugugaaauuaccaugcauuacccacagaaccauuucauuccaguuggagccguaugcuuuuuuuuuucuugcuuuugaaagagcuaaaaagcugaaaauccuucccccaaaccucccucaacugcaaagccuuauaggaugaacagcaagaagaacaaagcuuacuucuucccauuccgaugugaaggaugguguucuuucagaauucccuuuagaacuguguucagcaguggaagauucacuccaguuaacucuugauguuuucucauuggaaggauaggcaaugagaucagaaucagauuuagagacacuuuuugacaaaugcaugucgaucaaggcuuuaggcaaugaccuuauucuccccagaguacaggcucucuccacaaaucccccugcguucauaacccacugguccccauuccgagauccacuccugguugaucuugugccaacaaugguaugguuuucgaguugguugcuuuuuuugugaaaaauuguucuacugaccacuuuggguuuaauuuucuuuaccaaagguucugaguuauuuucuauuggagacugcuugaaaggcaaaggacuguuugccaaacugacuucaucuuguccuuuuucacauuguucucuuuucccauagagaugaaauggauuuucaggggacucacaggcuggagaggauccauggagcaggccugcaaauugcccaggaucauauucuuuugggggaucauugucauccugucgggagaggucaucugcaaaaggaaggaagggauaucaggguuuauaaagguucugaaagccacgauauaauagcagugcccuuaugaacaugugggcuauccaaacauuucauuuacugcuacauagcaauaccuucacuuuaugaaauaccccugaccccacagugccauguauagaaugaauguaugagugugugugcguguguaugcaugugugaaucauucuuucugauauaccuuagaguucauuucaaaaguaugaauuguguauuaauugaaugacuucauucacuucucccuugaacccaggguguauguuuuauagccaaugaacaaaauuggguuuucuuaaaguagaacacacacaucuaaacucucacaguaaaugaaucaucgugaaguagaacacuaggcagguaagucaaggucauauauaaugacaacccucugcccuccucccagcaaauaaauucaaaaaccaaauuuugaaaaaagguauuauuaaaaguaauugaaguuuaauaauccugauauuaccuuaaauauaaauuuaaaauaauucuaugcagauuacauaauuuagacaaaaaaaauuuguucagacuuaacaaaggcaaacaacgcaguaucagaaaaagagagacuccaauauaagaaacuaauguuuagcuaugaacacaaagguagcuuuuucuuucuucucugaaacggcauuagcuauuuucuaauuucuucagaucuuugaagauguaaugcagaaaagaaaccaaugaugaaugauaauuuuuauuccuuuggauuuuuuucuaagauaaaacacacauuuucucugagauuuaaaauacaccaugcuuuuugcgacuuaauuugucuuucaaagacauacuguguaaaaaccuggccaaagaauuuagcaaagaaaggaaguguccuuuuuuucaguguucauuuuaauucauaucaauagcuaaauauugccaagaugaaaauuuaaauuaccugauaagcccauaacucacuguugcaaagaacuaaaguauaguaaaugugguacauaaugacaacaaauccaaaguugaugugcugauucguacuuucaguaaguuaauuauuaccauaaaccccaaacacuaacauuuuuauaaauuaacaaguaacauuuaauggguaaguguuauuuacuaggcacugaaugaggaauuauaucaucucauuugacacccauaacaauccuaugaagugauuauuaauaauaauuaugauuuugugauggaacgagauggccaaaauaucgaauucucacauuuuuaagaaauuggcaaccauaauaaaucuuauuagacauuggcucagaagaugcuacaggcacaucugcucuuuauagugaagauuggccccaggugucuauacugcucuccgccugggaacuggugaaagcagguauauuccuagcuauguaucucuagacuucacccugguuccugcuugauuuuuccaaagagaagauguuugccugcccagcuaucauaccagcauccugagauugaagaaagaagagugacaggaagagagauccaagacacaugaaucuacaaaugcaacaaucugcauccaucuacuacuauuauacucacugucuucucacaaaaacaaaacagaacgauaaaaccucaucacuuucuaaaauagccacacugucuugauaacucucuauuuuauuuuccuuucacaacagagaccauucuagggguagaauagugaguggauagugggauaaggcagcuuucaauucucuccaaagacuagaguuuaucacugaguaugugcauuuuuaagaagucaaaacuaacacuuagacaacuuaagacacagacauuuccccaccuaguaagcaauuaagcugagauucaaauuaaggucuaucagauucugacauccauuggccuugcaaauauauugcuauuaaagauaagcuuuaaaaaaaucuaggguugguuuauccauaggacaagcaaguaggcucuuuguaaagagacaugcuucuccuguucaugacuguaucuggaauuugggaaaaguggacuaaaagcaucagagcuuuuucuuuguuuuguuuuguuuucuucuuggagauaagcuaauacuaagaagaaaauaagaccuggcaucuuguuccaaugcauuuuuuuucuuaggcuacuuggaucucacagagugcuuuacaacauaagcagguugguaugggugacaauaauggggauuaaggugguaggaaggaggaauucugaaauaaggaaguuuuagaauuucauuuugaaaguugcugaagaaggauaaaaggucugaauuugaaaggaaaauugaaaagagcuugccuauugugggaaaaagauucuguaaaucucagccaaaagaguuuccgacgauguucauuaucuagaaaaaugagaauuuuaggggcguaauauuauuuaaaguuuucugcaaauauuauuauuagguuaccauccccucuguaguuugacuacaaugacuauaauuaccaccccacaaugcuuuacacuguccaaguccuccaaucacaagcagucacuucucaaaguaaaagauaauuucauuguuagcuuauaaagcuuaguuuuuugaauagcaguucuuagcauugugaugguaacauuucugccaagaguggugaaaagacaaauauuacuugcuuuuuccaguggccaaauccuaaagauuauucaagucaaagaaaaggagaaguugauaugaagccuccuggaaagccugugugguggauugauugcaguuauggccccagucugcucacagcucccugcagacacagcccuccccguaucuaguccucucacgcugacucccucacagcguggccaugugccuuguaccgcucaaucagacugcagcaaaugugauauaagcagagaccucugaaaagcaugugugcauuagacuuguucccuuguugcucuuggaacccugacaccaugugaacaagccaggcuggccugcuggaugaugaggugacacauuacccagcuguuucaaaauguagguuuuauuauauuuuucagguauguugaaaccaacagaucaggagacaauugccauugaaagauagacgcucuacucauugauccgagaggcaugccacauuauaggggccacacagggaacuaccaggguccaucaggaggaggcugacaaagugaggggagauugugggcaagagccuuuacuaugguuuccaugaaaagaaacacacaaagcagguauaagcagguuuaggaauggcuaguuugaauaguuucagcagacucuggggcauaagaacuguaccuaguugucuggucauuagagcaggugaaugaauaguggccuagagagugagagccagaugaaggagguaauugggacuaugggcucuacgauuguuaguuugcauaagaaaagcaugcucucuggugagcuguuuacuaucucuaggaauuagcuagccccaggaggggccgucccuccacagcaagagcucaagagaccaaagcauaaaaauaaaaauacacaaauaaaauagaaaauaaaaagacaugguuaauacauccgccaguccugucaccccaaccaaaagccagccaacuuccaccuaugugagugagggcaucuaggaccuaccaaauucaggccauucugccaauaccaccgaugcaucagcaagcacagcuaagaggagcugagguuuucccaggccagaagaagacacccaccaggaucaugagcaauauuaauggccauuaaguuugggaggguuugauauaugaaaauauaaacuauaucccaaguuuuaaagaauuaauauauucuucaaaauaaauucuggcaauguuuauauuuccacaucuggaaaaugaugauaguaauagaacauaccuaaaagugcugugaagauugaaugaaaucauagaauaauaaauguguuaguccauuugggcugauauaacaaaauuucauaaaccagguagcuuacaaacaacagauauuuauuucucacaggccuagaggcugaguaguccaagaucaagacaccugcagauuuggugucaggagaggguuaauuuucugguucauagagggcaccaucuugccuggguccucacaugguggagggagcaaaggagcucucuggagucucucuuauaaggucucuguccucaugacuuaaucaccuaccaaaaggcccaccuccuauuaccaucacuuugggggcugggauuucaacauaugaauuuugguagaacacaaauauuuggaccauggcaagaaguaaaacaguuagaacaauauaugcugcauagaacacuaagaauauguuucuacuauuauaacaauaauuuuuaaucuauaggguuucauuuuuauaaagaaauacaguaauaacuguauuagacacucaauaaagauuauuuugacauaauaaucaugugggauuuacuccuuuguuucuguuuguauauuuuaaaaaguauacuuuggaaagaauuuuuuguguuuucuuacccuuucuucagacaaaacggaggaaaauauacagauuaaacuguugucauaacuugucucauuuaauuuuacacuucucuuuugauaaguggauauuucaugccaagguacagaacuaaauaugugugaauuccaaucugauaguuauucaaggcaucauuagcauuucaaagaaaugucagaguaaauguccaauaggaagcaguucaaucucuuuuuauccaccuuugcuaugauuuuuaucaccuauauaucaccugauuaacaauaaaauccaaaauuucaugcuauggaaaaauuauagaaaacaaguuacuuuuuucuauuauagaguauaacuuuugucuauugggucauugcaucugauuuagaaaauaaaaauuuuuccuauuuuuaaggauaccggggcugauguugauauuaguagaaacugugaauuuauuucacaaauauguauaaaacguuuccuguauaucagguggcaaaguuucagcagugucaaaggcaauguccugccuucauggugccuacauuccagcagaaaagaugacuacaggcaaaucaagaaaugcuauaauuucugaugaugguaugugcugugaaaaaaauaaagcaaaguaaugagauagaaacgaaaggaagaugcuauaaggcaauuaggaaaugucuuucucaggagcugacauugagcagacauagaaaugacugugaaaguguaaaucauucaauguuuugggggaggauuauuucaaggcauaggaaagaagauaugaaaagucccuaaggcugguaagaacaguaagaaggccaguguggcuauaauagagugguaggggauuaguagaauggcugacgauugaaucagagaugcagguaggaauaggguuggggugauaugacuuauacuuuuagaagauaauugguauuucugaacaugacaacagcauaguguucuuuuuaaauuauucaccucaauucucauaaaaacaagacacggggauaguaaaagaauaaaaugagcacaugauagcaaaauaaaggaaaaacacuacaggugauaucuccaguaaagcuaaguauuaagaaguccccauggccccgaaacacagagggguguagccaaaucacaugacagcaguaggauccggaacugaaucagcagugaugcagcuauaguggugaagagaaagggaaauucaauggcaccuacaagccauggaacccagaaauugccaucagauacugauuucccaaaggagagggucuugugcuaagcaggagugugcaguaaaauuugagaacaacuagcagaacuuguacacaucuuguaacaagaccacaggaaguagcuuacucccuugagaauaucagaaaucuccaauaaaugcauacuuguaguaggcuacagauccacucugaagaaaaacuucugggagaagaauacaaauugcacagggugaaaacaccaaagaugugagggagaaaaacauuucauauaauggggcaguaggggccaggugcaguggcucacaccuguaaccccaacaguuugggaggccaaggcgagaggaucacuuaagcccaggaguuugagaccagccugggcaacauagcaagaccucaucuguacaaaaaguguuuaaaagaaauuuaagcaugauaaugagugccugugaguuccagcuacucaggagacugagaugggaggauugcuugagcccaggaguucaagucugcggugagcuuugaucaugccacugcacuuagucugggcaacagagugagaccuucucuagaaaaaaaaaaaaggcaguggggguggcaucaggcagauguccaguagagggagacuuugaauguaauagaauagcaaagcacaguguucagaugugagagcaccacuuuggaaggcaggcgcauggaacucaagaacacugagguaguagcaggaagccuuccugaaucaagcagagaaaaaccuguauuucuuaauacuucaucguaacugcaaaggagaaggcccuugagaugugaagggcucauggcuacuguggcucaucccugcucccauacaggaaucucuuccuaauccaugacaucccuucucauuaaacgugggaaacaaaaaaggauuuagauagagggcaauuuuaggaauaaaauaaauaaugacaguaauggauuauaacccacugaauaaaacagaaagacacgagcccauaaauaaacaaaugauuuaaaaguuugacuaggaaugggaauccuaaauaauuucaaauugccuccccacaaaauacuuauuaauuagaaagaggaaaaagagacacgcuacagugaagaaaucugggaggcccuaucuuaaucaaaugaucaaagugaacaauaucaguaauggaacaaaucaaaaucauauccagugugguaaagaugcaaugagaaaaaugcagaaucacuuuuggauuuuccugccaaagauguacaaccuaaaucuaauuauauaggaauaucagaaauaucagagaaauccaauuugugggccauucuacaaaauaauuggccuguaaucuucagaagugucaaggucaugaaagucaaagaaagucaaaugaacccuuccaggcugaagaaaacuaaggagacauuacaacuaaaugcaacgugugauccugaacuagauccuuugaucauaaacaauauuauuggguaaaccagcacaucuugaaggaggucugaggaauagaugcuagugauguauuaacuuucugauuugguugcacggugguucugugguuguguaagaauguacuugccuguagaacauauacacuaaauuaguaguuaucaaaguguaguccagggaugcuuggggucuccaagauuauuucagaaguuucaugaagucaaaacaauuuucagacuaacacuaagacauuauuugcccauuucacuuucauuaucucaugaguguacaguagaguuguucagaggcuacaugaugugucuuuucacaguggaaauaugugaugccucuuucuaucucagcuguaggaacuggcacgcuauuacuucuugacagaagaaagucauaugucuaaaccuaaaguaaauggagugaggauguaaauggccaccuaugcuacugcacugcaauguaccauggcagaagagagaguaaagaacugagaacaguaaucucaucuuaaaaauaauguuugcucuaaguuuuggguagaugcccuuuauuaaguuaaaugucuuaucuucuaagguugcugagaauuuuaauugugacuagauauugaguuuauaaagaauguuuuucugcaucuguucaguuauguaauuuuucuccuuuacucuguuagugugaaugacauuuguacauucucuaauguuaaacauuagauauuaaugggauaccaacaggauaaacucaguguggucauaaugaacuuucuuuuuggcauccugcuagauuugguuuguuaguacuuugggaucuuuccaucuauguucaugaaagaaauaggccuuugguuuuaccuuuuuuauucugucuaguuuuuacaugauuacucaccucacagaaauaguuggggaaaauuuccauuucccuagaagaguuuauauaagauuggaacgauauguuucuugaaagccuuuauauuuacuuuaccuuuaaaaucaucuagacucaacauauucuuuguggaaagauuucaaauuauucauuaaauuuauuuaguauagaacuaucuggagucucuauaccuuuuugaaguuuuuuaaaguuuuaauuaucuagaauuugucuaauuuuucucaguauuaaaauucacugguacaaaauuauucauucuucuuucuuaacuuugaaugguuuuuuguaucuguagauuuacccccuuuucuuuccuaauagguuuauuugugccuuuuuaucuugaucauuuugacuggaaagugcauccauuuuuuuagugucaccaaugauuccauuucuggcuuugugaauuaauauuacauauuuguuuucuauuucauucauuucuguccuuuacuauuuucuuucuaugccuuuucuggauuuauucuauuauuucuuauaaaauuucuuaagcuggcauuuaccucauuagucuucagcguuucuucuuuucuaauauaugcauuuaaaauuucuaaguuccacuuuaugcugcauucaucacauuugauauuuagcauuuauauuuuuguuuaacuuuaaagguuuuuaaguuaguauuauggcaucuccuuuaacucauuucucaugacuuauuuagaaacguguauuuaaauucauaaauauauggggauauauaugggaaucuuaauuuaacuuaauugaauuauuuuuagaaaauauaguguguaugaauaugagucuuugacauguugaaacuugcuuauagucaagaucacuuuuugugacuguuucaugagaauuacauguauucuccaauuguugaauacaaagcucuuugcauuaugucagauuaaauuuauuaauggaacucuuaaacucuuccauugagugagguguguugaaaccuaauuuuagcagacuuauguuuuuuccuaugaaauauauguauauuauaucuggccaacauggugaaacccugucuauacuaaaaauacaaaaaucaacuggcugugguggugcgugccuauaauccuagcuacucgagagguugaagcaggagaaucgcuugaaccagggaguuggagguugcagugugccgaguucgugucacugcacuccagccugggugacggagugaaacuccaucucaaaaaaaaaaaagaaaaaaaaaagaaaaaagucuaaaguuaaauaauaccuuauccacuuccuuccuaaacaauuuaaaaacuuuagagcauuuuacauucaauuacuucuucuauaauaaauauuguugucaguguuuuaauuauuuuguuagcuuuacaaaucagguguuauuauuuuauucagaccauuuuuaaauuucaauugguuuacauguuugccauuuuauuuacucacaauucguuccucagaauggccugagaucauuuuccuucuuaaaguuauucuuuagaauuuccuuuuauacaggucucugguggucaaugcucuaguuuucaacugugaauaucuuucuauuuuacucucauuuauuuaaaauucauaauuuuagguugauaguuauuuucucucacaguuugaagaaauuauuccacuuuuuuguggcuuucaucuuuccuuguuaauucugcuauaaugauaccugucuuucuugugggugauccauccuuucucuccaccugguuugaaaaucucuguauuuuucaauuucacaauaaugugucucacuauggauuucuguuuauuuauccugcuuggaauacagugugcuuucuggaccugugaauccauauuuuuaucaguuuggaaaaaaaucagccauuauccaucaaaaaauguccucuccuacauuuuuuaaaaaaauuauuucaucccggccgggugcaguggcucaugccguaaucccagcacuuugggaggcugagacggguggaucacgaggucaggagaucgagaccauccuggcuaacacugugaaacccggucucuacuaaaaauacaaaaaauuagccuggcauuguggcgggcgccuguagucccagcuacuccggaggcugaggcaggagaauggcgugaacccgggaggcggagcuugcagugagccgagauggugccacugcacuccagccggggcaacacagcgagacuccgucucaaaaaaaaaaaaauuauuucaucccgagucucugauucaaaguuaaucuucugauuccauacuucauaucucuucauaccuuccaaauuuucugccucuuugccccucugugauacauuuuggggaauuuuuuucaaauguauccuucaguucaucaauuuucucuucuucugugcauaaucugcuauuuagccuauucauuuaggauuuuaaaaguaaucucaaguauuaaauuuuucauaucugaaaaugccauuuauuuuucaaauuuuccuacuauuauagucaccauuuuuuacucauuuuaaugauaaggcauauuauuuauuuaaauauuuuguuuauauauagugguucuauuucuuguuuccuauuuccaguaauaauaucuauagucauugagcgcuaaauaugucuguguuauuuuuguugauaucuacuuauagugguuugcuuuucaagguauuuagaaauaauuuauuauuaacuuuauuacuugauuuuaaucuauggaagcuugucaaucucaucagggaagguuuucugcagagagaaaaccuugugcuucccugagcuguguugacucagccuuccagccuuccagcugagccagggaacagugucccaaauagcaacacuauuauucccaucugcacucagaacaacaacagcccuccucucuucuaucagauguuuuuagagagcaagagugacuggagcaggcaaugucucaagaacaugucuuauucagaauauauuuguucugcugcagaaagaucucucagaguaccuagacugacauaauacuuugaagcauaauauuuuuauuuaaaaauguacauuugugacaauuucacuucaaaaaaaccacaguuuauuaggaaucaaaaguuuuuaacgugacucuuuaaaugauuuguacccuacuacauagguaggguuaauaauaaauugccuugcucugcauguuuuugucuuguaauguaugauguaauauauaaucaauaaauuauccugagaauuguauaaacgaagaacaagcuuauuuuaauuaauuauggccucaaauaaagcaaauccuuuuaaaauaagaucccccuaaaaaguauauuuauaaagaacacaaaagaaacuaagggagguuugguauuuugaaagaauuccaaguagucuaugaucuucauuuaaaaaaaaaagcaugcaaaauaaucauagaguguguuuuguacauaaauccuggaucaacuugauuugacuaaagauagcaaggagcuaaacuuuaauaauauauacugucaacuugucucaacaagcuuuuaaaggagugcuggguuuuagaaauauuagggagaaauauuauccacuuguuuuuuuuuuuuuuuuuuacuuauaauguaaacuuaugugaugagcuaguacauucauuuuuuuccaaauauugagaaaauauuuuccaguucacuuuccaggucaccuucacauugagauagaagugugagucaaacaaguaacaaugagccacagaggaaacuauguagaacugacauucccuuaauuccccaauguaaaaaaaucaauuauaguuuccaaacauacaagaaauuaauuuaagcaaacuccaauuuucuggaaaggaauuuauuucaaaaauuacaaagaccaagauuccauacuagguaaggggaaccaccaauagauauugugugccuucuauguccaaggucauucuaucucauuuaauccucacaaaagucucugaaguagguauuauggcauuugcacugaugaagaauuagauagcuagugaacagaggagcccguaugagauauaaaucuggcuaaugcaaagccggcuuuuuuccgauacaucacgacgcuuugugucggauuacccuagaaccuccuauggcaucaguacaaugcaccauccacuggaguguccuauccaaguagcacuggagcuugaaaaccacccagugggccucuuuccagguaucaguagugaucuuuggguauuuauucugauugcacaauuagcccaaagauugcugguauguuuagaugcugaaugguguuagauagagcauguaauaaaauucccucuucuaagcaacuuaagaccggcagcugccuuucugaaaagccacccagguaagcucuguuguuuccuggucuauuagcccuacacucugccaaacucagcauuuacugcggaagccagagaaugcugacauucugacagcucuuggacagcagaccaugcuguuugacucugauuucaaacauuuauaaucuuuucucuuguucccuuugcucaauacaggagagaggcuaucagccaauuuccccaccguuuauagcaaaucccaaggcucccucauuuccagcugcuaagcugccugggcagacuguauuacuaaauuauuguaucuuuuugguagagugccugaucugucuuggcaugcgcuuugcauugaaagaagcuccuguugcaagcaaaggaagccagcgacauucacccuucccacacgucuuuccucuguuacccucaaccacuaacuucuuuguuucccauguauaagccaaguucacaggggcaguuucucagcuaucucugccucccuagggaguuaaggauuucaaagagaguucugugcuaggaguauuucccauagccuagagccagaugaauaaauggcgucuagugaauaacuacaucagaaccaagagguuuuguuucucucuuaccaaaauguauuucuuuguaauaccacagucacuguaaccauguauuuuccucaucagaagagacuguauugggggaagagaggaaauagccucuuuaacucaagucgguuguuuucaagaguguugguccuuugguuuaacuuauuuuaauaacuucccauuuauauacuaucccaauggauuaugaaugugaaaaaagaacuauucugaagaaauaaaacaaaaaaagaucuacgaucuuuaaauaaaaaagaaagugauuuuguaauauaaaagggacagaaacuauuuuuaauuacucuaaaaugaauaaccacuccgauucaauuuucaaaaguuauaccuugaauuugaauucaaagucacccaaauguccucaguaaaagcucugagaaugcagugcauucaaauguauccugugaguuuucuauuccuguaagcaaugaacagccuagauuuuucucauacguaucucaagagauacuucauuucaaaagagcaggagaguuaucaaaaguguaauacuauuaacaagauacaccauagaaaauauacagaaacguuaaagauaaauuauaucuagggaguauguuuuaaaucaacuuugcuguugcuaugguaagagauauccaauguaaaacaaaaauccucuauaaggcuuuggugcuauagccauggcaacaaugauguucaacucugcgaguguuuccaucugauucagagagaagaaaaaaauaugcuuuaaauguauguaaaauggcuuagaaaaucgaucauuuaugguuaucuuucacaugacccuucaaccaauuaaagaagacauuguaaagauagcagccagagagccuaaacaaaaggcucauagauuugcuuggguuuuucaugaucacagaagcuggaaagauccacuuuagcugagguguugguaaaugacauauucauuuagcaacuaucucacagaaauuuucagguuggggccucauguaauuuuccaugcauaggaaaaaacuaaaugcaaucaaaugacaauuucuaccucuuuaacacaggaagagaaauauuaaccuaaaguaagaaaauauggaaagugguguucuagcucugcaaaagaaaagucucuuaaaugcuagucucuuaaaucuacuccaaauaggcuuuuauuccaccuaccuccaccgaauagcccuuaacaauaucagcaaaaucucuaccuuccugaaaugaacauucauaacucucaucuuacuugaccuaccagcuauacaauugauacagauuaucaccucuuggaugaaacacuuucauuaacucccaagguaccacacucuucugguuuucauccuaccuccuaggcuguuccuucucauucucugcucauuccuucuguuuccaaauguggaagcauucaagugcuccagggcuuggcauacugggaccucuuuccuguuuacauuuucuguuuacauuaauuccuuugcuggccccaggguuuaacauauuacugaaacaacugcaacacccaaguuucuguuuucaaccugacuucucccccacacuccagacuuguauauccuacugucuuaguuauccuuaugccuccuuuucucucacaccccacagccaaucacacagcgaauccugguggcucuaccuuuaaaauauaacugcaaccugccuaugccucacuuguccuuuucucccuggauuauuguagcagccuccuaaccaucuccuagcuuucauuuuugcaccucacaggcaauucucaacauagaagucagaguuaucuuaguaaaacuaaggcaaaucaugucacuccucugcucaaaacucuucaauggcaccuugauccacucugaguaaaagccaggauccuuacaauaaccugugaggccauacgugaucucagaccuguggauacucugccccaauucucuuaaauaacauaagcuccuacuacacuccuuuucccuuaacugacauccagcuauauugccucuugcuguuacuccaaugcauuaggcauucuucugggucaugaccuuuguacuuguuuuuucugccugggauuuucuucccuuaggaaguagccccuccuccaacaccuucuucaaauaucuauuccuaacgaaaccuuacuucauaauuuuuucaauaaggccuccauggaucacaccauuuuaaauggcaaccacuaauucuuauucccuucccugcuuuauaguuucuccacgacaccuauaaauauaaaaaaauauauauuuuacuuacuuaugcuaucuuaggaggagagacauuuuugucccuaucauuucauugcuauauccagaaauuagaacaaaggcuggaacauaguggauaaucaauaaacauucuuugacugauggggugaaauaaauauauagauauuugcaugugaagaaaaauucaagagugauaucaacauagcuaaauguuaacagugauuaacaauaagugacuuuaaaauaaaauaaccuuuuauucuguuuauaaaauaauaucuguucauucuaguuauuaguaaaaguaaagagagaagaaagacacucauaauuccaacaccuaacaaaaguuacuauuaacauuuuuauauuuuuucuuuuguuuuuuauggacauuauuuucccccaaugaaaauaagaucacucuguuuauguaauuaaaaaaaauuuaaaucucaccuaaaaaauugagacauguuuauuuuauuugucuaaaaauuuauugucuaaaaaauugagacauguuuauuuguaucauaucaauccuugaaauauucaaauaacugauacauuugauuuuguuucucucuuuuuauaaaguacauuuggucuuuuauagugacuaggggaaugugugugugugugugaguuuuuguuagucauuacuuuuauguuaccgaaaucaucuucggaccuguuuucucuguuuucaucaguaaauuuuuguuucucucuuuauaaguuaauagcuaauauuacugagugcuuauagguguuaaguacuucagaugcauuaucugauuucauucccacacaauguucccucacauaauaccccauaauacucugggguauuaugguauucccauuucguaggugaggaguugaaugcuuagauguuaaguaaccaaucaggguuacaggguuacuaaguaguggagaagcacaugaacaagguacccaugcuccuuacuguuaaaucauuugcaguucuaaaaugagggaauuagcagacuuguuaucucuguuccccugacuccccacucaugcccacgccccguuuuccaauuuauauuaaaauagucuggguuguaaagugcugauacuauauuacuguauauuuuauaccuucucuuuucaauuucuuuuagauuuauaguguuacaacaauauugagaacaauuaguugaaaacauuuuaugucuuacaagcuuuauuuuacauucuagaauccuuuaugcuacuauuucccuugcccauucuugagaauuuauuuaucacuugaucaacugaaguauaucuuugagcaauuacuucaaagagauagguuguuuucuaaauuacugauaugguuuggcucugugucccuacccaaaucuuaucucgaauuguaauccccacuugauuggaucaugggggugguuucccccaugcuguucucaugacagugagugaguucucaugagauaugacgguuuuauaagugcuugacaguuccuccuacacacacacucacucucucuugccugccgccaugaaagacaugcuugcuuccccuucuguuauggugauuaaguuuccugaggccucccuagucacgugaaacgugagucaacuaaaccucuuuucuuuauaaguuacccagucuuggguaguaucuuuauaucagugugagaauggacuaauacaauuacauaucugaaaaugacuuacuauggucuugcacaccuuggcugggcauacaauucuugaaucucaaguucaaauccauugcccuaaaaauucuauauacaauuccccauugucuucuguaaguaaucuguuuuauuaccuuaauaucuaucuagauucuuauaugacuuuuuccuuauccuugaaauuauaaaaauuuaaaauucccuucuaaaauuauuuauuucagaaauuuugcuaaauucaguaaaucuguaauuuauuauucuaggcauucuuuagcucauaaacaaacaaugagaguuuucuuuuauugaugcuuuacuucacugcuacacuuuucguucuaaaauuccuaucauaugcauauuggaucucauggaucuuuccccuguguuuuaucuuuucucuuguaauuuuuauuuauacauuucuucugucuauuaaaugucuuaauauucuacuuuacugacuuggguuucucaugauccaguguauuuuuugccuucuuuacaguuuugaauuugauaugaauauuauucaaccacaugaagcguuuaugaucuuacaguuuuaacccuucaugacugcuuagucugguuucaugcagcguuagucuacugaauaucauugagauccauuugacguuagcauuuuggaaaaugcucuuuucuuaagaaaaauuuuacgucaaaggaugccacuguuuucauuccucaaaacgagccuucucuuuugagguaucauuuaaugucuccagcucuuucucuauuugcucacuguugcaaaggguggucuuagcuugucucuuuuggggaccugggaugaguucugucagggacuuaggaaauucuccuuuucaccuuuaggauucaaaagagagaagaaaggaaaagcuuagguuaacugccaguucugccauauugcacaacucuaggguccuucauucacauaguacaaaugugccuccugcaauuguggcuggugguggccauguucaccgcaguuuuacuucauuggccuaguguagggcuguucaguagaauuuucuaugaugagggaaauguucuauaucugugcuggccaauaugguaaccacuaaccacacaugauuacugugcacuugacauguagcugguccaaaucaauaauuuaauuuuaaauucauuuaauuuuauuaacuuaaauuuuacuuuaaauagucacauguaguaguggcuacuguaaaggacaguacaggucuauagcagugguucucauaguguggaccccagaacagcagcauuagcaucuccugaacacuuauuagaaaugaaaauucuuaggccuugcucuagaauaucugggggugggccccagaaaccuauacuuuuacaaacuguccacuugauucucacuagaaaugcauauucuuaggccucacuucagaauaccuggggaugggcccagcaaucuauauuuuuacaaacucuccacuugauucuuaccauuaaugcacauucuuaggcccugcucuagaacaucuuggggugggcccagcaaucucuguuuuagcagauccuccaugugauucugaugcacauuaagagaugagaaccacugcucuacugaucacgaguuaggagaggaucagaacuaacagcagucacaaaagggacuuuuuucucuauuccaguguuucuuuucuauauuugaggugagcugcuaggaguuaacuggggcaguguccucauucuucgcuucucacaguuguccucauuaagaaccaacugugacaauguuccccucaguguaagugaagaguaagcaagucaugauccuugcuuuccagugggacuggcaggauccaaugguaccuccucacugcccccauguauuucuuuacuucgugcuuuaaccuucuaaagucuucuccaguuacuaccauggagaguucuucacauacggggaauuauauaucuucaguccaguucagucuucaauccacuucacuuugccuucuaucuugcaagaacucuugaaauaaucagcauguagaugucacccauuauuaacuucccauacuaauacagauauuuuucuuccuuacuuuuauaucuguuggucauuuccaagguaauacagaaaggagugaacuagaaaaaugcuuucagucuucugcuuuuccaagaaaucuuccaucuuucucuuaaugccuuaccuuauaugaaauauuaaaaguuuuucauauaauucuauaguguuuuauauguaucauuucaucuaauuaccaaaacauuccagugacauagguuuuauuacugucauuuuccagacaaggagacugaggcuuacaugguuuaagugagcuauauaagaggaauggguagagcaucugcuuuguaagggucucugauaugcagaaaaugauggcuaacauuuauuggaucuuuauuacggaccaagcauugugauaaguguuuuuuauccauuaucuuauuuaaggcuuauaaaaauuuccauuuuacagauaaugagcaacacuagaaagguuaaauaacuugucuaauuacacaacugguuaguaaaacugcccauuuccaugcccugguuugucugacucuagagguugugcucuuaccggcuaugcuguauugguuucuuggccuggaaaguaaucaaauggcaugggcagaguaaagaguauaacauuucggaggguguccuuacaucucaucauuuaucacacaguggguuauuuaauuuauuuuccauaccacuaccaagucuacagucacggguuuaaggguuaauagaaacccauuaaucucugguaauuuuaauauuuugcuuauuuuuucuuacucugaauggaaucccuaaaaccauaugaguccuaacuuuuaucuccauucauucuaaauauuuacugcacaacuacugcaugccagacacuaagcgaggugcuguguucuugauguuugcuagguagcugagcaauagucccugucaaaacguuuggugaauugccugguuuacuguuaaacucuccucccagucugccuuuguuaugaauaugauuauggauucacugaaaacuucacuugaacuuuaaguaucauaagaguauuuggaacaaauaggcaccuugauugcaacuccaaggaguucuguggcuuccuugcugcaaauuuaaaagagagaacuccaucuccaaaucagugacauucagacaugugcaucacuauaaaggacaagggucaacucaccauccagacuaguuugacaggaacaauucagagaugaaagagcugcuuucaauugcucaagcaaugaauuuuccauacaaugcaccuuuccagagucaugaucaaaggaauccuugcugaagccugacucacaacacagggaaauaauuuuaugccuaauuuuuuuucucuccugacucucucucucucucucuugcuacagauaugucaguacuaauuuaguuccucuuauaaaauagaauuaaaauaucuuacauuuuuggagccuguuauuguuuauaaaauauauacauuuccaagguguaauuaaauauaauaggauaaucugugaggcagguacuauuucccccaguuugccaauaagaaaauaaagauuauuuggcuguacauucauucauucauucauucauuuauucaaucuuccaacaaacauguaucacacugaggcacuagagugacaaaaauuaaucaaacaagguccauuaucuugaacagcuuauaguuauaaaacauacaaccagacauauuauaacauguguuuuuaaagaaguuuugugagcuucagaggaagacaaaauaaaaucuuuccagaaaaagauggagccuuggaggacagguaggacuuagauaugcagaaaugagugaggugcauuccaagcacaggaagcaugcacaagcaaagauauggagcucggaaaguacagacggcacaagaaaacugaguuguuuuguauguaugauugcugaaagaagacaugaagggagaauggugaaaaauaagguugcaaagguagguuauaauguuugagggauauaaguaaucuaaccaaaguaaucagcauaagugggacucaaacccaaauuuuacucugcaguuggagcucuuaccuugcuagugcuauauuccaaacuucuuaacacaguauauagcucaaucaacuugaaaaaauagauacaggacuaucaagagaacucaacucguuuuugaaagccaucuauaucauucuuucauuuaagaacugggagauguauauuuuaaggcaacugaugcacaaacucuauagacagcgaucucaguaucugucauauuaaaaguaacuguguuuuucugaacacuacuagaauucagagcagaaauaugaguccccuugaaaaaggggacaggaagcccuaaguuguuaagcaguugcuuauaccuggauagaucuuguucacuuuauuguaaauggaagugggaaucuugguugagugaaaaucagaccggcuaaguucucaguuccaucaauguuuaaggcaugcaagugguuuggcuguuaugccuaugucaccuuggccucuucuaugagggccacaacacagaguucaccccuuguaauuuuuguccccaguggguauucacugccugacucagaacuuugaaaaguuggagacaaagguaaugggcauaaaaugacccccaacuccaacacauacacaugcugguagugauauaaagaaauguaauaggaaagcauaauuuccuuuuuuauucuaaauuaaaaaacaaucacuuuccuguuuuaugcuauagcugacacaaguaguagaaaaauuuggaagcacaaacugcaacaauaugacagucaagggcauggacucacugaugauaaaaagaaaggaggguuuacauuuccaaauauucuccacuucuguuaucuuuuuauuagggaacgccauuugagacaauaaguucugucucuggaauaaaaucuaacauggaaagcaaaaugaaauuuauacuccuuauuaauucauugugcauaaaaucaggugucauugguuguauuguguaacggcuugcugaaaaucauuacaaauacacacagcacaauucuaguauuacuuuaaaaucagcuuccccuugaaaacaaaauccggauauuuuuuauaaaaauacauucucuaauucuuaucugggaaauggcuccuaaaugaacagaugauaccuuugcaauuugaaguuaagagcugcuuauuugucacuaaggcaguuaguuuugacuaugcaguuuucguuuuauaucaagcaaauacauuuuuuuauuuuccuguuuuaaauauuauuuucaugguuacauuuauuuagagaaaauuaucuaugguuuacacauaaaagacaagcaucaauugagcaaauuauggcauuuauaauuaaaugcuucuuguaugcagucuccaacacugcuaaaggaagccaucacucuaacaaaauauugaauauguuuagcauaaaauugcauuaaacagacccucagaauucuuauuaauuuauuugggaugaaauaagcagauuuuuuuuuuuuuuggucacacguuuucauguaaauucaccaauucaaaagacuugcuuauuauucuuauuugagacggagucucacucuguugcucaggcuggagugcaguagcgcaaucucggcucacugcaagcuccgcgucccggguucacgccauucuccugccucagccuccagaguagcugggaccacaggcgcccgccaccacgcccggcuaauuuuuuguauuuuuuaguagagacaggguuucaccuuguuagccaggauggucucgaucuccugaccucgugaucugcccgccuccaccuuccaaagugcugggauuacaggcgugagccacugcacccggccgacuugcucauuauuuuuaaaagcauauuuuacaugagugauaccgggguacuugauaacugacugagccauuguuccauuugaaauaaaaauauggagacauuucaggugagaauuuuuggcauuaaaccaaagaaugaugaauaguacauuuuucaaaaaagauagcaacaauauuaaaaaauuuaacaaacagagucccuugauuaacagagacuggagugaaagugaggugagacugugugaaacucacaaaaggccccaguuagguugaucagugggguuccaagacauaacuuugaaauuaggcaauccuugacucuuccuucucucuuaccuagucaguaucucagcccaucggauuuuaucuccuuuucuaaaauugaaaugcuuugcucuuucuuacucagacuuuuccuuuucucauuaugagagcucagcucaaauaucaccuccucagagaggccuauucugaucccuaauuuaaaguaaucauccucuuagcccucaccccaccuacuacucacugccuccuaccuccuccagucauuccuaucuaauguaucaucuuccuauuuuauuuaccugagguuacuuauauuuguuuucuugcuuauuuucugucccucccacuagaauguaagauuuauggagguaaggacauuccauguuaacuguugaaucccuagugcccaaacucuguggcaaguauuugaaauaacaccuauccacaguguccuaauucagguccuuauaauauccugucuggguaccuguaagaguucccuggaugguuuccuuaauaucagccucaucuuccucaacccauuuuuugcacuagagcuggauuguucucuguaauucaaaucuaaugaugucacuccauuacacaaagcucuucauugguucuucacuuuccaaaugaauauugucgaaccauacagaguggugugcaguaucacuuuaaguaguucaaaaaagaauauuuuaauuuaauaguuuuuaaaauuuauuuuaauaugcguuaaaacaaaccaucaauuagcacauuaacgauuucacagaucuuauuacugaagaugagaaaaaauaaaaguuauaauccauuuacagacauggaaaaauuaaugaaugugucuuuaaaagaguuuugaaugugaucagagacuaaucuaaaggauaaagcccaaugccuucucuucaguuucacagagucccugccuaucucucuggcauaacauucacuacuucuugccuugcgcuuuauaucuuggcaaauucaaauuauuugcagcuccgccaauucaucacauucuuuauggccucucucuuuuuaguucaguuaucuccugugccuagaaugccuuugguuggcugcuuucucccuguuuacugucacaugguuagcucuucucauucugugacucagcucaugaaucaccaacuucaugaagccuuuguuguuuguuuguuucucuuuccucagguuugguuagguacuacuucuuuguucucccuuaacauucuguaaaaacguuuuguuuauaccuacugcauugaaaaauaacuauuugugcauaucuauccuucaagugaaauauuccuaagauuagggauaauguuuucuuuacauuaguaucccuagcuucuauuauaggaccuauucugaauaggugcucaguuaaaauaauuaguuaagagaaggggccauaacaucaauaauuaaaaaguuaaauuaaaaaguuguucacccacaguaugagacacaucauauauuuauucagucaguagucagucaauaaacuauauauauauauauauauauauauauauauuuacuaaauguuaaaaaguaugggcacuuaaaacuaguuugucgaagagauaaaugaaaaggucuuagcaacauggcauaguaggaccuguugguggggaagaaggaugaaccaagacuggagugaaggaaggauuggguaauagcuggagguaacaguugauuuuauugauuauaaauguuacaucucaucagagaugguaccacaguccauacuuaccaaaucaaaggugcaugugggaaugagaauugguggugcuaauagaauacaugucagugaaacuuucagauaucagauguucuguuuuuugucuuucaguugggagauggaaucagugauuaucaauguucaccugauaacaccgcaaaaggggccagggcaaacugcuaguaggaacugugcagagacccuaguaugaaaaaauuuauucaauaaacagugucuucuauggaccaaacacuguggauauagagaugauuccaguaugauauuauuaugguuuauaaugaccauaagugauugcuauaaaagaagggaacuguugucgagcuucagagcuaacccagggauuacaucuuuguuagacauaauagauuaaggccaugugacuagaacacucuuuucagaaaacuuuguuagugcuugagaaauaacauuaaaauccaagcaaaagacaauucugggaaaaugaugaaguaggaagcaccagaaaucuaucucccugcuuagacaauaauugcucuagcagaaucugucuacuauaacuauuuuggaacucuggaguauaaugaagacuugaagcguccaggagaaggauaauugggauauccaucauguuaaacauuuauccugauuugaccaauacacacuguacacagguaucaaaauauuacauguagccccaaaauauguacagcuauuauauauccauuaaaaauguuaaaaauaaaauuugaaguaaagaauuaaguaauuuccuuugcuucacuaauuagcagaaaauuugaacauaacauacauuuugggaguuuggauuauaaucauuuuuaaggauaaaaccuauaaaucccuuucuucucuagaccauuugagagacuuuuuauaaaaagcaucauuugaagauaugcuuuuauuuuuuucuuauaaagcuucaauaaucucuugaaguuguucauacacuucuacaaugcauuugcuauuccacugauuauugugcagugcuauuacugacccuaccaauaucucuggaucaugcuacauuuggagaauaauauucucccauauauccaacaugcaguggugggacaggcauaggauaaccucuacagauaguugcaaucaaaaggagggaaaauggaaguugagcaaguuacuggucuguagacauucugaaauccaguugggugcagauugcauuucuugaguagggcuccaucuuauuggaguuguucacuauuguucuuaguucuacuuucuggguuuuuguuuccucccucugaaugauccuacuuuucauauaagaaacauucuuaugccugcuuucuguucauaaaagcucaggggcccaaaggucucuuaauauauuguacuuucucugucccuucuauuccaagcuagggaugcuuccaccagaauaauuaucuaaaaacauugugggauuuguguuuacuaauugacaauucgcacaauuagauaaaugucauauccacaaaucuuucugacauaagucuuugucuaccuugaguucccuguaagacuguuguaugacucucuacaauccuguccaacccacggcccaugggcugcaugcuuugaaugugacccaacacaaauuugcaaacguucuuaaaacauuaucagauucuuuuuuuuuuuuugcgauuuuuuuuuuuuuuuuuuuugagacggagucuugcucugacacccaggcuggagugcaguggcacaaucucggcucacuggaaccuccaccccuccagguuuaagcaauucucugccugagccuccggaguagcugggauuacaggcgcgugccaccacacccggcuaauuuuuuguauuuuuuguauuuuuaguagagacggaguuucaccaucuuggccaggcuggucuugaacuccugaccucauaauccaccugccucggccucccaaagugcugggauuacagguguaagccacggcacccggccuuuuuugugauuuuuuuaaagcuaaucagcuauuguuaguguauuuuaugcauggccugagacaauucuuuguccaaugugucccagggaagccaaaagauuggacauugcugcucugcaaugcccuuagauucucagaacccuuauuuuuuagggcggaggagacucaaggcaugcccuuaaggucuuaggucuucugucaucugaaaguuucuaugagucacuauauuugaucuuuugagggcuuaauaaggaguuuuguaagcauacccagggauuacaccuuagacuuuacuucccugauagcgcucuggauuugaacucugacccagagcuauuuauuaauuuuaguuucauuugacaucuggagagacuaagaacaaaaaccacuuuuuuuuuguacaaauaaucuugcccccuuuguaaugaacagucuguucuuuuacuuaucucuguuuucucacauuuugucaucuaacaagaagaagacagguggcacuuucaauaaucugccuggaaaucuuagauugucauuagauacuuuuacuauuuuccauguuauugcaaccaacagaauugccagacauucugccaccauauuacaaaagucuccuuuccuccagcuuccaaucacauuuuccauacuuuccuuuaagcucccagggacgaucuacccagcgcuucugcuaacaccugccuuuuuagucuuuccccaacauucuucaugaagcacuuucacuaacacuuuuucaaugcccuuuuaguuucugccugcuacuugguucaaaaccuacaccauauguuauaggauacuauaauaugacaugauaauagcaucauauuuccagguauuaaaauuuguucuaguccucuauuguuacauaaaauaguaucuuaaaaaugcaguuucaguaagacaguggaugggacuggggucaaugcaaagguuuucucacucacauguuuggugguuaaugcuggcuuucaaaugagacuuuacuuggguuguuagccagaacaguacacaggacuucuccacauggcuauugugcuuccuuaaagcaugguggcuggguucuaagagugagauuuccaaaggaccaggcaaaaucuacauugccuccuaugacccuagucuugaaggucacuuuuuaauaauuguuuuuauuuuaaaauuuuuguggguagauaguagguguauguauuaauggaguaaaugaaacauugugauacagccauauaaugcauaauaaucccagaaggauaaaugguguauccaucauaucaaguauuuauccauucuuuguuuuauaaacaauuuaauucuaccuuuuuaguuauuuuaaaauguacgauaaauuaauguugacuaucgucacccuguugugcuaucaaauacuagauucuauucauugcaucuaacuacuuuuuguaccuauuaaccacccccuguccccacuauccuucccagccucugauaaccuucauuuuacucucuaucuucaugaguucaauuguuuugauguuuagcucuacaaauaagugagaacaugcaaaguuugucuuucuaugccugucuuauuucacuuaacauaacauccuccaguuccaucuguguuguugcaaaugacaggaucucauuccuuuuuauggcuuaauaguacucuauugugcauaugcaccacauuuuguuuauucauuuguuuguugauggacacuuagguuguuuccaaaucuuggcuauugugaauagugcugcaacgaacaugggagugcauuuaucucuucaguauacuucuuuugggguauauaccuggccacuuagugucacuugugccauagucacuggcuauaccauauucaaacauaaauauaaaucucaccucuugauggaaaaaugucauuaucauuuuguaaggaaaauguauagauggaaagauguuauuguggucauccaaaauacaaucugucacagucugugauagcuaaccugcuaaauucaucuucagucucaauuuuccauuaaaagaaaagaaaugauuuugagugacacuagcucccagugucagcaauuuaaaaauuaaaaugaacuugaugaugcuucccugagaaugccagaaguaguaaauuaagaaguaaacuuuucaagagaaaaaacuguccuggaucuaaaagaguaggaauacagacaacaauacucccuaugccagaauaauuuagcaugcuuacucuguuagauuuuacugaguccuuacuuagcagacaaaggaugagguuuauuacuuuuugaugaaugagaguugaguuagagaagcucugggugaauauuucaucucacuagacgguuugggacauuaaauuuugggcauuaaauuauguccccaucuccucccgaaauucaaaugcugaagcucuaacuccuaguagcuuagugacuguauuuggauauaggcccuuuaaagugauguauuuggauauaggcccuuuaaagugaugauuaaaguaaaaugaugcuguuaugaugggccccaauucaguauuacugauguccuuauaaaaauaggaaauuuggacaugcugagagacacuugagauguguuuacacagaguggagggccaccaugugaggaggaagcaagagggugagcaucucucucaccuauaaggagagagacuucaaaagaagccaacccugcugcaaccuugauuuuggacuuccagccuccagaacugugagaaaauacauuucuacuguuuaagccacccagucugugauauuuuguuauggcagcccuaguaaaaguauacaccauuuuuaaaguaaggauaauaaaaccuucuucugacgauggaaucagacauuuaaaaaacaucacacugugccugccauuuuauagguagcagaugaagaaaucacccuuucuguaauaagauugugcuacauaucagucaguagagaaaggugaaggcucaacaaauauggaggcccuuuaauagucuuguaauauuuuacuucucuggauguuacaugaucucuguauaguuccuuaauauuuuauuagauaaacacugugaccccuuuuugaagucaccuaacuuacgucuacauuccccuuucuugccgaauaucacuaggucccuucuccccuaccugucaugagggcuuacuuccuaaccugaugaucacagagcaguucuugaaaggagucuugagauaccuucaaguacaaaagagaacuuguuauuuugauguauuaaaaaacugagacgugauagucuccaggugccaucugauaagcacucccccucauccauuccuaucugccauguaguucuuaguaaaugacaaagucuuauuuuaaaaugugacuguguuuauuucccacugaguacccaaugaaaggaagaucaccccuauuuacccuuaccaugaauuaaaagcaaaaacaaaaucacuggauuccuccacaggccauguaagaaucauguuaucaaagcuacuuuggugccacaucgaaaaauggcagcugagaauccaaggaaauauugauuuuaccagcagaaaagggucugugaaaauuaaaaagaauauuguuuauuggagagaaauauaaaauaauaaaauaggaggcucuaaagcuauguguacacaugaaauguugaagauagaaccaaagaugcacuuguggguuaguaaagaguucuucccuuuacuucugaggcucgcccaguucuacagaaguccuugaguccucgguacuguucaguaguuugggaagcaaaacugaacccuaugcagucaagaucugguucaagauaguaugugcuuuugaacugguaugagucacuaacuggugcugagucuuaagggaacucagagaaaaagguaaguucuugaucacuguaagguugaauacacauuuaugggguggaacagaccagaccauugugaaguauugccccauagacuauuccugaauaggucucaucugguagccugaacaauagauauuugucuuuccuauucaggagauaauuugaacaugcuuugugaucauucucagcagauucacuugauuugugagcaaacugaugaaagugauaauccacagaccuaauucuacauuuuaagagauaaaagauaaaacucuucaagcgaggauauuagaaaucaagcugucugccaaagauuaauauucccuuccacagaauggagccgcuguguugcugggaagcagcugcccaucaggaauuacauuucucuagcucccuucauuuaagugggaccaugugacagagagcuggccaagagaaugcaggcagaagugaugcacaccacauacaggccuggcccaggggaaacuuucaugcagucuuccacugucuuucccaucugcuggcuagauaucaacacugaggcugacuucggaagccauguguugaauccugcaaggucucuguaugaaccccuguguccaggucccaucauuuggacuuuacauaagcaaggaaaauauuugcuauuaugauaaaccacuacaauuuuggggaugugucuguucccacagcugauauuuaucuuaacuaauauggacagagacauaggaaaaaagaaguuccccaaauauauuuuguuuccauaugcuuuuguguacccucuucugcacuuccucccccucuuugauucuuacacauccuucaagaccaaggucaggcaucaccuccuccaagaagacuuugaaaccuccccaagcugaguuaaauauggauacugcaugaaggauuguaaucuucuguguaugugaucaugucccaauaucuaacaaccuaacugguacauauuuguaaaauuaauauguaaauuaauaaaauaaauggagaaagguaaauacuucaagcaaaaaauaaaaaguacaagucauccugaaaauaugaaaggaaaagucucuacuggcuguggacaauguaauugcauuaaauauuuaaaaauaucuagguaugacuagccuuucugcugcuucauaugaucuuguauuaaccuaaauuauugcacccaaaauguagcauauggcacuugguacaaaucugacucuuucacuagauugcgaauccccugaagacaaagacugugguuuucuuuguguuuccauuuucaggucccagaauggugccugaaaugguguaggcccucaccacaugcccauucacugacucguugacucacugacuggcuccaggcuggccuugaauuccugggcucagacuauccuccugccuuuguccuuuuguucugagucuuccucagcauuuucugccaacccuucuuuucaggcugacauggguuaggagguaaucugaaagcuuucaccaauaagaaaaauuaauugaauuacaucagcucuauuauaaggaaaagggcuauugagauauaaucuacauacuguaaaauucaucuguuuaaaguauacaauucaaugauuuuuaguguacuuagagaauuguacagccacucccauaaucuaauuguagaagauuuccaucauccaaaaaagaaaccuugcagcagucacuccucauucacacucuucccacccccagcccuaggcaaccacuaauccaguuucucucucuauagauuugccuauucuagacacuucauauaaauggaagcaugcaaucuguggggugggguggggggagguuguagaagcuuuaucuuuugacaaaugcugauuagccuuguaaagugcaguugaauauuaucaaacauguucucaaaaugaacaaauauaggaauaagauggggguuucuauaacugucuaaauuacugagaaauaauaauuagggguugggcaugguggcucaugccuguaauccuagcacuuugggaggccaagguggguggaucacuugaacccaggaguucaggaccagccuaggcaacauggugaaaccccaucucuaaaaaaauuagcugggcauguggugcaugccuauagucccagcuaccugggaagaugaggucggaggaucaccugagccugggagguugaggguucagugaguugugaucgcacaacugcacuccagccuaggugacaugagugagacccugucucaaaaaaauaaaaauaaaauaaauaauaauuaaaggaaccagcagcucaaaauauauuauaaacaauucucauaauugauauuuuauccaaauaucaaaaauucauacauuuuucagaugaagggucuccagagaaacagaaccaauagagucuguguguguguguguauguguguguguguacgugcaugugugugugugagagagagagagaaagagaaagagagauuguuauaaaauuuuauaacaaacacuaacaucgaggaaugcuagugaguagacaugcagcuauaugguuuggcagggccugccagugcucaccauaaaugucuucuccuugucuugcuggauacauaaucugacucucuuccucaacuguccuuuauagguaggugaccauauuaguuaguucuggacaauggaauauaagcacaauuuauguaagcacaaguuauguguuuuacuucugggcugccaugguacauuuuauguuaaccugauggggccacagagugcucugguuuuuggccaaacauuauucuagguggaucugugaggguguuucuggaugggacuaacauuugaacugguagacugaguacaguagauugcccucucuaauauggguagggcaaucaguugaagacuaacuagaacaaaaaggccgagugaaaaggaauucccauuaccugacugccuuugggcuaagauguuguuuucuuuucugcuuucagacuuggauggcaacaucagcucuccugggucuccagcuugcugacugcagaucuuaggauaugucagccuccguaauagcaugagccaauuccuuauaauaaaucucucucucucucucucucucucugucugucucucucucucucucacacacacacacaugcacguacacacacacacgugcgcacauacacacacacacacacacucucucucucucucgcuauugguucuguuucucuggagacccuugacuaacacaugagccuaaaccauaaccccuuccacagagaauccuugcucucuucucucaucuacuuacugaauggauggagaggaugcuaugaaccuagggaaagguggggccacaaaaugguaggcaucuggggucccugaauaaagcauaagaagagagcugccuagucuaccuucauuguacugcaacaugaaugagaaauaaacacuuauugugcugauccacucagaguaugcgguuuauguauuauggcagcuagugguauuuacuguagcauuuauuacaugcuagauuuuuaugaaauugaaggguaauucacucaagucaaaauguaacuaaaaauuaacuguuucaguggaaugaauaccucuuugcuugugaauuuucaaaauuaaaagagaaaagucugagucaugaacugauaguagaggggugcuuuaccaugaccaguguucuggcucacaugaagccauggagucuagcccaaguagcugaauucaguggcaauguucagaucugacucauccagucuggcucuucuuaagagacaaagaacaaauacugucuguuggcggguacuuccaaaauaauuagcaagcaccagcauacuuuuauuauuuuuuucuggcuauacaaacgcccauaacuaguauaucaaacuucaugacugugaaaaaauaaaagaacuugugaaaaguaagaaacauuuugccaggaagcaauuucauuaauagagaaguagaauuguauacuaggaggaacaugggcuuugaaaguaggcugucauagguuuaauucauucaucacuauuaauuaauucaucaauuaaacaaguguguacugagaaccuacuaaauugaaccauaaagaugcugauacucaacuuuauuugaacuacaaaaauaaugguuuuguaugauucagucuaauacauaacagccacuguuguaugugcugggccuucaguaagaauaaaacaaaguuccuguucucauggagauuaccuuuuaguggugagagaucaaaagaaaacaagucaaauguauaguaugugcaguaauaauacaggcaauuaagaaaaauauagaagguaaggaagauggguguguugugaggggaggaauuugcuauuuugugguagucaggaaagcaucuuugauaaagccauguuugaguagagaacuguaggaagugcagaaauaagccauuuggcuaccugggagaagagcauucuaggcagaggaaauagcaggugcgaagucccugaugcaugacuaugcuugguauguucaagaauagcaaugccaguguggcuggagcaaagugggcaaaagagagaguaguaagggaugagaucagcaaggcauaggacuaccucauguaaaccuugccuuacuuuuauagggcuucugguuuucacugauuuaagaguugaaaaaccuuggaggguuugggggagagaugugacauguguuuucaaaagacuacucuggcuacucuugugcgaauagacuguagggaagagaaggucgaagcaggccaauuaaaaggcuauuauuccccuaauccaggcaggaaaagaccauggcuuggucuaaaacauuagguaugcagcuagugagaagugguuagcuuuuguucuaugaacguagaacuaacaagauuuacugauguaucggaugugccauaucaaaaaaaagaggugcuaaaaauguucugagcaagugaaaaggauggaguuuucauuaacugacauggggaaaccugaacaaggaagagguuuuauggcugugagaauuuagaguuucguuuuagacauuuaaagggugaaaugccuacuagacauucaaauggagaggucaaauagucaaguaggcagcugaauacaacagcugcagagagacucagguuaggaauauaaacuuuggagucaucagcaugaauaagacaauaaacuauugagguuaauugagaaaaaaagaaaagaaauagcggagacaagaacuaagccuggagcauucugacguuuaggggucaaagaaaagagaauaaaaggaagcagcuggggaugucagaagagauguuuagaaugcaagucuucauucuuaugagaccucuccagguuucaguuuccauaagugaaaaauacagaaaauaauuccuaggucagaggauuuccaaaggcugaaaagaaguaacaugggaaagcauacauaagaucuagaaugugcuuaauaaauguuauuccugacucuuggugaaauucuggguagaugccagauuucucaugcuuccuucuauuuuuuggcuccucaaucagguccucaaauaugaacccuauaguccaacaguguuggcuauggaaguaagagccucauuauucuucaguuauuaguuauacauuuuucagugauagagcucacuguuaucagauauucaucuuuacuguuuguucucuuccuguguuuugugaggagucagguuuaaaggagaguggucacuaaugugaagcugggaaaauggagggaggaugaguucuuuaucaccuggcaggaguguauccuuacuucaacauuuaacugcucaccaaauaauuuaauuucagaggauuuguuucagugcuauggaagaacuaucuguauauaaauagcuggguuaaguagaucuuucacugcagcuguuaaaaccuauuguuguagcuagacaccuuguagugauucaagaucaucugucuuugaagaaagucuaugcuuucuuuuaugcacauguaguuucuuuuaguucugaaaauaaaauaagcuuuacuuaggaagacuaaagaaaauguuuacugaauaaaccagggguagcugaaauaauacccugccacaaucuccugcuuuuauuucauuuaucugcuuucaacauuuaccacugaauacuuauugaaagaauaaaggaaaaacuaaaugaauggaugaauuaauaucugaauggcuuuuuuuugcuuuuccuuaacaagacuccuccuaaauaauccuaaauaaguucuggguuacccugaggauuaucuuuuacaacaagaaucaugaaguaggaauacuuuuucauaaagaagagauaaaucccagaguaacaccgaaacuuaccuaguaaaguaguaaacaaucuguagggaaucucaggggaucaucugauccuaguaucaggcucaagcagauucuuuuucaaguucuuaucccuccuccucuuccccaccccaacccaguuggauuuaaauuguguauauuagagccucuuuguaaggaagaauugggcagcagugcagagagaaggaagaguugggugcuuuacccuacugcuagcacuugggugcucaaaguagagaaacaagaaaaacaggcuacugguaagauggacaauaaaaugagcugcauugggugaacugugaccuagauuauaacagugcuuuacaaauaauauuccaaauuauaagucccuaaaauuauccaaaucuagauuuuaacaaucccgaaagccauucauuuuagaaagauuuuauuuuccuguauccuucccuccauuucuacuccugccaccuuaguccaaaccaguguuuuuuuucuugccaggacaaugacaaaagcuuuucaaccagucucuucauugcuucuguugcucuucuguaauccauucuccauguagcacuuggaauaauccgacuaaaauguaaaucaaaucaaaucauuucucuacuuacaaucuuucaauggcucccuauaguacuuggaacaacguccaagcuccucccuguggucuuuaagguuuuuugugauccggccccucccugccccucuaacaucauauugagucauucucuccuucacuauucuccagcuacauugacauccuuuuacauguauggugcuuguguauguuuguacauaucuauauaguguauauacauauaacuauuuuuuauuaggauauaauuggcauacaauaaacuaaacacacuuaaaguguauaacuuaaaguuuucagauuuagauauaugcaugaaaauauaaccacaaucaacaaaauuggcauaucuaucauccaaaaauuuccuuuuacccuuuuguaauuucucacucaugucccucauuaucuucucauccaccaggcaacaaacaauaugcuuucugucacuauagguaaguuuagcuuuucuagaauuuuaucuaaaugaaauuauacaguauauacuuuuuugucuagcugccuuuacucagcauaguuauuuugauauuuauccauguuguuuauauuaauaguucauuccuuuuuauugccaaauaguguuccauuguauggauauagcauaauuuauuuauccauucaccuacugaugaacauuugguuugcugccagguuuugucuauuagaaauaaagcuacuauggacauuuguauaaaacucauucuaucgccauuuguuuucauuucucuucaaaaaauaucuagguauaaaugaccgagucuagagaaggugaagcaaaaugacugaauagaacuuuccagcaauuguugccccugcagaauaccaaauugaauaaccauccacauaagaaaacaccuucauaagaaccaaaaaccaggugagugaucauaguaccugguuuuaacaucauaccaaugaaagaagcacugaaagaguaugaaagauguuggcgccaccccucccucauccccuggcagugacuguguggcauggagagagaaucugugugcuugggggaggaagagagcaguaauugugggacuuugcacugaaauucagugcugugcugucauaacagggacuaacacagggcagaacucagcuggcacccaaagagugagcauuuagaccagccuuagccagaggggaaucaccuagcaguauugucagaauucugacaagcccaaaaacaagcuaaagcgcucuggaguucuaaauaaacuugaaagauggucuaggccacaagaauugcaauuugugggcaaguucugaugcuguucuaggcucagagucagugaauuuggggugcauacaaccuagugagaugccaaccacaggggcaagggaauguuugugccaccccucagccaacuccaggcagcacagcuugcagcuccaggauucacaccuuccuucugcuugagaagaagagaggggagaggaggacuucguuuuucaacuuggauaccagcuaagccacaguaggacagggcaccagggagagucugacagcccucauuccagguccugguuccuggacaaaauuucuaaauauauccugagccagaagauaaccugcuuccuugaagggaaggacccaguccuggcagaauucaucaccugccagcuaaauagcccuugggccuugaaugaacaugagcaauacccaggcaguacuugucauaggccuuggguaagacccagggccacacuggcuuuaugugugacugagugcauucccagcagcuguggccuugaggagagaauccuguuugaggaaaggagagggaagaguaaaggggacuuugccuuguaguuuggguaucagcuuagccacaguggaguagaacaucaagcaguuuccaaggguccccaguuccaggccuugguucuuagauggcauuucuggauccauccugggccagagugaagacuacuguuccgaagggagagauccaggccuggcagcauucaccacaagcugacugaagaguccuugggccuggagcaaacaucagcaguaaccaggcaauccucacugugagccuagaacagugguggccacagcgagagacuucuucugcauagaggaaagagugggaagaauguugucuugugguuugggugccagcucagccacaguagaauagaguaccaaguagauucuuacguuuccuaacucuagaccugggcuccuaaauggcauuucuugucccacucugggccaggggggagcucaccacccugaagggaagggcauaaaccuggcuacauuugcugccugcugacugaagagccuuugagucuugagugagcaucggugguagccaggcaguggacaccucaggacauugacaagacccaguguuaugcuggcuucaggucugacacaguacagucccagugauggugaccauaggggugcuugugucacccccucugacagcuccagggagcccagcaugcagagagagacuccauuuguuuggaggaaagcgagagaagagaacaaaucucugccuaguaaucuaaggaauuccccuggaucucaccuaagaccaggaaggugguauuucuacaagucuguaagagucccaguguuacugagcauggagugcccccuaaugcagauauugcaacagugacuaaagauuuagaucauaacacuugaauacuuggaaagccuucccaagaaggauggguacaaauaagcucagacugcaaagacuacaauaaauaccuaacucuucaaugcacaaaaauaaaugaacacccacaagcauuaagaccauucaggaaaacaugaccucacaagacaaacuaaauaaggcaccagugaccaauccugaguaagagauaugugaccuuucagagaauucaaaauaccuguuuuuaggaagcuuaacaaaauuuaagauaacacagagaaggaauucagaaucuuaucagauaaauuuuuaacaaagauauugaaauaauuuuuaaaaaucaagcagaaauucuggagcugaaaaauucaauugauguacaaagaaugcagcagcaucuugcaauagcagaguugaucaaacagaagaaagaauuacugagcuugaagacaggcuauuugaaaacacagagucauagaagacaaaagaaaaaagaauaagaaagaaugaagaaugcccauaagauguagaaaauagcuucaaaauagcaaaucuaaaaguucuuaaucuuuaagaggagguaaagagagagaucaggguugaaaguuuauucaaagggauaguaaaagaaaauuuuccaaaucuaaauaaagaaaucaacuuacaagaacaagaagguucuauaacaccaagcaaauuuaacccaaagaagacuacuuuaagucuuuuaauaaucaaacucccaaaggucaaguauaaagaaagaaacuuaagaguagcaagagaaaagaaacacauagcauacaaaagaacuucaauaugucuggcagcagaauucucaguggaagccuuccaggccaggagagagcggcaugauauauuuaaaaggaugacugaaaaugcuuuuauccuagaauaacauaggugaaaauauccuucaaacaugaaggagaaauaaagaucuucccaggcaaacaaaaggugaaagauuuaaccaacaucauaucuguccuacaagaaaugcuaaggagaguucuucaaucugaaagaaaauaauguuaaugagcaauaagaaaacaucugaacauacaaaacucacuggucauaauaaauaaacagacaaacacguaauauuagaacacuguaacugugguguuuaaagcacccauaucuugaguaggaagacuaaaagaugaaccaaucaaaaauaauaauggggugauaaaguuaaaguguauagaguuauuaguuuucucuuugcuuguuuguuaauuuguuuuugcagucaggguuaaguugucaucaguuuaauguaauggguuauaagauguuauuugcaagccuccugauaaccucaaaucauaaaaaacccuacaacagguauaaaaauaacaagaaauuaagauauaccuccugagaaaaccaccuucacuaaauagacaaagggaggaagaaaggaagagaagaccacaaaacaaccagaaaacaaauaacaaaauggugguaguaaguccuuacuuaucaauaccacugaauguaaauggacugaacuuuccaaucaaaagacauagaguggcugaauggaugaaaaagcaagacccauugauccgcuacaagaaaaacauuucaccuauaaaaacauuucaccuauaaaaacucaucgagacugaaaaugaaaagauauaaaagauauuucaugcaaaugaaagccaaaaaaagggcaggaguagcugugcucauaugagacaaaauaaguuucaagauaaaaacuacaaaaagugauaaaaggguuauuauauaacaauaaaggugucaauucaguaagagaauauaacaauuguaaauauauaugcucccaacacuggaggaucagauauguaaagcaaauauuaucagagcuaaagagagagacagaucccaauacaauaacagcuggaggcaucgaugccucacuuucaacauuggacagaucauccagacagaaaaaucaacaaagaaauaucauaguuaaucuauacuauagaacaaauggacaucauagauauguacaaaacauuucauccaauggcugcagaauacacauucuucuccucagcacguggaucauucucaaguauagaugauauguuaggucacaaaagaagucuuaaagaauuaaaaaauauugaaaucauaucaagucucuucucugaccacaauggaaugaaacuagaaaucaauaacaagaagaauguuagaaacuauacaaacacauggaaauuaaacaauaugcuucugaaugaccagugaauuaauaaagacauuaaaauaaaauuuucaaaaauuauugaaacaaaugaaaauggaaacacaacauaucaaaaucuauggguuauaguaaaagcaguacuagagaaaaguuucuagcaauaaguuccuacaucaaaaaaguagaaaaacuuuauauaaacuacuuaauuaugcauuuuaaagaacuagaaaagcugaaaagcuagaacaaaacaaacacaaaauuacuagaagaaagcaauaauaaagauuagagcagaaauauaacagaaacagaaaagaauaauacaaaacgucaaugaaaugaaaaguugguuuuuugaaaagauaaacaaaaaugaaaacuuuuagccagacuaagaaaaaaacuaaaaaggccuaaauacaaucagaggugaaaaaggagauacuacaacugauacuccagaaauucaaaugaucguuagagaauucuaugagcaacucuaugccaauaaauugaaaaaucuagaagaaauggauaaaugauuauacacagacaaccuaccaagauugaaggcugaagaaauccaaaaccugaauagacuaguaacaaguaauuagaucaaagccauacuaaaaagucucccagaaaaaaaaaaaaaaaaggcguggaccugauggcuucacugcuaaauucuaccaaauauuugcagaagaacuaauaccaauccuacucaaacaauucugaaaaauaaggggacuaccucuaaacucauucuaugaagccaguauuaugcugauaucauaaacaaagacacaucacaaaaagaaaacuacaggccauuaucccugaugaacauugaugccauugauacaaaaauccucaacaaaauaagagcaguccaaauucagcaacacauuaaaaaggucauuaaucaugaccagguuggauuuaucccuggaaugcaaggaugguuuaacauacacaaaucaauuaaugugauauaucauaucaacagaauaaagggaaaaaaacauaaaaucacuucaauagaugcugaaaaagcauuugauaaaauucaauauuccuucauaauaaaaacucucaaaaaacuggggauagaagaaacauacuuuaacauaauaaaagcuauauaugacagacucacagcuaguauaauacuuaaugggguaaaacugaaaacucuucaguuuugaagaucuggaacaagacaaggauguccucuuucaccacuguuauucaauauaauacuggaaguccuaguagaguaaucagacaacagaaagaaauaaaaggcauucaaaugggaaaggaagaagucaauuuauccuuguuuacagaugauaaaaucuuauauguggaaaaacccaaacuaauucaguaaaguggcaagauacaaaaccaacauacaauaaucaauagcauuucuauaugccaacagcaaacaauaugaaaaagaaaucaaaucccauuuccaauaguuaugaauaaaauaaaauacuuaggaauagacuuaaagaagugaaagauaucuaaaauaaaaacuguaaaacacugaugcaagaacuugauugaagaggacacacaaaaaaauggaaauauauuccauguucagggauuggaagaaucaauauuguuacaauaaaaugcucauacuaaccaaagcuaugugcagauucaaugcaaucccuaucaaauaucaaugacauucuuugcagaaauagaaaaaaaauuuccuaaaauuauauggaaccacaaaagaacuaggcuagccaaagccauacagagcaaaacaaacaaaacuggaggaaucacauuaccagacuucaaauuauacuacagaaauauuguaacaaaaacagcaugguucuagcauaaaaacaggcacauagaccaauggaacagaacagagaacccagaaauaaauucacacauguacagugaacuuauuuuugacaaaagugccaagaaaacacauuggggaaaggacaaucucuucaauaaaugguucugggaaaacuggauauccuuaugcagaagaacaaaacuagaaccuaucucucaccuuauaaaaaaucacacuaccugacuucaaacuauacuacaaggcuacaguaaccaaaacagcaugguacugguaccaaaacagauauauagaccaauggaacagaacagaagccucaaaaauaacaccacacaucuacagccaucuuaucuuugacaaaccugacaaaaacaagaaauggggaaggauucccuguuuaacaaauggugcugggaaaacuggcuaggcauauguagaaagcugaaacuggaucccuucuuuacaccuuauacaaaaauuaauucaagauggauuaaagacuuaaaugauagaccuaaaaccauaaaaacccuagaagaaaaccuaggcaauaugauucaggacauaggcaugggcaaggacuucaugacuaaaauaccaaaagcaaugguaacaaagccaaaguagacaaaugggaucuaauuaaacuaaagagcuucugcacggcaaaagaaacuaccaucagauuggcugggcaugguggcucacgccuguaaucccagcacuuugggagggcaagaugggcagaucacgaggucaagagaccgagacuauucuggcuaacacagugaaccccaucucuacuaaaaauaaaaauaaaaauaaaaauaaaaauaaaaauaaaaauaaauuagccaggugugguggugggugccuguagucccagcuacucaggaggcuggggcaggaaugaaccugggaggcggagcuuucagugagccaaaaucacgccacugcacuccagccugggcgacagagcaagacuccaucucaaaaaaaaaaaaacgaaacaaaacaacuaccaucagagugagcaggcaaccuacagaaugggagaaaauuuucacaaucuacccaucugacaaagggcuaauauccagaaucuacaaagaacuccaacaaauuuacaagaaaaaaaagaaacuaccccaucaaaaagugggcaaaauaugugaacagacacuucucaaaagaaaacaucuauccagccaacagacacaaggaaaaaugcucaucaucacuggguaucagagaaaugcaaaucaaaaccacaaugagauaccaucucacaccaguuagaauggcaaucauuaaaaagucaggaaacaacagaugcuggagaggauguggagaaauaggaaugcuuuuacacuguuggugggaguguaaauuaguucaaccauuguggaagacagcguggcgauuccucaaggaucuagaacuagaaauaccauuugacccagcaaucccauuacuggauauauacccaaaggauuacaaaucaugcuacuauaaagacacaugcacacauauguuuacugcaguaguauucacaauaguaaagacuuggaaccaaccccaauguccaucaaugauagacuggauuaagaaaauauggcacauauacaccauggaauacuaugcagccauaaaaaagggugaguucauguccuuugcagggacauggaugaagcuggaaacuaucauucugagcaaacuaucacaaggacagaaaaccaaacaccacauguucucacucauaggugggaauugaacaacgagaacaccuggacacaggguggggaacaucacacacuggggccugucggggggugggggcuggggaagggauagcauuaggagaaauaccuaauauaaauuacaaguugaugggugcagcaaaccagcauggcacacguauaccuauguagcaaaccugcucguugugcacauguacccuagaacuuaaagcauaauaaaaaauaaaauaaaauaaaucaaaucaaaauggauuaaagacuuaaaucuaagauuucaagcuaugaaacuacuaaaagaaaauggggaaacucuccaggacauuggacuggguaaaaguuucuugaguaauaucccaugugcacaggcaagcaaagugaaaauggacaaaugggaucacaucaaguuaaaaagcuucugcaaagcaauggaaacaauuaccaaagugaagaggcauccuacagaauggaauacaauauuugcaaacuauucaucugacaaggaauuaauaaccaaaauauauaaggagcucaaacgacucuauaggauagaaaccuaauacucugauuuaaaaaugggcaaaauaucugaauagacauuuaucaaaagaagacauacaaacagcaagcgaguaugugaaaagauacucaacaacacugaucaucagagaaaugcagaucaaaacuacaaugagauagcaucucaccccaguuuaaaugauguuuauccaaaaauacgaguaauaaugaaugccagcaaggauguggagaaaagggaacccucguaaacuguuugcuggaaugcaaauuuguacaggacuauggagaaaaauauguagguuacuaaaaaacuacaaauagaaccaccauauguuccagcaaucccagugcuaguuauauacccaaaugaaaugaaauagguauauaagacagauaucugcacuccuacauuuauugcagcacuguuuacaauggccaaaauuuggaagcaaccuuuuguccaucaacagauaaauggauaaagaaaaugugguauauacacauaauguaguacuauucagccauaaaaaagaaugugauccugucauuugcaacaacauggauggaacuggaggacaucauguuaagugaaauaagccagguacagaaagauuaacuucacauguucucacuuauuugugggagcuaaaauuuagaacaauugaauccacggagacagagaauagaaugaugguuaccagaggcugggaagaguagugggggcaggaggagaaauggggaugguuagcggauacaaaaauacaguuauaaacaauaauuaacauuuaguaauugauaacauaacagggugacuacagucaacaauaaauuauugcacuucuuuuuuuuuugagacaaaguuucgcuccugcugccgaggcuggagugcaauggcgcgaucuuggcucaccacaauccccgccuuccagguucaagcaauucuccugcuucggucucccaaguagcugggacuacaggcaugugccaccacgcccggcuaauuuuguauuuuuaguagagacgggguuucuccuuguuggucaggcuggucucaaucuccugauuucaggugaucugcccaccucagcuucccaaagaauuauugcacauuuuaaaauaacuaaaagaauauaauuggaagguuuguaacacaaagaaauaauaaaugcuugaggggauagauagcccauuuacccugauaauuacacauuguaugccuggaucaaaguaucucaucuaccccauaaauacauacaugcacuacguacccauaaaaaaauuggcugagucaugugguagguagauguuuaacauuuaaaaauacagccaaaccauuuuccaaagugauuauaccauuuuauauuccuaccagcaauguaugagaguuccaguuacuccacauguucacuaacacuugguaugaucagcuguuaauuuuaaauuuuguaacagguaaauauuagcccaauggcuaaugauaggaaguauuuuuuuucacaugcugauuugucaucugaauaucugcauaucuucuauggauagguguccauuaaaucuuuugcucauuuaaaaaaauugucauuuguuuccuuauuacuggauuugacaguucuucacauuuuccauauuaacuccuuuauaagauaugauaauuggaaacauauucucccagucagugguuugucaucacugucuuugcaauguuuuucagaaagcugaaguucuuaauuuugauuaaguucaauauaucaaauuuuucuuuuauggauuauacuuucagugucauucuuuuaaaguuuuauuuuaaguccagggguacauguucagguuuguuauauagguauacuugcgucauggggguuuguuguacagauuacuucacacccagguguuaagccugguacacauuaguuauuuuuccugauccucuuccuccucccacccuccacccuccaaaaggccccaguguguacuguuccccucuaugagucguguauucucauaauuuagcucccacuuauaagugaguacaugugguauucaguuuucuguuccuguguuaguuugcuaaggugucauuuuuaagaaaucuuugccuaacccaaagucacaaaguguuucucuuauguuuucugcuagcaauuuuagaguuuucggcuuuauauuuaucuuugcaaaauauuuaauuuuuaauaugguauaagguauagaugagugcuuuuauccuuuuuuuugaaaaccauauccaauuuuuccagaaaauuuguggaaaagacuuuccuuuauucauugagucaaaccuuuguuaaaaaucaauuaaccauauaaauguggaucuguuucuggacucuguauuuuguuucauugaucuauuuauuuuuacauugauaccacauggucuuaaauaucaugacuuuauacuauaucuugaagucaguuggugugucuuacagcuuuaauuuucuucaaaguuguuuuuaaauuauucugcauuuccauaugaaugugaggaucaguuugcuaauuucuacaaaagccugcugggauuuugauuggguuggcaucuuuucuggucuuuuaaaauuaaaagcuuaucaucacuuuaagacuuuuguauuuuguucauugguucauuuaucuucuuuucucuuuacagggaucuuucgauggcuggcuccuuuguaucauucguauuucagcucaaaaguaacauccucagagauaucuuuccuugauuacccaauuuaaauuuauaucccucaucucuuuauaucaaagcauuguuuuguugacuuaacagcauuaauuaucaucagaaauuaaucuugccuauuuguuuauuuuguugcuuauuaucugucuagccaacuagaaugugagaaaagaguagagaccuugcuugucuuauucaguuuguaucccugaagccaaaaagugccuuugauaagcggauacuaaauauuugucgaaugauugacuauuugacaaaugugcauuuaaguaaagauucaacuaguaugaaaauauauaauauuaacuagaauauguuaacuuauuuaugaaaugauaguucucugggaagacugugggaacuugacugugacuuaaagcuguaguucucuugaagauuaugaauugcguugggcuagauuauggcauuucagaaacauagauuuuugguuuuuaaacuaaacaucucaauuuagcucauuagcuuuguuagcagaauuuaaauaggucucacauuagaguuauuccugauuacuuuaggaaugugaauaucuagaacaaauaaaaucuuuccccaaacauuacacagauaaaaggcagaaaguuucagguccaugagaaauuauagguauuuccuaaauaauauuuaauuaaaaauaaauacuagucauaauuuugacagacagaggcagcaauuaaaacauacuucauuuuuguccuugauugcuuaaaguagcaaacaaugaaaucaauuucuugagcccuauccauguugcaaagguauaaauaagauuuuauccuuaaugagaucauacaacacagauacaaaaccuaaggcuguuucaaaauguuuuguaguagcguaaacauagaauuuuauuugcugagcuauuucucucacugagaaccuucauucauugaacccaccaaacuuguguugagcaccagcuacauguuaggaacugugcuaggcaauggagauaagaaaugaauaaaacagagucucaauccuucaagaagucacagauuuuacaauuucaauugcuugaaggaaaagucacaacugaagagacuggaaauuguggaaauggucagcuuuuuuucccugauuuuguucuacugugguccuuacguggccuucauucaauaccuaggcuucauggugggcuuagcuuuccccuuccaagugacucacaggcaacuccagaucuaguguucuauuauuagccuucucaaaccugauuauucuaagaagcacuucccacuggcaacaugguaaucauguuuaaauauaacucuucaugaucaaucuaaaucuccagauuuuuaaccaaguuucccuguggcuuagauaccuuuuuuuuuugcuuuguuuuuaauuaauccacguuuuuauaauccuaugugacauuaacauguaaggggugugugugucuguacguguggccuucugcacuaaggcauuagacagaaacaauuugaaugaagaccacuggcucuucuagucaaacuuccucuuucuguauacucugccuguaucugucaucugucuauaccugucagaugucuguacaugucaggaauaaagcuaacgggauguauaacaacuaauaauucaugguuugaauaacuauaguagcuuucauuuauugaauguuuccuacguaccaaugauaugggcuggcuguguccccacccaaaucucacguugaauuguaauaauccccacgugucaagggcagggccauguguagauaauugaaucaugggggugguuucccccauacuguucucauaguagugaacaagucucaugagaucugaugguuuuauaaaugggaguuccccaacacauguccucuugucugccaccauguaagauguaucuugcuuccccuuugccuucugccaugauugugaggccucccuagccauuuggaacugugaguccauuaaaccucuuucauuuauaaauuacccagucuuggguaugucuuuauuagcagugugagaacagacuaauacaaccaggaaccaggaaauaugcauguccuuacuuuauuuuuguaucaauccuaugagguagggacuuuuauuuucuucauuuuaucaauaaagcucagguaggguaauuuggccuagauuacaucaguaagugaagagaacaagguuucagcuuaauccugucaaucuggccauagccuauauacuuaggcuauacaaauauuaaaguauacuauuaaguuacaaaauauuaauauuaaaaacuaagaaugguuucuauauccucuacaacccaauuuuccaaucuuucaguaaccagggcaaugagacugaaauuguucauuuucuguuuuuauagacauuucuguuuuuuaaaacaaguuguuagcaucaaauuucggucucugugaaucuggaaacacaaggcuauagcugaccugucaguuauuauauuauuuguuuuugcaauuuuggccacaggccauuuauccuauuucauguuuguugcuuuuuuuuuuuuugagauagauagggucucacucugucacccagacuggaaugucauggcacgaucauagcucacugcagcuuugaacuccugggcucuaguaauccucccacuucagcccuucaaguagcugggauuacaggugugcgcuaccaugccuggcuaaguuuucuauuuuuuguagagacgaggucucgcuauguuguccaggcuggucuugaacuccuggccugaagcaauucuucugccuuagccuccaaagcacuggaauuauagguguuagccacugcacccagccuuguagcuucugaagagcaggaaggagagcuugugaguuaauaugaaacauuaagaugucaauaucaugaaauaaaggcauacuuuucauagcaaaccuuuccauaaauuacucuuacgcuuuuucuuucuuuauuccucuugaacuguaauaaaaaugaaaacuauaacaaauauaaucacuuuuaaauguuucuuaguccuaagcuucuauccuguugcuuuccaguaauguguuugugguugcuguuguaacuauaacaccuuaacuuucaaugaucuaauuuucacaguaaacaguuacccuauuuuccaaagaucacacucugacaauagaaguuaggacauaucuauaugcauacccauauuugggaaauagauuaaucaacuaacacaguuuuccaaauaaguaauuuuuuaaaaaucccuuuuuuuccauuuuguuaagccuuuuguauuuucuuuuugauauuagguauugacaugacccugccugcacaguuccagugauaaacacuugcuuuaaugauuuauugccuuuccuggaaaggaacaaugaaugaucugaacuuauugcuguuccuaugcuuggugggcaaaucacauugaguuugccuucauggucaauacagauggcuguaaucaaaucaauuuugggacaagccacauugaaugcuaaaagccugauuugaauagcacagccuaaagaugauggaaccuaugccacugccagcugauuacuaugcuuuagaaaaauaaaaauguuuuaauuaauuacggggaugacaaaaaucuguauuaaaaggaguaaaauuggaaaucuaaucaaggguauuaaaauccccaacgaauuaggccugaaggaaggauaucuaaaagauguaccaaugaguucauacagaccuacagauacaucuaaugaaugguugcuaaauaggacaaauauagcucauuaucauuuuagaaggauaauuauagauaauuacagguaaacuaucaucccaaugcuacaugugauguagaugacauguuaugcugggcuuuuuguuuucucucacaacacuuauugaauauccacuaaguuuagaacaucacagaaguucagauuuguaaauaagaaaaaaaaaacaacacagaaaacauagaccaaagcccauuauaauaaacuccauggagcaucuacauuuuugcuugcaguacaauuuuguuuacauauuuacaaaucacuuuccuaucaacagggaacuagagacuaauaaaagggcucaugcccaacuguucuggagaauuuaagcaaguaaaauguuguguucaaaaugcaguagggguaagagguggauaaaaugcauauaacuucacuuuugcuuauucuuucuaugguucagccuugaucugguuuggugcacaaaugugaagguuuagaggcauacuuuggcugugcaguuuagguaguauuuugaugcacauguaaaggcuagaaaaaaauuuaaaagugcuauuuggugacuagauguauucgguuucagaacuaauaggcuauauagagauauaaaagaggauauuuauuaugggaauuggcucacaugauuauggaggcugagaagucccaugaggugccaccagcaagcuggagaaccaggaaagcugguguguacuucagccugaguccgaaucucugagaaccggggagccaaugguguaaguccgagaguccaaaggcccaagaaccaggagcucugauguccaagggcaggagaagauggaugucccagcucaagaagagagcaaauuagcccuuccuucaccuuuucauucuaucugggcucucaacagauuaagugaugcccauccacacuggugagggcagauugucuuuacucaguguacugauucaaauguuaaucucuuccaaaaggacccacauagacauacacagaaauguuuaccagcucucugggaucucuuggcccugucgaguugacauaaaauuaaccauuacaccagaggaaaaaagaaaaaaacuuugacaaacuaaguuaucuuuuuaauacauggguagaauuaccacucacacaguaaagaaacaaagagcuguugaacagauauaauguauuauaaugcauuuaguggaccauuuuagaauauagaaauggaguaaagggaaaaaucugugaucaaaagaauuuuaccacucauucauucauucaaaauacauuuauguauuaaauguacauaauagauuuacucauucacugguucauucaaaaacauucaguauaugcuaugaaccaggcacugagugagccaauagacuugguuucccaaagucagaaaaagaugaacucuuaggaaaaaauacacaaaaaugaaaaacauaaccauaaaaucaucaggaaauagcaaaauuuauaaacauaauuacagcuauuaaauaauacuuguauaaaaaaguacacaguguuauauaaaaaaaggcauaaagcaacgguaaggcauuggagagauuggggucaaaugagguuagucuuugaaaaggucaaccaggagacugcauuuaaaagcgggaaaaggauauaauuuguucaagugaagugggaaugguguaucaggaaggccaagcaauucuaggugggagaaguguguacaguagaagguuuucuuagcagaaacacagaaaacaggugugggaaauaucaccaguucuuaacuuggccugucucucuauuaagaagagggucacaaaguguucacagauggagauauucucuuuccaaugggauaacaguacugauuuaguucauaugaaaagauuuuuuacaugaaaaucauauuuuuuggaauaaaugaugugcaauuauguacaugacaaaagaauugauuuacaggggaauuuugccgcaguguuauccaaacacuaaauuuuuuccauauauuuaaaacaugaugcuauuuacuaaaacaugcuuuaugcacucuccucccaggaacacaugcauuacacaaaagaauguauccauuugccuuaaaacaaaacaacaguagcauuaccauuucauuuuauuuagcuacuaaugucaagagagcucaaugaaaggaaauguuuuuucagaguugaaaaaacucugauuccccuugaaaauagucauccaaggucaauagagaucauguuauucagauuuuuagacaagaaacgaaugggggauucagaugacauugugcuucagugauauguuaggcacaugaauuauuauaguggcuugaaagagaaaaauucaucuaagaaucuuccuaauuccccuuuauucacugacuuucucaguaucaucuaucaaauauuucaaacaaaaaggaccacauuguuaagugacauaaagaauaaaauuuggcagcacagauuuggcuuuuccucucuuaugcaaguauaaaguuaugaauacaaacaaauuuaguuuucacuugcuuuucaucaucuaaucaauaaaacacauucuacauaauccaaagcauacugaaaguagagaugacauuaaaaagcugacuauaaaacuaaauuucaaaagagcuuaaaaucuagugccaugagaaguccagaagauuaguuauuauguucuuuaggcuaauugaguucaaauguuggcuuuuaugaaaugugcacaagggccaccucaugauuaaguaaucuuagcaaacgcacacaccggucagaauagucacaucugaacaaaaggcacauaauacuuauauguggcaauacagcaaccucuaagacagccaugugauuagaaauguacacagcaguacugcugaccuaaaaaauuacauuuguuacauggggaagguguauauauuauuggaagucauggacuugccuuacaaaucuaaauuuauaaacacaucauagaugaaaugcaaguuuggucaguaaauuggccaucuguuccagauacuuacuuuucuguuucaaggagaaaaacagucuauucuaaauauuuucuuagucaaccucccauuugaggcucuagugaccaaucaauccaucaaucauuuauguauaucuaucuacuuaaaacaaauauuuauugagguuguacuaugccccaacacuguucuaaacucugggguuucaguggugaaucagaaaaggugccuguacacauccuagagagguagacaaauuuaaaaaaaaucaaacaauaaauauuucaguauugauaaauuguauaaagaaaaauaaggcaaaguagaagaacacagagacuauuuuaucuuauuuuauuuuuacguauuucaauaguuuugggggaacaggugguguuugguuacauggauaaguucuucaguggugauuucugagauuuuggugcacccauuacccaaggaggguacacuguacucaauguguagucuuuuaucccucacccaccucacucuuccccacaaguccccagaauucauuauaucauucuuaugcauuugcaucuucauagcuuagcucccacauauaagugagaacauaugauguuugauuuuccauuccugaguuacuucauuuagaauaauggucuccgacuccaucuagguugcugagaaugccauuauuucauuccuuuuuauggccgagcaguauuccaugguauucuuuauccacucauuggcugauggguauuuagguugguuccauauuuuugugauugcgaauugugcugcuauaaacaugcaugugcaaguguccuuuucauauaaugacuucuuuuucacuagauagauacccaguagugggauugcuggaucaaauggucguucuacuuuuaguucuuuaaggagucuccauacuguuuucgguagugguuguacuaguuuacauucccaccagcaguguagaaguguucccuuuucaccacauccaugccaacaucuauuauuuuuugauuuuuuaaaauuaugaccauucuugcaggagacuguuuuaaauagagggaccugggagggucuucuuaacgcgguaguucacauuugagcagaagguucucguucucuagucuauuauauuuucuuauaauuuaaaauugugcacucuuugugcagugcugauucuuggcuuuccuuucccccuucuaccguuuucuuuuacuagcuuuugccucucagagagcgugaguuaggaggugaaacucauuuauuugugacaauguuguuccugcugacagcuuuacaaagaguuuugauugaaaagaaggcugaaaauaagggauaaaaugagauauucuuggauucuaaugaugcacauuuucucugccacccugaacucauauaucaguaaacaauugagaauugccuagcuuucugagugaucucuguuuaucauaggcucugggaauaugucugauggugaucucuuauaauacauuaaauaauauauuuuaguaguccauuguaauuuguucaucucugaauuugguaggaagucauccugaucuuuagcaaugaauguguacuuugagauucccuugaauucauaaaaaaagguuaauguauccauauuagucuguuuugcauugcuaugaaggaauaccugagacuggguaauuuauaaggaaaagaggcuuauuggcucaugguuuugcagacuauacaggaaucauggcaccagcauuugcuuccagugaggccucaggaagcuuacaaucauagcagaaggccaagggcgguggggggcagguguaucacauggugugagagggagcaagagagagagagaugggggagguccuaaauucuuuuuaacaaucaguucucacaugaagucauuacuguggggaggguaccaagccauucaugagggaucuacccccaugaacccaacaccucccaccaggccccaucuccaacauuggggaacacauuucaacaugagauuuggaggggucaaacauccaaacuauaucaguaccuauuuuacaaauuguauauuucugcugauaucaauuuaaauaaaauuacauuauuucauaauuaucugacucaugucaggaauuaucacuaaauugaugacaaaagcuuuggacaguagaacaaucucaaaauauuguuucccuagcauaaugaugcugucuagcaauaggauagaggauugugggaauauuuuagcucugaaaaaagugguucuuuacaguuacaaggacagagaaaaacucaauauuucuagaaaggaauauaaagauucuuacucucagaaucccuggaaauacaaauauaacaagaaaucuuguuucaucaaaauucuugugaaguuacugcagcuaaaaucaggagucaaauaggggauucucucuauacauagcaauggucaagaaagcuugaauaaccacagaaaggagccuagaaucaaagaagcccaggguaggaaggcaucuuuaaaaucaccugguucuauacuucauuaaaggcuugaaucauccagcaacuucucugccauacaauauucagacuccaguaauggagaacccauuucuuucuaaagcagugaacuccuuuaauggaaaccuacauaaaugguaaaauguccucccuuguugaacugaaaucuauuuuuucuuuaacuuccauuuccauaacagaaauuuaacuacacuuugggggaugcuuuuuacuuucauaaagcauuuugacuaugcacaagaauuugaacuccagggguuuucuggaccuauaauuuagauuuugggaggauauggugggggcaaggcaggaagaaaagaaggucuuaguguugugcuucaauccagaaauuccugaaguucaucaccaacaguuauuggaggaguuguuaauaaaguaauuuuuaaauguucacuguuauuguuucuuguguacugcucccucagcaaccucacaaggugcaagugggguaggggaugacugagaaggaagcauucagccauuccugggucucuagacccgaugccaucaaauacuaguaaaucucuguuguaaccccuagcaaagacuuuacuaggcagguuuuuccaucacugaacaagcugaauauuuagaaaguguuuucuugugugucucccuacccccacccccauaacuuucaccacugaauccuuuacuagauaagcaacacauaaggguauuuggagcccuucauguaauugaauagggggauaguuucugaugaugguuuuacaugacagaugguuucuagauuauccagguuuuuaucaacuggaugcugucuagcauaucaaagacauuuuaaaacuuuuaaauaaauaugugcuaagcagguccaaagaggcuaccacuucuggugaucuggucacuguccuuuucccaaugcaguauaauuuuaugagcacuuuguuaaagcugcaucucuuugcaaaccagcuugguuaaauuuccuauuucauuuucacauaucuaguguucauuuucacauaucuagugaucuguucuuauacaguugauuuuuuuaaccucaaggaaggauuuuauauuuauccuuaguaaauuucauucuaaugguuuuuaucuaguguuauagccucuggagaucaugcugcaucuugauuuugucaucagucaguuaagccauuacuccacucccagguuuguagcauccacaacuuuggaaaguacaauguaaugguccuugucgucccuggcucugccuucuucuaacuuuugcacuuaaggucaauuaaaaugcaugaauucaaaauaguuuuuccuuccaggaucaacucugcuuauuagacugaagguggggacagaaugaauuuagaaucauuuuauuuuagcacaggaaaaacuguauaauugugauuguuggauucuucaggauugcaugauauaauauuucaaauggccucuaauuucuuuaagucucuuuucagggaggaaaauccagguuuauaugcaaaaauguagccaguaugcauaucugacaaaaacucgacaaguaggaaugaaagcaguguagaccaaggaaaauggcuugacacuggaauagagaaagggugaauaaucuggagucaaacaaaggucccaagagagugggugaaacucucccugaaucuugaguucaaacuauauauaaagguuugcaggaaaagaaacagaaaaaggcagugaacaggcaguccuggagagccuggacaaagaaaaagauuauaauaagagaaagacacuuccuugucauuuuaugggaaaaugagaaggaagaggcaaagaaguuugugugugugcaugagagauaggggagggaguuggguagugagaguugugguggaaaaacaccugcuuugugcuuuuugauucuuucuggagcuuagcucaacugaaugucuuuuuuuuuuuucuuucaagaauugacaugcugauauaagagcucaaaaaccagcaauuucuaaugagguuugcuacaucaaaugugaucuaggccaaccuuuuuuauuuagcuguaguggaaaaaacaauucuccaaaggcuaauucuugcuggaggucacacagccaauuuguuucagaguugagacuagagaauccaugucucccaaucacugguucaguagucuuuucuauggaggacucccucgacuaauaguucaaacaacacaacaucaaauaagccuuguucucuaucaaccugaucuaucuucugcugauagcugauuaaacaaacgauuauagcaacaaaugaaugauugugacucguuuaacuauaucuggaccuggagguagcuauuuguuuuuauauuagguuuuaaaaaauggauuuaaauauuauaauucuauagaaauuauagagaacaagaaucagagcaaucacuacauagcucuaugaauuugcugcagagaauuaagacauaacauaucagauacauuugaagcacccuauguauuacuuuguaaucuauuucucauacuucuucuuuaaauguguugauuaucaucuuccaugaauuagguugguaaagaaguugacaaggggcuuuauauuuuuaaaauagagaaaauacugcaauauaauauuugauuacacgaauaggggcugguacacaaauguuuguccuucaauuuccauuuaugaauggauuugcuucuaggcugucuuuuccaugucauuaucauuugucuauuucuguauuaauuccacaucaucuuaauuacuaauaguuucauaagauuugauagcugacaaagcaaguucucccauauuuucaagcuaauuuuggcuccuuguuuuuccucauuaauuuuagaauaugcuuguuaagauccaaaaaaaacuuuguugaaauaugauaaugguuuuauacuguaaauugagagaugaauaacaucucuaugauauuaagucaagccauuuuggauauggucuaugguaucauuuguuuccauuuuuauauccuucaaaacuguucuguauuuuuuuccacaaaugucuuucacacauuuuauuagauuugugccuagguaauuuauagauuuauuguuauuauguaggaagaauacuauauuuguauaauauauauaguauauauguauacuauauauaacauauauguuaccuguguacuauauauaacauauauauaacauauacacuguauguaauagauguguauacuacagguauuuacaaauacuaucaguuuucauguauuaauccuacagcuaggaaccuggcuaaacucccuaauaguuuguaguuacuuuuagguuuucuaugguugcaaccuuguaaaucccauguaauuucaguuuauguuuuccuuuucaaccauuaugccuuguauuucuuuuucuuaccucauugcauuggccagguugccauuauauuuuaaauaagagcaguuauguuuuagauagauaauuuuugucaauuuaaaaauuuaucuuccauuuauuguuugcuaauuugguuuauuuuucaauuuuaugaguguggaauuuuaucaaauauaucuuaagcuccuacugaguuaauguuauguuuuuuucccuuuaaucuguugucauuaauaguuuuccacauauugaaacacucuuauauuuucauuaauuuuuauugcccuauaaaaucugauauuaucagcugaaagucaugcuugccaaggauuuucaagguuaaaaaucacuaagugugagucuugucuuuaggaaucaaguggugcaucuuaauggauguguaugugcacauauguauacacauuaauuuagauaaacacacauacaucuagucacacauaaauacauaaauauacaugcauauaaaauaaaauauaaauaauggugcuuauacuuuguccauuuuauuucaggacaaucacugaaguuuucauuguugaauacuaacaaccuuuuguaauagccauauauuacaauugguguagcaaugagaacaaaauaaagugaagcucuacagaauuuuaaauaagccuaagcaguacuacaaacagcauucauuuuggcuaaacacuaugauguccucuuaagaacauuacuuaaagauuuuaaagcucauuuucucuuuaguaaucacgaguuuggagugaaguggcaauguagggaauaaaaagaacuuacuauaaaugguauuugaaaauuccuuauguggauccacauaguguugcuaggaaacaugguuucuuagcauuuggaaagcuagaaaaccaaguuucuuaccucuuuuggccacagaaaucuguaucauggaucugauuuaagagaguuuggagauuaguuggcuucaaaauauucggauaagcauaaauuauguuuuaugaccaaccaucccuuaagaaauaauaacauguuuucaacucaugcucaaaaauaggaaaauauacccuguaucaucuuucauuacugggauaucacauaacugaaauauuagaauagugguuaaaacuauagugaugauuaauuuuacaugucagcuuaacugggccacaggguguccugauauuugaucaaacaugauggauguuuaugugaggguauuucugaaugagauuaauguuugaauugguagauuacuuaaagcagccuguccucccuaauguuugugccucaugucaucagcugaaguccugaauagaacaaaaggcugucccucuuucuauuagcgaggauucuuccuacuugacuaccuucggauugagacauuagcucuuuuccugcuuucagacucaaacugaaacguuggcuguuucugggucccaggcuugcuuaccuuaggacaggaacuacaucacuggcucucacgguuuucaggccuucacacucaggcugggaccaaaccaucagcuagcuauccugggucuccagcuugccgagucacccuauagaucuugggaguugccugcuuccauaaucaugugagccaauuccuuacaauaaaucuaucuaucugucugucuacauccuauuguuucuauuucuuuggagaauccugacuaauacaaauauaaacucuauagccagauugguuagguuugaauuacagcuuugucacuuacugccuaugugacucucagcaaguuauuuaaaaucucugugccucauuuuccucaccuuuaaaacagggaaaacaauagcaccugccuaauggaacuuugugagaauuaaaugagcuauuacauauaagacacuuaguaggacgccugaccauaauaaauguuggauaaauguuaccuauuauuacugugugguugcuguugucauucuuguauuagaaaauguauuuucagguggaacuauuacaaauuucaccauuucuuacacucuuaagacuucuuaagcaaauagaauuuacucuugccaauauuaaucuagagauggauagcccagugagaaauuuacauucuccugcuaaauggguuuccuauaacauugccagaaacccagcaaguugaaaaaaauauacagaaaaagaaagaaacaaauguagacucugugggugagugggugcauccauggaauuaaagagaaagggggacaguuuaaauggaacgcuggauguaugucuuaagugcauuuguaucaaaagaagggcauauauaugaagguauaaaauguaauuucuucagcuucauaaaaaccuucuggguaugaagagagauugaugaaacaaguaucaauauagaaguaaacaccaucagaauucagaacuggaagugaagaacaauucuguaugcaaauugaaaccaccagagggaaccuagguagguggaauauaauuacccaaacuggaaagugcccaggaagcuggauuaauaaucuacauuuuaaagaagugccaggcauuuuugaagucaaaaauguucagaaacuuuugauuauguuuuauaaucacaaaauauuuugaaaguacauucaauguacuaguuggaaccauaccaaaaauaagagcucagugagaaggaaagaggaauguggugcuuuuuauuguuauauauauuucaucuuuuuauaguauugaggaggcuuauauuuaaauagaaugacagaaaugaauuauucccucuugacgggugcaaaaucuuagagcauuauuuuucucucaaagcaaacuauaggauucaauuccccauuacaaggaaaaaugaaaaaaguaugauagcgaguuuuauuagagaguguacucgaagcauuuggagaaauuuuagaaagagauugucacaauagcaucgaaauaaaucuuaggaaugauuucuacaguuuguaggcagaaagcuaucuagguuaaacgagucauuucuucagccauuagaucugcccuucuguaauagcugcacaguuuugcacaaagggcuauauguuagggccagcaaccaggagucuugauuuuaaaagaaaugaugucggaagugcuggcuaauuaacaaaaggcauuggcaacauuuacggacuuauaagcagugaauaacauuguucuuuucauuuuaucauaugaaaguguucacauaacuauuaucugcuauccuugaauggugaggugggaacaagaagaccuauacaguaucugcauaggaaguggugaaauaaauguuuacuuguuuuaaacagucucuuuuuagaagaucaguguguucuuuacaguuacagugagaacuguaagucugcuugucugacuuuucgugaaaugcucuuccaaaaugacgacauagaccaaguauauauuccuaaaaccugugccaagcagcuuuccuaucuuguauuagcauugaguuaacuagcaacaucauaaaauagauggaagaauaaagauuaaccuaaugaaucaaugaauagguaaauauuuuuaccacagacaagucaaggguaaggguauuuaugacccucuauauaagaccaucuuucucauccgugacauggaacaggcauagaauguuggcuuuguguuaagagggaaauuuauagcauuaaaugcccacauuagaaagcuagaaagaucucaaaucgauacccuaacaucacaauuaaaagagcuagagaagcaagaguaaauuaauccaaaaacuagcagaagacaagaaauaacuaagaugagagcagaacugaaggagauggaaacaugaaaaacccuccaaaaaaucaaugaauccaggagaugguuuuuugaaaaaauuaacaaaauagauagacugcuaacuagacuaauaaggaagaaaaaagagaagaaucaaauagacacaauaaaaaaugauaaaggggauaucaccacugaccccacagaaauacaagcuacuaucagagaauguuauaaacaacuauaugcaaauaaacuagaaaaucuagaagaaaugaauagauuccuggacacauacauccucccagaaaccaggaugauaucguaucccugaauagaccaauaacaguuugaaauugaggcaguaauagccuaucaacuaaaaaauaaaaguccaggaucagacagauucacagcugaauucuaccagaaguacaaagaggagcugguaccaaaccuucugaaacuauuccaaacaacugaaaaggagggaaucuucccuaacucauuuuacgaagccagcaucauccugauaccaaaaccgggcagagacacaacaacaacaaaaaacuucaggccaacaucccugaugaagaucaaugcaaaaauccucaauaaaauacuggcaaaccgaauccagcagcacaucaaaaagcuuagccaccacgaucaaaucagcuuccuuccuggguugcaagguugguucaacauacgcaaaucaauaaauguaauccaucacauaaacagaaccaaugacaaaaaccacaugauuaucucaguaggugcagaaaaggccuuugauaaaauucaacaucccuucauguucaaaacucucaauaaacuagguauugauggaacacaucucaaaauaauaagagcuauuuaugacaaacccacagccaauaucauauugaaugggcaaaagcuggaagcauucccuucgaaaacugguacaagacaaggaugcccuuucucaccacuccuauucaacauaguauuggaaguucuggcuagggcaaucaggcaagagaaagaaacaaagggccuucaaauaggaagagaggaagucaaauugucucuguuugcagaugacaugacuauauacuuauaaaauccuaucaucucacccaaaaacuccuuaagcugauaagcaacuucagcaaagucucaggauacaaaaucaacgugcaaaaaucacaagcauuccuauacaccaacaauagacaagcagagagccaaauaaugaaugaacucccauucacaauugcuacaaagaaaacaaaacaccuaggaauacagcuaacaagggaugugaaggaccucuucaaggagaacuacacaccacugcucaaggaaauaagagaggacacaaacaaaaggaagaacauuccauccucauggauaggaaaaaucaauauugugaaaauggccauacugcccaaacuaauuuauagauucaaugccauucccaucaaacuaacaucgacauucuucacagaauuagaaaaaacuacuuuaaauuucauauggaaucaaagaagaccccauauauccaagaaaauccuaagcaaaaagaacaaagcuggagucaucaugcuaccugacuuugaacuauacuacaaggcuacaguaaccaaaagagcaugguacugguaccaaaacagacacauagaccaauggaacagaacagauaccucaguaauaacaccacacaucuacaaccaucugaucuuugacaagccugacaaaaaaaagcaauagggaaaugauuuccuauucaauaaaugguggugggaaaacuggcuagccauaugcagaaaacugaaaucggaacccuuccuuauaccuuuuauaaaaauuaacucaagauggauuaaagacuuaaacguaaaccccaaaacccuaaaaacccuagaagaaaaccuaggcaauaccauucaggacauaggcaugggcaaagauuucaugacaaaaacaccaaaagcaauugcgacaaaagcaaaaacugacaaauacgaucuaauuaaagagcuucugcacagcaaaagaaacuaccauuggcugggcgugguggcucacaccuguaaucccagcacuuuaggaggcugaggcggguggaucaugaggucaagagaucaagaccauccuggccaacauggugaaacccccucucuacuaaaaacacaaaaauuagcugggcgugguggugcaugccuguagucccagcuacucaggaggcugaaacagaauugcuugaaccugggaggcagagguugcagugagccgagauugugccacugcacuccagccuagugacagugugagacuucaucucaaaaaaaaaaaaaacaaaaaaccuaucagagcaaacaggcaacuuacaaaacggaaaaaauuuuuuacaaucuaccuaucuaacaaaggucuaauaugcaaaaguuaaaggaacuuaaacaaaucuacaagaaaaaaacaaccccaucaaaaagugggaaaacgauuaugaacagacagugcucaaaagaagacauuuaugcagccaacaaacauaugaagaaaagcucaacaucacugaucauuagagaaaugcaaaucaaaaccacaaugagauaccaucucacaccaaucagaaugguaauuauuauuuuuuucuauaaguuuuauuaauauuugaauauaauucacauaacauaaaauucauccuuuuaaaguaugccauuuggugauuuuuuguauauucagaaagucaugcaagcacaaccacuaucuaauuuuuuuuuauuauacuuuaaguucuaggguacaugugcacaacgugcagguuuguuacauagguauacaugugccauguuggugugcugcacucauuaacucaucauuuacauuagguauaucuccuaaugcuaucccuccccucuccccccaccccaugacaggccccggugugugauguuccucacucuguguccaaguguucucauuguucaacucccaccuaugaaugagaacaugugguguuugguuuucuguccuugcaauacuuugcucagaaugauaguuuccagcuucaaccaugucccuacaaaggacaugaacucaucauuuuuuauggcugcacaguauuccaugguguauaugugccacauuuucuuuauucagucuaucauugauggacauugggguugguuccaagucuuuacuauuaugaauagugccacaauaaacauacgugugcaugugucuuuauagcagcaugauuuauaaucauuucgguauauacccaguaaugggauugcugggucaaaugguauuucuaguucuagauccuugaggaauugccacacuguuuuccacaaugggugaacuaguuuacagucccaccaacagugugaaaguguuccuguuucuccacauccucuccagcaccuguuguuuccugacuuuuuaaugaucgccauuuuaacuggugugagaugguaucuaguugugguuuugauuugcauuucucugauacccagugaugauaagcauuuuuucaugugucuguugggggcauaaaugcuuucuuuugagaagugucuguucauauccuuugaccacuuuuugaugggguuguuugauuuuuucuuguaaauuuuuaaguucuuuguagauucuggauauuagcccuuugucagaugaguagguuguaaaaauguucucccuuuuuguagguuuccuguucacucugaugguaguuucuuuugcugugcagaagcucuuuaguuuaauuagaucccauuugucaauuuuggcuuuuguugccauugcuuuugguguuuuagucaugaaguccuugcccaugccuauggccugaaugguauugccuagguuuucuuuaaggguuuuuaugguuuuaggucuaacauuuaagucuuuaaucuaucuugaauuaauuuuuguauaagguguaaggaaggaauccaguuucagcuuucuacauguggcuagccaguuuucccagcaccauuuauuaaauagggaauccuuuccccauuucuuguuuuugucagguuugugaaagaucagaugguuguagaugugugguguuauuucugaggacucugcucuguuccauuggucuguguguguuuugguaccaguaccaugcuguuuugguuacuguagccuuguaguauaauuugaagucagguagcgugaugccuccagguuuguucuuuuugcuuaggauugucuuggcaaugugggcucuuuuuugguuccauaugaacuuuaaaguaguuuuuuccaauucugugaagaaagucauugguagcuugaugggaauggcauugaaucuauaaauuauccugggcaguauggccauuuucacgauauugauucuuccuaucugugagcauggaauguucuuccauuuguauccucuuuuauuucauugagcagugguuuguaguucuccuugaagagguccuucauguuccuuguaaguuggauuccuagguauuuuauucucuuugaagcaauugugaaugggaguucacucaugauuuggcucucuguuugucugugauugguguauaggaaugcugugauuuuugcacauugauuuuguaucuugggaguuugcugaaguugcuuaucagcuuaaggagauuuugggcugagacaaugggguuuucuaaauauacaaucauggcaucugcaaacaggggcaauaugacuuccucuuuuccuaauugaauacccuuuauuucuuucuccugccugauuugcccuggccagaacuuccaacacuauguugaauaggaguggugagagagggcaucucugucuugugccaguuuucaaagggaaugcuuccaauuuuuguccauucaguaugauauuggcuguggguuugucauaaauagcucuuauuauuuugagauauguuccaucaauaccuaguuuauugagaguuuuuagcaugaagcguuguugaauuuugucaaaggccuuuucugcaucuauugagauaaucaugugguuuuugucuuugguucuguuuauaugacggauuaaguuuauugauuugcauauguugaaccagccuugcauccuagggaugaagcccacuugaucgugguggauaagauuuuugaugugcugcuggauuugguuugccaguauuuuauugaggauuuuuacaucauuguucaucaggaauauuggucuaaaauucucuuuuauuguugugucucugccaggcuuugguaucaggaugaugcuguccucauaaaaugaguuagggaggauucccucuuuuucuauugaauggaauaguuucagaaggaaugguaccagcuccucuuuguaucucugguagaauucagcuguggaucugucuaguccuggacuuuuuuugguugguaggcuauuaauuauugccucaacuucaaagccuguaauuggucuauucagggauucaacuucuuccugguuuagucuugggaggguguauguguucaggaauuuauucauuucuucuagauuuucuaguuuauuuguguagagguguuuauaguguucuuugaggguaguuuguauguauuucugugggaccaguggugauauccccuuuaucauuuuuuuauugugucuauuugauucuucucucuuuucuccauuauuagucuugcuaguggucuauuaauuuuguugaucuuuucaaaaaaccagcuccuggauucauugauuuuuugaagguuuuuuuaugucucuaucuccuucaguucuucucugaucuuaguuauuucuugccuucugcuagcuuuuuaauguguuuguucuugcuucucuaguucuuuuaauugugauguuagcgugucaauuuuagaucuuuccugcuuucuccggugggcauuuagugcuauaaauuucccucuacacauugcuuuaaaugugucccagagauucugguguguugugucuuuguuuucauugguuucaaagaacaucuuuauuucugccuucauuucguuauguacccaguagucauucaggagcagguuguucaguuuccauguaguugagcgguuuugagugaguuucuuaaucuugaguucuaguuugauugcacuguggucugagagaugguuuguuauaaguucucuguucuuuuacacuugcugaggagugcuuuacuuccaacuauguggucaauuuuggaauaagugugauguggugcuaagaagaauguauauucucuugauuugggguggagaguucuguagaugucuguuagguccacuuggugcagagcugaguucaauuccuggauauccuuguuaacuuucugucuuguugaucugucuaauguugacagugggggguugucucccauuauuauuguguaggagucuaagucucuuuguaggucucuaagggcuugcuuuaugaaucuggguacuccuguauugggugcauauauauuuaggauaguuagcucuucuuguugaauugaucccuuuaccauuaugaaauggcuuucuuugucucuuuugaucuuuguugguuuaaagucuguuuuaucagagacuaggacugcaaccccugcuuuuuuguuuguuuguuuuccauuugcuugguagaucuuccuccaucccuuuauuuugagccuaugugugucucugcacgugagauggguuuccugaauacagcacacugaugguucuugagucuuuauccaauuugccagucugugucuuuuaauuggagcauuuagcccauuuacauuuaaaguuaauauuguuaugugugaauuugaccaugucacuaugauguuagcugguuauuuugcuaguuguuaguuuguuuguuaguugaugcacuuucuuccuagcaucgauggucuuuacaauuuggcacauuuuugcaguggcugguaccgguuguuccuuuccauguuuagugcuuccuucaggagcuccuguaaagcaggccuaguggugacaaagucucucagcauuuguuugucuguaaaggauuuuauuuauccuucacuuaugaagguuaguuuggcuggauaugaaauucuggguugaaaguucuuuucuuuaagaauguugaauauuggcccccacucucuucuggcuuguagagcuucugcugagagauccacucuuagucugaucggcuucccuuuguggguaaccugcccuuucucucuggcugcccuuaauauuuuuuccuucauuucaauuuuggugaaucugacaauuaugugucuugaaguugcucuucuugaggaauaucuuuguggcauucucuguaucuccugaauuugaauguuggccugccuugcuagguuggggaaguucuccuggauaauaucucgcagaguguuuuccaacuugguucuguucuccccgucacuuucugguacaacaaucagauguagauuuggucuuuucacauagucccauacuuuuuggaggcuuuguucauuucuuuuuaaucuuuuuccucuaaacuucucuucucgcuucauuucauucauuugaucuucaaucacugauacccuuucuuccacuugaucgaaucggcuacugaagcuugugcaugcaucauguaguucucguggcaugguuuucagcuccauccggucauuuaaggucuucucuacacuguuuauccuaguuagccauucgucuaaucuuuuuucaagguuuuuagcuucuuugcaaagggugugaacaucuuccuuuagcacagagagguuuguuauuacugaucaucugaagccuucuucucucaacucaucaaagucauuuuccguucagcuuuguucuguugcuggcaaggagcuguguuccuuuggaggagaagaggugcucugauuuuuagaauuuucaacuuuugugcucugguuucuccccaucuuugugguuuuaucuaccuuuggucuuugaugauagugaugugcagaugggguuuugguguggauguccuuucuguuuguuaguuuuccuucuaacagucaugacccuggaaaugcugcaggucuguuggaguuugcuggagguccacuccagacccuguuugccugaguauccccagcggaggcugcagaacagcaaauauugcagaacggcacauguugcugccugauacuuccucuggaagcuucaucucagagggacacccgguuguaugaggugucaguuggccccuacugggaggugucucccaguuaggcuacucaggggucagggacccacuugaggaggcagucuguccuuucuccgauuucaaacucugugcugggagaaccacuacucucuucaaagcugucagacagggagguuuaacucugcagaaguuucugcugccuuuuguucagcuaugcccugcccccagagguggaguccacagaggcaggcaggccaccuugagcugcagugggcuccacccaguucaagcuucccagccacuuuguuuaccuacucaagccucggcaauggcggacgccccucccccagccucgcugccgccuugcaguucaaucucagacugcugugcuagcagugagugaggcuccaugggcaugggacccuccgagccaagugccggauauaaucuacuggugugcuguuugcuaagaccguuggaaaugcgcaguauuagggugggaguguccugauuuuccagguaccaucugucauggcuucccuuggcuaggaaagggaauuccccaaccccuugcacuuccuggguaaggcgaugccccgcccugcucugugggcugcacccacuguccgacaaaccccacugagaugaacccagugccucagauggaaaugcagaaaucaccugucuucugcaucacucacacugggagcuguagacuggagcucuuccuauucggccaucuugggaccauccagaaugguaauuauuaaaaagucaagaaagaauagaugcuggugaggcuguggagaaauaggaaugcuuuuacacuguuggugggaauguaaaugaguucaaccauuguggaagacaguauggugauuccucaaagaucuagaagcagaaauaccaucugucccagcaaucccauuacugggcauauacccaaaggaaaauaaaucauucuacuauaaagacaaaugcacacguauguuuauugcagcacuauuuacaauagcuaagucauggaaccaacccaaaugcccaucaauguuagacuggauaagaaaaugugguacauauauaccauggaauacuaugcagccauaaaaaaaugagacuauguccuuagcagggacauggaugaagcuggaagccaucauccucaguaaacuaacacaggaacagaaaaccaaacacuguauguucucacucauaagggguaguuguauaaugagaacacauggacacaggggggugaacaacacacaccaaugccuguugugggguggggaaugaggggagugaacuuagaagaugggucaauaggugcagcaaaccaccaugacacacguauacucauguaacaaaccugcacacucuguauauguauccuggaacuuaaaguaaaaaaaaaaaaaaaagaaaaagaaaaaaaucucaguacaaaagauaugucucauacaggaacaaaaacaaaacaaaacaaaaaacaauauuggcuuuguaucuccaccugccugcaucuacuuuuaccacugaauaccucgcuauuccaugcuaugagaacccuaugauucaguuauaucaaaugauuugccaugcucugaagucacccaacuuucacuuuucauauuugccuuucuucagugauaugguuuggcuguguccccauccaaaucucaucuugaauuguagcucccagaaguccuacaugugggagagacccaguggaagauaacugaaucauggaggaaguuuuccccguaccguucucacgguagugaguaagucucacaagauaugaugguuuuauaagggguuucccuuuuugcuugguucuuauucucucuugccugccaccauguaacaugugucuuucaccuccugccaugauugugaggcccccuggucauguggaacugugaguccacuaaaccccuuuuucuuuauaaauuacccagucucggguaugucuuuaucaguagugugagaaugaacuaauacacucagcuugaguugcucuuccuuuauauuauccuccaaaaaguuucuacuuauccuguaagguucaacugaagggucagcauacugauauauccucuuuuaacuucuggacagaguuguguaucuguucuauuaugcuucauuugagcccuaccuauuucuaucacagcaagugucacugaacugugaauauccacuuccauuacaacggaguuccuugagugaaaaauacauaauaccuaugaguaauuaauuucugcauggcauucaugcagccauauucauuuuaugugcaucauuuuacuaucaagaguuaaaauuaauggucagugauuuucauuucuugcaauuuuacuuccuuagccagcauagguuccuggcaucauuucuucucaaccccaacagaggcucaauuccaguacugacuggaaugcuuuucaugcaugaagaauauugaaaagagcucuuucuuacuuucaugucuuauuuaaacauguuacuugcuuuauuuuuuaaccuuuaaugacuaucacuugccuuauuugucacauuuggacuaaauaaucauuucauuuugucagccaguguuaauucuuauggcuuguuauugaaacuaagcaaauucaauguauagcaugaguaagaugggacagagaaaaagggaacucugaagaaagugagcuauugacugugucccuacaaaaguagagaucaauauguagguaagagguaggaaggaaggcugagaagaacagacuagaaaggcagugaagugagacucaagcgauuuaaauucucaucuugcuucacuuucaacuucuuguauaauauuuuuuuuccucuuugggccucauuuaucucauuuguuuuuugagggcgauguacuuaagucuuuuguauagcaccaguaugauuuugcaauauccacacauaauuguauuaguauuugcuuaaauaaaaauuaaacuagugcucuuaacuuuaugccauucccacaauaaucauaagcaaugauaucuauauaauaaaccaaguuaaugagcuauuuauuuuuguguguacauuaauuacauggacauuaauuuuuuaaguccauccuauacaccuaaaauaacaacagcugacauuuaucuaaauuuugcugggugccaugugcuguucuaagcuauuuauuuguauuuacucauauaaucuucacaacauccauuuuaauacuaauuuuacaggugggaaauuguggcacagagaaguuaaggcuuuauaaaaagccauguagcuuguaaguggcagagucaggacucaaacucaggcagucuguagucacacuugggaacaaugaacuagaagacaucuaggguccuuuccagcaucacgacccucugauuuugcuuuucucuggagcacacucuucucaguuccuaagagaguauuuuauuucuacuuagcuuaauaagguccuuucaaauagagucuauauuaggcuguauuugauuuuuagccuuuucacugucuuuuaucuccucacaauuacauaaaauuguucacuuagccaguuaugaacaaugcagaagucaaauuucauugcagucccagaaaucacuuuaucuaaaaguacuauaaaaaacauucauucuugacuaugaagaggcuguacaaaguuaccucuuuucaagagagucagucugcccuugaaacuuaguaauuuacuaaccaucauuuuuuuuucuaaaaagaaauaucaggcacagaaauuuagaguugaaaggagcuuagcuguuaugugguccuaacaccaaacauugaaauaucccugccuagacucccugaauguuggucauucaccuuuuggagaagaaucuucagaaagugaaauuacuauguccauuauuagguguuccauucauugguaaauacaccucauucccuuucugaaaucagauaugccguauauguacaguauguaccacauaaugauauuucagucaaugauggacuguauacacgaugguggucccauaagacuauaaugaagcauauagggucuucaaaaaauucauagaaaaugcauauuaugaaaaaguaugcaugaauuuccaauuuuuuacacaaaauaaacucauacugaacaggaucuaguugagucucuaagaaagaugagacaucaguuugaaaagagccccuaucacagcaacaugaauccugcuaaaauugaggcaagaacaaacauugaauuuacacugaagcuugggugugagaauggugaaaucauugaugcuuuaugaagaguuuauggggcuaaugccccaaagaaauuggcaguuuacaaauggauagcucauuuuaaaaaggagugagaagauauugaagauggcaccugcaguggcagaccacccacaucaguuugcaaggaagaaaauucauuuuuuccaugcucuaacugaagagggucaacgauuaacagcagaaacaacagcgaaugccauagacaucuaaauuuguucagguuacacaauucugacugaaaaauuaaagcugaacaaacuauacacuugaugguugcuaaaauuguuaugcccagaucagcugcagacaaacggaaauuuucaauaagucggaucaagauucugaagcauuucuucaaagaauuguaauaggagauggagcaugguuuuaucaguacgauccuaaagacaaagcauaaucaaugcaauggcuacuaagagguggcagugguccagucaaagcaaaaguggaccaguguauuagucuguuuucauacuacuauaaagaacugccaaagacuggguaauuuauaaaggaaagagguuuaacugacucacaauucagcauggcucggaggccucaggaaauuuaaaaucacagcagaaggugaagagaaagcaaagcaccuucuucacaaggcagcaugaaggagaagugcugagugaagugugaaaagaguccauuauuaaaccaucaaaucucaugagaacucauucacuaucacgagaacagcaugagggaaauugcucccacgauucaauuaccuccaccuggucucuuccaagacacauggggauuauggggauuauaauucaagaugagacugggguggggacacaaaaccuaaccauaucaaccagucaagagcaaaugucauggcaacagguuuuugggauacucaaggcauuuuccuuguugacuuucuggagggucaaaaaaugacauuaucugcuuauuaugagaguguuuugagaaagguagccaaagcauuagcagaaaaaugcccagaagcuucaccagagaguacuccuccaccacaacaaugcuucagcucacuccucucaccaaacaagggcaauuuugugagaguuucaaucagaaaucauuaggcauccgccuuaccauucuaauuucacuccuucuucucucuguuuuugaaucuuaaaaauucuuuaaggacaccuguuuuucuucaguuaauaauguaaaagagacuacauuaacauuguuaaauucccaguacaggacuugagggaugaacuaaaugucugauauuguuacguaaaaagugccuugaacuuaauggagcuuauguugagaaaguuuauauauuucuuacuuuuauauuuuaauuuuuuuuuuacaaacuuuuugaaguccccuuguuuaaagaaaccugauauauggcacuugauauuagcauugcaguucaaguagggaaaauaguugauaugcaguaauugugcugagagaguuuuccacauaagguggaugccuaaugacaauuuuccacaugaaaacuauauuuuuauguauauuugaugcagaugaaacauauauaaaauauaaaguucacaaauacuauaugaacaucauagaguauauguauacaaaccuagauuuuauauauaauauauaauacauaauuuauauauuauauuauaauaaauauuauauauauuuauauacaauuauauauaauacaauauauaauauauuaauguuauauuauaauauaucaauauauauuaauauaacuaauauaauuaauauauuaauauacaauaauauauaauauauaauauauaauuauauuauauauuuauuauaauuauauaauauauuaucuauuauauaauauaauuuauaauuauaauaauuauaauuuauuauaauuauauaaauaauuauaauuuauuauaauuauaacauauaaaauauguaauuauauauuauaauuacauauuauauauaauuauauauuauaauuacauauuauauauaauuacauauuauauauaauuauauauuauaauuacauauuauauauaauuauauauuauauugucuauaaauuauauauuauauauuauauuauaauuauauauguaaaauauauauauuauauauuauauauaaaaucuagguuuguauacauauacucuaugauguucauacaauguugaaauugcuugcugauguauuucucaggacauauccccauuauuaagcaacgcaugacucuguguguuagggagguauauguaucccccccauauauauaugccacucauuggucuuaccuuguuauuuucaagcaaaauaaaagucgguuuucuuuuuccaaaaguuguauauauuuauauaauagauaauauucauuuuaguaaaauuaauaucuuuucauggaagauaauuuagaaaaguauuaaaaugaauacaaaucauccauaaucccagggaucagcacuguugcuaauauuuuuauauuuucuucucuuaaugugaacauauaugcauguacuaguauucugaauauaucuauuuuuaaacuaacgggauuauuuauaugauccuauuuucuguguguggugaggcuccuccugauacucuacuacauacagaugaauaaauuuuuaauaauuuuuggggaaaaugaagaacaucauaaagguaagggcaucuacuuccagacaaaaugggauaacugaccaaaugugcacuccuuccuaaaauaaaaagugaaaauauauaaaaugauaauuugcaagacacugaaaagcaggaaaugaagggccaaaaucucugagaaacagcaaacaaguugaguccuauauuugccccaguuuauugccuugagagagucucuaggcuguagugcaggagaaggguaaccaggagaugaacuugacagucugagaagacagagguaaacagaguuguccagauaguaucuaacggggugagcaaaacgucgaagauccauagaggaacucccucgaauauucagugcaugcaugugaggaaauaacccaacacugggggaaaaaacaccuaaaagaauuaguggcaagacugcccagugcccacacaggaccaggaacagugcuugcucccauuagucagauuagaauuagguggaguacacagaagguucuugccucaacagcaggaaauaauuggccuuagauuuaguauugcuguguucuggccuaacauaguuaaaaagaccccaaaagaucaaaauguuuccaaguaagucaauuucaucccaaaaaagcccucaaaaauauuuauagaaauauaaaaauauauccaacaucaagcaagguaaaauuuaucaugucugguauuugaucaaaaauuacaagcaugaaaacaaguaggaaauaugacccaauuaagaaauauaauaaucaaauuugaaccagaauugacagauguuagaauuggcauaugagaacauuaaaauauugaaacuuacaucaaaacuguguuccauauuuuaaaagauaaguagagaucugaaagauauauaaaaagacugaaaaaacuucuggagauaaaaauucagucuaagaugagaaacauacuggcuagaauaacaaguaaauucagcaaugcaaaagaaaacauacuaaugaaaacuugaaaacauggcaacugaaaauaucaaaaauaaaacucagaaaaaauagaauccaaagaaaaaugaacagagccucagugaacuauggagcaacuucaaguggccuaauauauguguaauuggaguaacugaaaaaagguuugggguaugaggacagaaaaaaauauuugaagagauaauagcugacauuuuuccaaauuugauggaaacuauucuuauuuuucauuuaacauuauguugucagaauucuucuuucuuucuguguaucaugugaaaacacaguuccugaagacuacaaaauucccucccauggauguuuuaugauuuauuuagccauuugugccuguacauuuugauuaugauuuuucauaauuauaaaugauguuguaaugaaucuuuauacccauaaauguugaucugcaucugauccuugagauauauuccuugaaaugaguuuacaggguaagguucuacauauauuuuuagagucuugauauauaauuuuaagccauuuuccagaaagaucauauaguacuuguacauuuguacaguauauguaguaugcauuguauauuuuaccacauucuggucaacaaaugucuuuauuaaagaauaaaaagauauuacugaaaaagacaaacuuagcuacuuuuguagguaaaaauuauaagccuuaaaaaucugcauuucuuauauuauuaauagcuaaaauauuguucauguucauugcaaaugccacuucauguccuuaggccauuuuucuauuaguuuuaaguguuuuucuuacaucaauuucuaccagcuguuuauauguuaaggauauuaauauuuuauauuugugaugaacguuuuucaaagauuagacaaaaucuacauguuuacaucauaugauguauuaauaauuuccagagcucccacccucuuuaaagugcauucacauuuaucauuguucuuauguccuaaacuugcaucuauuucucccuuaaacugauauuuucuauuuugguuacagagcccaaaccuaagaauuaaguguacacuaauuucauguauaucagaaucuguucugcuuaauucuucaguucaccuuaucuaaguaauuucucuuucacaucauaagagaauuaaaaguaauuaagauccaauccaagggcuauggacuaggguaaagccugugguacaacuuaauggaagaaauauuuucuuccuuaggaguucuaucaguuauacuugagcccauuguucuugaaagaguuaaugucuuauuucuaaaauaugucuauuauagauucaaguaaauccagcuacacuuacuuaaugcacauauccaguacauaagagaaauggaagauuccuagccugagugccaggaaaugcaguuuagauauggcccugccaucuuuccagaacuugauuuccuucccagcuacaaaaugagauccaaaccagaugauccucaggaaccaauccagcucugaaauucgacaacuuugugauuguucuauaaaacaaauauuacauuucccuccaaaggaucuucugggauuauuugcaucuguuuuagaaagauuggaggugggaaggggucaauuuuuaauggcugcagguguuuuacaaaugucaaagauacauugcuugcacugauagcuagguuuaaaaucuucagaaaauaaaugcauaauuagauguuuccagcauuuauauagugaaucuguucggucuuucaugcuucaaggagcuaauagaaccuaaugcuuccuuugaaaucaguggaagcucuaaacccaucuaaugugcuagcuuauaacuaacagaaaaauugggucaauuuuuaucccacugaugaaaaauaaaucaaacaaguguaucuuuuaaacagcauguaaaccauuuaauacuuaguguacuagguuaugugcauaguuuugggaaacaugaaagugugugaccaaacagacuucaaauacaucauuuuuauacauucgagggugguuauuuaaacaaugcauugaugaauccauuggauauugcuaggggugggaaaaaagcuuuguaaucacuugcauccaaauaauacaaguuuauaauuuuauuuuuauaaacuuuaugauuauaaucauauucauguauaugaccgugcauguguuacuguuaauaacaacuuguguuuuaagacauaaaaugguuuuauaauaugcucauggauuccuggauugaaccugacaccucuggguuuacuuaacguccuaaaaaaagaaacaguacucuaauauggggcuagauauuacugaaaaagucaacuaguagcaguaaaugucaaaauucaccuuaaaauggcaucucuaauuauaagucgacaguagcaaagcauuggcaguuuccaugauauuacaugcuuuacaaccuccugcagcugccagccaaaucuccguuucucuucuacauuugcuuuuccuucaugacauuuaaucagucaacaauaugaacgcuggaguucuccuaagccacccuacaguuuaaaauccugacuacuucauguucuucugaaaguggggcggggagagcagcaagucuuucagaaugagaucuguacuuaucgaucacagcaucagcagggaaauuggccuuuguaggggugaaugugguucguucacugagaaaggaaaaacuauuuuggguuaaaaugaaggcaaaacaauucaggcagcugaagaggcuucugaaaacuggaaagauggaauuuccaggguuugggcaaugaggcagagacuaaauuuauggaaagcagacaggagaacaacuucagguuagucuaaaaaaggaaucuggagagagcuuauguagagaaaaaucacacagacugaaucauacguggggaaugaauagagggaaaaccugacucugggagcugcgauuauagaggaaauaaaggcaguaaagauuaaauaucagucccuaacacugccucaaaaaagccugacaauauauucacagcuggguauaaccucugcaggcaccacuaaguaguccuuccguucuauugaguuccuuccacaguuuguuccucccuuaaaccucucaugagaaauccuuucccucgauaugcuguauagcguguuaaaguguagucugaggaccagcagcauuggcaucuccuaggagcuuauuagaagugcagaauuauggcuccacucaaaucuacugaaacugaacacaauuuuuccaagaucguagaugauucaugcgcacauuaaaguuugagaagcacugaucuacaacauauacgaugugcugucuaagacuuuuuuacugcauaucaaaacauaggcagauagauuacaacuguacaucauuuauucauucucuuaacaaauacucacuaaacacaggcccuauucucaaggaguuggcacuuugcuaccaguuauugaacucccuuccguucucugcauugugugaggugucagggcuagaaggauaaauauggcauugucccugcccuuaauuagaucauagauauguuaggaaauaguuaaugcaaaaaagugucaugguuuuaaugcuaaaaacguguaccuggcacugggauuacaggagaacaaguauuggagacauauaaggaagguggugaucaagguuuuuagaaauggaaaaguuuuuauagaggugagcugagcuuucaaaaaaaaaaaagcuuuuuuucuuuuuuccagguggaccauggggcauugugggcaggaugaaggaaggguuagaaagaaggguguacaagggagaggaaacaaucuuaacaaaggcucaagggcaagaaacagguuggccuauucagagaacuuuaaguaauuccauauggcuggaugauagguuuugaggaggguggauuggggucugguggucagagauaaggcuggagagcuugacaggggccagauuuagggggcuguauuguagccuaagcacuuugggauugauccuacagagcagcaauaagaagucacugaagguuuuccaguaaggcaauaacaagaucacguuuguguuuuagaaacaucacucuggaggauguuuggggaauggugauuagccaauuuggcugaagcacaaaguacacagagaaaaguaaaggcagauaaggcuggaaauguaaauuuggauccagaucauagaggauacugacugccaugcuuuguacuuuguaggcaguggggagacacugaaauuuucugagcaagagaaugcuuuagacugggaagagacuaaagacagaaggccaguuagaaaguuauugcaauaauuuaggcaagagguaauaagaaccugaugacucugagaauagaaauuaacagauagauucaagaagcaggugcacaauuauaagcacaguuucauuacucauuuuaggauaccacaauuucauacauaaaucagaucuuuauaaaugucuucauuuucacauccuaauauagcauuuacuucuguaccaaucacugggugagauacucuuaacguucuuugggucaccaaggaaaaaaucuccuuccuguugauuuaguuugcaggucccugucucaguuccauguggaagccgcugcaugccucuaagucacccaaacccaaaauaaaaauuuuguuacagaauuguucucuauuugccucuuugguuguuucucaacccugaauauguuccuaggaaggcuucuugguuauucuuuauucacuuucaagaaaauagccuucccuuuucccaucuccagccccuuuucuagucccacauuuuuuucacuuagaagcacugauuccacuaggugguagguagggagaucaaagucacauuuccaguucucaguuuuuuuuuuuuuuuuuuuuuaacaaugugaguaaguuguaggguagguacauguugaucgcauuucauauaccucaacugcugccagauugguuuuuuguaugauuuaugguuauggagcuuuauggcuggugugagguuauuuugaauuuauuuagaaagcucuuucaaguguuucaguuucacaucauagaauauuuauaauucugggucaggcaucauguuuagcuugacuuccaagauacagaauuccaaacagccauuugcuccucuaaauagauagauagauagauagauagacagacagacagacagacagacagacagauagauagauacauagauacauagauacauagauacauagaaagauagaagcacaguauaucuguuuccuguacaucaauuuuccugguacuggauggcuucauucuuucuaauucaagacccaccaggccucgagaaugauuagaaacauucaugcuuuaauauuaauacuuacaaaaucucccuguucuuaucugagcuuugcauuuuuguuaagaugcuuagccagaauggaagcugcccacacaaugcuuguauaaaaauuauacuugcucaauaauauucauaucuccacccacucuugaguggaacagaacaagcauuaugauaugcauguacacauuugcauaaaaauauaccauacacaaauucaaguuugcaugcccaguuccaaaugcacaccaccauagaaaugcacauuugaaaaagcaugcaaucucaauguccagacguuuuccucccuagagagugauuuuuuuccuaaaaugaaagaauaauaauagccuuaauuuauguaguacauuuuuuuccauucuccucccuuuacaagagaugagucaauuauuuuaugagcaacuuaaaaaagcauaaauuuuuucuuccuuuacguauggaguaaggcaaggugucccaggagacuaguuccucaugcaaauucaagggugaagugaaauuugucaauauauucuuccuuuuaugacagucuuuccuucucuuacagcuaccucaauucuuugccagccagcugagagaucucuauugaagaaaucucuuggcuaaucucccaguuucccaucucuuacuacaaaagguuucaauucacaaaacacaggcugacacaauccuauugaguccucgcgauggucuugcaauuuuguaaacucauagagcagauguuauauuuauuuaacaaacauauuuuccacuucuaagaguucuuucuuuuuucuauuuacguguuguauuuuuauuucuuccuaguuuucuucuucaguuuuaauuuuuuaagcuuuuaaaauuuuuuucauuuuuaauuuucauggguacauaguagauguauauauuuaugggguacauaagauauuuugauacaggcauauaauguguaauaaucacaucacaguaaaugagguaucccuaaucucaagcauuuauuauuucuuuguauuaugaacauuccaauuauauuguuuuaguuacuuuuaaguauacaauaaauuacuguugacuauagucacccuguuuugcuaucaaauacuagauccuauucauucuauuuuuuuuaacccauuagccaucccugcucccaccugguucccagcuacccuucccagccucuaguaaccaccauuuuauuaucuccaugaguucaauuguuuuaauuuuuagcucccauaaauaaaugagaacaugcaagguuaaucuuucugugccuggcuuauuucuauuaacauaauguccuccagucccauccauauuguugcaaaugacaggaucuuauuauuuuuauggcugaauaguacuccauuguguauaagugccacauuuucugugguacauuuucauuuccauuugucugcugauggauguuuagguugcuuccaaacuuucgcuauugugaauagugcugcaauaaacaugggaguguguagcuaucucuucaauauacuaauuuccuuuccuuggggaauauacuuagcaaugggauuucuggaucauaugauaguucuaguuuuaauuuuuugaagaaccuccauacuguucuccauaguggcuccaccaacuuacauucccacgaacaguguacaagaguuccguuuucuccacauccucgcuagcauucacuauuauugccugucuuuuggauaaaagccauuuuaauuggggugagaugauuucucauugugguuuugauuagcauaucucugauaaccaauaacguugagagcaccuuuucuuauaccucucugccauuuauacgucuucuauugagagaugucuauucacaucuuuugcccauuuuuuaauuggacuacuagauguuuuuuuccuguagaguuguuugaguuccuuauauauucugguuauuaaucccuugucagauaaguaguuugcaaauauuuucuccuauucuguggguugucucuucacuuuguuauuuccuuugcuaugcagaagcucuucaauuggauguaaucccauuuaucccuuuuuacuuggcuugcuggugcuugugggguauuuuucaacaaaucucugcccaguugaauguccuggaguguuuuuucaauauuuucuuguaguaguuucauguuugagacauuagauguaugucuuuaauccacuuugauuugauuuuuguauacaaugaaaaauaggggucuaguuucauucuucucguauggauaucuaguuuugccaccaucauuuauugaagaggcuguguuuucccaaaucuacguucuuagcaccuuuguugaaaauaaguucacuuuagauguacggauuuauuucuggguucucuauucuguuccauguguugguuuuuaugccagggaaaauauucuucauacaugaaggagaacuuggauauacuauucaaggguaaaagauuuuuuccuucagcacuuuaaauaugucaugcuacucuguccuggccuauaagggucuccacugagaagucugcugccaggcauauugaaacuccauugaauguuauuuguuucuuuucucuugcugcuuucaggauccuuucuuuacauuuggccuuugggaguuugguuauuaagugucuugagguagacuuauuugaauugaaucugcuugguauucuaucacuuuuuuguaauugaauacugaucucuuuaucuagguuuggaaaguucucuuuuauuauaccuuugaauaaacuuccuauuucaaucucucuucauccucuugaagaccaauaaccauuagauuucccuuuugaggcuauuugcuaaauuuuguaggugugcuucauuguuuuuucuuuuguuucucugauuguacauuuucaaauagacugucuucaagcucgguuauucuuucuucugcuugaucaauucugcuguugagagaaucuaaugcauucuuugguaugucaacugaauuuuucugcuccagaauuuuugcuugauuuuuaaaaauuauuugucuuuuuguuaaauuuaucugauagaauucugaauaccuucucuguauuaucuugaauuucaaagaguuuccucaaaacagcuauuuggaauucucugucugaaagguuacauaucugucucuccaggaugcucacugguaucuuauuuaguucauuuggucagguaacauuuuccuggauagucuugaugcuuguggauacccauccguguccaggaauuuaaguuagguauuuauuguaguuuucucagucuagacuuguuuguacccauucuucuugggagggauuuccaaguauucaauggaaauugaguaauguaauuuaagacuuugguuacugcagccauaucugcauuagggggcaccccaagcccaggaacacugagacuuuuagagacuuacagagguccagccuugguggaccugagagagaauugggugagaucugagagaauuccauggauuaucaggcauagaauuuuguugucuucuuuuacuuuccacuaacaaacauagucuuucacucugugcugagcugccuggagauagggaagcacucccuggagggcacaaacacuccuguggccaccuccacugaaauugcacugggucagaucugaagccagcacagcacuggaucuugcccaaggccuguggugaccacugccugacuacugaugauguucacucaaggcccaaguguucuuaagucagaaggcggugaauccagacaggcuuguguacuucccuucagggagguaagcucccacuugucccaggauggguccagaaaugcuguccgggaaccacagccuggagucagaauccuuaggaauccgcuugguacuauucuacugcagcugaacuggcaugcaagccacaagacaaaguccuucccauucuuuucucuccuuuccucaagcaguagucuccccuguggguaccacugccccaggcccauguuguguacuguguggcuauugccgauauucacucagggcccaaaggcucuucaguuagcuuguggugaaugcugccaggccugagucucuccuuucagggcagugggcuccccucuggcccagggaagguccagaaaugucaucuaagagcuacggccuggaaucugggacuuuaagagccugcuuugugcucuacuccacugugaccaagcuggugcccaagcugcacaacaaaaucuccuuuauucuucccucuccuuucuuaagcaggagucucuccucguggccagcucugcucagaauaugcugggccaugccagaagccagcaugucucugagucucacaaggcacguggcaaguacugccugguuaccacugauguuuauucaaggcccaugggcucuuuagccagcaggugaugaaucuugccuggaugauguccuucccuucaagauaguggguucccuucuggugcaggguauaucuagaaagacagggaagauagugccuggacugggagccucaggaguuaggcaaacugccuaagaccuuauuugacuguggcugagcuguuauuuccgaguugaaagaugaaguccccuuuacucucccaucucgucuccuaaagugaaaggaaggagucucucucagaacugugggcuucacugccuugggcugggugaggaguggugcaagcaguuccuuggcuggugucccacuaggucauguacaccccaaguccaauggcuuggaaccaagcaaagggcuaagauuugcccaggaauuacaguccuuguggcauagaccaucuuucaaguuuauuuaggacccaagggcacuuuagcccacagugguggggcuagccagaacuuggguuccacaagcuggaacggauaauuccccucugacuagggaugcucuaagugcucccucauaggcucuugcugacuucuccccuguguugcuuuccacuaugauggggcagcacuuaguugcaaugcaaaguccagcaaucacugcauucuuccucucccaaacacacaaauucucucuccaugccacacugcauugucagggaauggggcaggguugguguaggcaauucacagcugucuuuccuaccuucucuuuccuagauaugauguuaaaaccagguacugugauugcucaccuaaauuuugguuguuauaaaggugguuucuuguguggacaguuguucaauaugguguuccugaggugggggaguacaaucgcuggaggguucuauucauccaccuuguuccacuucucucccuauuucuucaagcuuuuagaaaguaucuguuaggauguauuaauuucauaaauuagcuuuugaaaguugauuuuguuagaugcauuacucaguuuuagauuuccuuauguauuuuugaauucugguuuucaggcgcccauccucccuacuucugccuugccccugaccuuggcuuuugacaguaauccuagauccagucuccacuuucgcacaaaacuuuuaguccucuaccaaacagaaacugagacucugcgucagaccauaguaguuccuaggucucaauccuguauacuucuuagguuucuauuccauuugagggucacugaaauguucuaucuugcuuuugaacuuggcccugucuuuuagauuuuuuagucuuaauuucuuucccauuguuauguauuauaaacuuauggggucauauugacaggaaguuuguggcauccucauuuuauuuauuuauuuuuaauuuuauuuuuguauuuccucagagaccuuuguucugaaccucauuuuacagauagaaaugaacugaaaaagguucauuagccugcuccaaguugcaaaccuaaucaaugguacagucugggcuaccauuuaagucuuucacuuggcucugaugaucaaaauuuauuucauuuuacagagagcugcucucagugaacugcugaucagcugugauaaagcaaaaaaaguaaauaacuuagagucagagaaccugaacucaaguucucacucugccaauuacuaguuucucuuggccucaguuugcaauauuguauaacagcaauacagucauguaucaccuaacaacagagauauguucugagaaaugcaucauuaggcaauuccaucacuaugcaaaacaaacaucaaagaguguacuuacacaaaccuagaugguauauauuuuuuauuuauauauauguauauauauuuucuuauggaaaaccaaaugccccaguaccauuaguaauaucaaucauuuccccuacuugaucugcaaugccaauauccaguaccagauaucagguuucuagauaugcucuauuuuaacauuaugacccaaacauugcuaugugacaaaugacuauauuaccaauuaccuuacacaguggucauaaaauuaauacaugugagaacuuuuaaaaaaaaugcaaagcacuauguaaaugugaaaguuuaaacagcuaaaagauuugucuuuucaaagauauauaaauaauauguguuuacuucugagaaauaauaaaauacagauaagcauaaaggaaagaaauuguuugcaauguaauuuagcaguguauucuucuagauuuaucucaauauauauauuuaaauuagcaacuuaaucgagcgcacuugucaaaauuuuaucuauauccaucuauacaguaauaaaucaugaaacugucuccucaagaaguuuuggggaaggguuuugacacaaaaucagguaaaguaacauuagguuauuugccaaauauagcauuaauugucuuaccuugauuugucacagucuuuguguucaggucucaaggacaaagcuuccauuuagaugaagccuuucaacaaacuauuuguggauuacucuucuauacuucaugguugcaagcuagagaauccucuuuagcuauuuggagcagaagugaaucauucuagguauuaauuagcucauggaaucuuuuggagugcuagagaaucaagcucagauguuucacaaccagaaacaaggcauccagcguuaaagccaacagaugaaauauccacgcacacuacccgacuauucuagaagaacugcacauugauuucacacaugaguaccaguaccuacaccuagauuuaagagauuucacuaaaacugucccuaaagaaccagacaucucuaucaccaugcuugccacauguggcuacugccuucucuguucccuucugcaucuaaauuugcucaguagaaccaaauucccaauagaaauguagcuucaaggaaaucuagaaauaaaguucuguuuuguucuguuuuaauuuuucagcucuaugguaggaaggugagauauaauggauacagaauggguaaucaguaagccagucugcaguaucugguaaguacuguaaguagguagagguaggcacuguaauuucccccauuuuacagauaaggaaauugagccuuagaaagauuauguuauuuggucaauaauaaagguauauagaaggaagcaaggauuucaacccagguauucugaucaacauucaccuuuuaacuacuacaauauuuaauaauuacuucauuacaugacuucuccuuagaagaauaugagugacugaagaacaauaauucuuucuaauucaguaaguauuuuucaguaucaaauucugggggcugcauucauucaaaacuucauuuagucauucaagacuuuuaauuaaauaccuacuaugugccaguacucuucuagagaccuaggaauaugguggugaauaaaacgcgcauaguuccugauaucauggaggucagcauuuaguguuagaguuaucaggugaaaaaguaugcauuaauuaaacgcgacuaaaaagauauaugaaaauaagagagcauuuaaaugggagauuuaagcuagcaggugcaggcaaagaaagauuuccuagggaagcuguuugaguuauagagaccuguaagaugaguaaguaucagcuagccuaagggacagguucugggaagacaguauuguaggcacauggaauaaauagaguaugagauguccuggagguugaaaggaggucaggggauugaaagaagucaaguguggcuaaucauagacaguaaguaaaaacugacccugcgauaagucuaaagagguagaaacccaaccaauguucauugaaugaauaaaggugugcaaucucuaguagaugguagcugugaugccuucuaaacuuccugcuuccacugagauuccaugauuccaaaagaggcaguauaucuuuguauauuuagaaaagaaaaggcgaggccagagugguaaacucuccuaaaauuaucaaaacauauugauagucuacauuaacacuuuagaaugaaucacuuuuguggaugcuauggauucugcaaggagaaaauuagaauggacccauuugucuaacaccuaaaaguaaaaugggaaagacuaacagaauaauuuagaauaauuaaaauuaaguagauuaguuuuuucucuucuucuuuauuugaccuuugagauaauguuuugucuuuaugaauaaagaaaaaucuuuagaaauuugccuaaagcuccuucucaaaacaauaaguguacagaaugcuuacaucaagaauacuauaauuuauuuuuaauauauuuuuaaucaaauagaaaaaaucaaacugcccuauuucugucaaaagaaaaaugugaauauauuccaucuauauucaguaggcagaauccucaaaauaacuaauaccaaauacaaguuuucaaaucuuucaaagauuuacauuauguauuccaaaguaacagcuaaaaucauauauuaacuuacacauauaucuuuuaagucuaccaauaaaaugugugaccauugaaacacauuuagugaugagcaggagccacauucaaugaagaaaauuaaguagcaguccagccucucuagacuacaugagaauagauccaauaucccaugauucacaauuguuuuuaaauacaugguuuauuucucuauuauuugaaguuuguuuuuuuacacauauaucugaacuucaaacacugucugacauuccugaaauagcuuuaauauuacuuuucuuuaucucauugccuucucucccaggucaauggacaaagcuuaaggcuuccagcauaaggcuaaucccuuuaucuguccucugaaucucauugucagcugcuuuuucagggaccuuacuuaauuauugcucuccucucagcaucuacaaccuuuuccucucaacuaaaucuuuacucucaccauauaaccaugcuaaaaucucugugcuggcaaaaacaaucaaagacaaauaauaaaauaaccccucaaguauucucuccucaucugcaauucuugucuucucuuuuauuuacauccaauauuuuugaagagucauugguaccuaccagcaauucuuucucaccucucacucaccuccacugcaaacuggcuuuuacccuuaugcuccaaugaaauuacuccugaaacugucacagugaccuuuuaguugcuacaugcagcgggcacuuuucaaguuggguugaucccucaggagcauuugauacuauuaaccagaaauuuccuggagcauauagaacuguaaggaacaauaagccauguucccagaaucaccacauggaagggcacccaauuaacacucaaauaaacuauucuuugugcacuaaauaaaccugcauuguguuagaccaaugggauuuauaaaacuguuccagcacauagcauuacuuaccuugacaaacacaugagucuuauuaggucauucuuaaucugucucccugauuacccaccauuccccugcugugaacucuaugcccuagcuacacaaaccacuguguguguauaugcauguguguguguuuguccaugcuauucuauucuuaauuccuuucuuccuauuauuuguugacacauucuuuuagucucacuuacagccuuugagaaagcuucccuguuucugacaagcauauuuacuccauuucaccucauauaucucucuuuguagcacucaugcuauuguaucauaauuguuuucugucucuuaagaauggauucuuagguuuuuggaauauguaaauuacaggaauucuaggcaugcuuuaucaaaacaagguugaaaugauaaacacugggcccuuacauaaaauuuuguaagaacaucagguucugacaaagaagaacgaauuugugguuuuauauuuuguuucccuuuaguuaaacccuagauaucaaagauuuauaauuucuuaaaaauaaaaucuugccuacuuuugggcaacaaauacaugaaccaaauauccuuuguaucuaauuuccuuagaggugauuuucuaugcauaacagaauuaucuuuugcaaauuauauuugcauaugaucagucacauuuuuuguauuucaaauguauuaauauuucaauuagcuaaaagcaauaagaaaaagauuuaucuagucugcuguggaagugcuaauauaauuuuaaaaaacaacuaagagcacuaauuuuguugucaauuucauauccuuauaauuaccucuuaaauaggcugcacuucucucaugguaaucacugcuguuuucaaauggcuugcaaagaagaaaagcauuuaagcuaacuccuagaacagaugaaacuauuuauuuugacauuugucggcuuuggaccauguccuuuccaauucugaaaaagacaaccugggaacuuacguguuuagaacaaauaauuuuaauaacuuuggaggugauuuaaaauggagccaauuuuaggugucagauaaaaugauccuaauucaucuuauaucaaagauacugggcagugacauugguugggguguggucaaauuguuacuaugccaaucacucaguaaaggagucugaaucgucaguggacaagaucuagagaucugagaaauaacuccuuucuuugcagcccucucuaugauagacacucaagaaugagagaaaauguagggucauucuuuuaggcauggucauaucaauucaaaggaagacaaaauaguuuaggaaguggauucuaaugcaagagauaguuuagaggaagaauggaaagugacguuaguauaguuuaugagguagugguuucaguuguuaaauacagauaaagagaacagaagaauauaaauauucuaaacuguaucagaaagaaucauggaacuuuaaaagcauaaaggacuuuagagagacaucauuuucguucaguccuuucauuuuaaagaggaggaaacugaccuuuaaaaagguuaaaucacuugacccagguugcacagagaguuagugaaaauagugucuguggguuccuaugguggggauagggaagaacauguaagggaagaaaggaagugggucucuuuucauucugauccagaaacgcaaauccuuuaaaagguaggcagaccuuuuuaaaaaaacagcuggcaucaccugcggagcugagccaaaugcugugguugguacccagccugagccuaaaaaaaaugcucuuuguaaaauuucucuuugugcacggauaaccuucacaaaauuaguucaugcuugcuuuuaaauuacuuugcaccuguccuaaucauaccugaagguggcaauguccuaagaguuacauaggguuuguaaaauugggcuacuggcauuauuuuuaggagcacucugccuuacuuaauuuggagaacauuuuuuuuccuacuaauuucgaugccacaugcuuuauaacucaacuuuaauuuuccuccaaagauauccaauuuauuauccuugucuuuaguguauauuugcuucaagagacagucuccacaaugcugauugggauaucauaugaauuccauaaauucauuuugaaguccuugguuuuagcuuauaggauuucuacauuuugacucacuuuucuuauguauuuucuugauaguuaccccccugccuaaacaauuuaacucuuccuuuucuuuuuuuaacuuagccaccucccuaaaugcauguauacauucucucucucuuucucucucacacacgcacacacacacacacacucucucucucucuccuccccuuccccaccaccacacacauaaaaucauaaaagcuguuuucccaaauggagagguaugaagcaugugagaggucuggagaagaccaggagucauaaaugugcacaagccaacuuaaaauauguuaugaaggcaucagcgagaaugucagaguaggagacuccaauagccuuacucuccacugaaaagcaaaaaacaaaacgaaacaaacaaacaaacaauucuggcaaaacugucagaaacaaaguuacugaaauucuggaaaaugggaugucugugaaauucugggauguuauuagaucauggggcagauuuccccuuugguauuguuuucgugaguuaucaaagaucugguuguuuaaaauguguagcaccucccccuucucucucuuccuccugcucuggcccuguaagacgugccugcuuccccuucaccuacugccagucaaagguuugcagcaaccaagagaauucuuaaucaagagaaagggccacuguaacccaguggaagagguuuauaguauuuuaauuuauuuguguccauccccaccauugcuggcuuaauggugguccugaagaaagcaccuuguucuaccaguguggguccugguaccagagggagcagaacagauuuuguucugaaaaaacugugguugccuguuuugaccuaucaggugguuuccugaaggacuaacacaggggacuugccuuuauuuugccuaacucagaacucucccagggcacaaacauggcugcacagacagcaucuauauaaauacuuaauagcaaaucaaccagccacugcuacgcccaugagacaaagaauauuagaugggauaaacaauaaacaaaacaaaaaacuugagaagaaggcugggaagugagaugcuugggggaguaagggcuuugagaagcuuccacauauucccagguaucuagaaggucacacacaugcgcagaacaggccacaugaucaaaugaucuugagaagauccuaaagucucaccuuugggugaacuucagacucugugaaagcaggaaaugaaguugaaggcagaguuguaaacugcuuagcugaguguuaaaggccugccccaacauacacacagagcccaguugcaaagacugagagaguuuuuguuuuauccaggcauuuaaggaaaucuuugucaaaucacuagcugaccauugaguuaguagaacagagauuucagugaccacagaggauaaaaaauacugucaguaaaaaauuagaaaagucacuaaacauacaaguacaacccaagacaaguagcaauaacaaaaacuuggggacaagaagaaucggauuuccaguuacuauaauauuuaaaaugcucaguuuuaaacaaaaagauauuagacuuccaaaaaaaauaauaaaguguggcccauuuacagggaaaaaaagaaaugaaugugaacugucccugaggaauccuagacacuagauuuacuagacaaagagauuaaaucaacugucuuaaauauguuuaaagccauagacaaagaaccaaaggaauauaugaaaccaaugucucaccaaauaaagaaggcagaaaugauauaaaggaaacaaauucuggagcugaaauguacaaguauaauacugaaauaaaaaaaucucuagaagguuucuacagcacuuuugagcagguagaaaaaaagaauagaaaacauauagauaaaucaauugaaauuauccauucuaaagaacagaaacaaaauaaaugaagauaaaugaacagaaccucagcaaccuuugggauaucauuaagcauaucuaccuaucuagcuaucggaaucccagaaagagaggagacagaauaauggacaaaagaccaaauaauggcucacaguauuucuacauuuuggcucacuuuucuuauauauucuucuugauaguuacccccuaccugaacaaaucgagucuuccuuaaaaaaagacaaaaaaauaaaaaaacuagcuacuuccccaaaugcaaauuuaauaaaagaaauaaaucuacuuauucaagaagcccaacaaauaccaaguaagauaaacuccaacagaucuaaacugacauauuauaaucaaaccaucaaaaaccaaagcaagaaucuugaaagaagcaagagagaaguaacucaucagguacaagugaucaucaauaagaauaauaucuuauuuaaacuauagaagacuuaagacagugaaaugacuuauuuaaauugcugaaagagaagaacuguaaauuaagaccuauauuaagcaaagcuauccuuuaaagaugaaggagaaauuuagacauucacaaauaaacaaaaggugaaggaguuuuucacuaacagacugguacuguaagaaauguuaaagggaguucuucauauugaaacaaaaacacacuagacaacaacuugcagcuacaugaagaaauaaaaaucaccaguaaagguaacuacauaggugaauauaacaaacaguauuauuguaauuucaguuuguaacuccucuucuuuuuccuaugucauuuagaagacaaaugcauaaaucaauaauuauaaauuuaugcuaauggggacacaaugugaaaacauggaauuugugacaauaacaacacaaacacaugggagagaccuauauuaaagcagaguuuuauauacuauugaagcuaaguggguauuaauucaaacucgauuacuuauaaauguaagauacuaacuguaauuccaaaaguaaccugaaagaacaagugagaaauguucagaaaaguaaaugagaagggaaccaaaagggauuacaaaaggaaauuaaauuaauaacaaaaauguaacuaauaugaaagacaauaauggaggaauuaaggaacaaaaagguuauaagacaucagaaaacaaauagcaaaauggcauaaguaaguucuuuguuaguagcuacuuuaaguguaaaugaauuauacuauccaauuaaaaggcagagauuagaaaaugauccaaauauauacugucuacaugagacucauuuuagauccaaagacacaaauagguugaaaguuaaaggauagaaaaagauauuucaugcaaagaguaaaaaaagaaaaagcuggaguggccacacuaauaucauacaaaauguacuaagucaaaaguuguuauaaaagaaaaagggaggcauuauauauuaauaaaagggucaaucccucaggaagaugugacaauuaaaagcauacaugcaccuaacaacugagucccaaaauauauaaagcaaauuugacagaaaugaaggcagaauaaacagcucuacaguaaucauaggagauuucaauacccuauuuucaauaauggauaaaauaacuauacagaaggucaauaagaaaauaaaugacuucaaugauacuguaagccaacuagaccuaauagagaaauacagaacauucucuggagcuagauauggaugauggauauacaacacugugaauauacuaaaugccaaugaauuguauaauuuaaaauguuuaaaauggcacauuuuauguuauguauauuuuaucacaauaaaaaacguuuaccuauugauaugguuuggaucuguguccccacggaaaucucugucaaacuguaauccucaauguuggagguggggccuggugggaugucauuugaucauggcgcagaucuccccuuuggugcuguucucaugauaguaagugaguuaucccaagaucugguuguuucaaauguguagcaccucccccuucuuucucuuccuccugcucuggcccuguaagaugugccugcguccccuucaccuacugccaugauuguaacuuuccugaggccucuccagcuaugcuuccuguacagccuguggaaccaugagacaauuaaaccucuuuucuuuguaaauuauacaggcucagguauuuuuuuuauagccgugcaagaguggaguaauacagcuauggacacucacaaggaaacaaugcauuauuagaagggauuaaaaacuaugaugaaaaaagagcaccaaauuauuuaacuuaauaaauccaucacuucuacaaacacaagacaacuguagacaucccaguucugaggcaggaggguauaagauaaaagaagcugcuaaaaauuaguaguccauaugaaaauaaaaacaaaagcuaaaaaguggaaaaccaugaaaaaguuuucugugugagaaagaaaugagauugggguacaaagguacugcuuuuuaaaugaagaauucuaaaaugauuuaaagcuuuaaacugugugaaugccuaacuuguuuuaacaucaacugauguuuaauauuaaugcaaacaucaauuaauuaaacacuccaaccccucaaauguaguguaggaaaaaccauacucacuucuuaggcucaguauuuucaaaaugauuggaucacauccacgucuuucugaaugcauucagcuacggucacuuaguucugcauugguuuugugucugucuuaauagcaaucacuccaaaccuaauagucucagucacagcucucaaguauuuuucucuuuucccaaaucauucucauuuuauuuugagaacuaucucccuuauaguaaucuagguuuaugagucauuuucaaaaucacaaagugcuuuaucauuccacuuuuugaaaaucucuagaauguaaguauuuuggaaaaaaucuugguauuuuccaccuugugagucugcugaugggcagccaguaaagucagugcuguugaauuaaaauaggcaacacaacaagacaagggacauuggucaugcaagucuuauuuccugaggcacaagacuuugaaaugagucguacagguuuuacgaugaucaacucucagaggccaaggcccacuaaacuaacuauauacuaaaaaaugagccauuguaaaggaauauuuucuuguaauuuuaaauuaaacuuuuuggggguggucuuuuauaauuuuuaauuuuggugguaauccuggaguuuauuugcacuauuuuuaguuuuuaacuuuuuuuuuuuauuuuugagaguuaugggaauguuaguguuucaaccugugaugguagaaaacacauuuuaaaauaagacagaccuggguuugaauuacaaagaacuucuaagucauguaagcauagauaaauuagugucuuuucuuaccuucgguuuucuucucuauaaaaugauaauguccaguuuuccuuguugucaugaggauuagaaauaauacagauaaaagagcaaucacgguauaugacaaagaacaggugcucaaauugguggcuuuauauuuauaguuaaagcauagaaguauuaaaguccucaugccucaauuagaccaguucuuacauuuuaccagaaaggaagcugagaaucaagaagagugaucugacauacaucaauaagauaaagcuagauaauuccagagauuaguacugagguuuccugcuuaagcaacaaucucuuccuucccuugggcucucuucacuauggaugaagucuacuauuuaaaggaaaguuuaaaauaauuuauugaacauaggagaaagcauaccucagaauauucggaaaugugacuuagaugcaccuucugagauugaaacuugaccaaagaugacccacauuuucugaagacuuugccaaugucugcuuguuagugacuuggaaaaaguagauacugaauaugaaaaguacaauuucuucuugcccuucauuaaaacaaaauaaaaacauguucuuuacuccaagacuaagucugaccugcuauuauauuugauaaauuaaaguucuucuaagauuaaaaaaaaucccuuuagcaaauuguuccagcuaacauaguacccagcauacaauaaacauuuaauaaauacuuguuggaugaacaagugaauguguacguucucauaaugcuaaugagaaguaaugauuaaaacaaaaguauaaauaagaaugacagaaacaucaagcauucugaugaggaucugggaggggggagucugcuaugagaacagcuugcucagacagagaaacaccaaacgacuucaaaaaaaaccacacugacuugaguucuggcauaacuaccucacugcaggcaacaaaaauucugcuuugccuuuaaucaauguaaugaaacugugccuuaacaugcuuccuuauuugcauaucucuuguaauccguguugcauacaauacaaaaagauuuauuauaaagaaauuaauauaucuugagaggccauccccaucaggcaaaagacccaucugaagauaaaaaucacaccauuuauaaaaaccuuagaaagaucuuacaaauccaugaauuauuuacuuaaaaacuuaaacauccagagauugaguucucagcucucauuggcaaauuugcuccucuaaacauuuccuaaugcacaugaaaacuauuucccugagaauccaguucucuaaguagucgaguuauagagucuauuauagauauaacuaaagauucucaauaacuuuuaaaaacuaaauuaugacauagucugaugaaggguacauuucaccuuauaaacugcuucauauuguaauucaaauuguaauuagacucuucaccccuaaacagggauguuauccccacaaguuucacuguacacaaaacugaaucacauuagcccaagccccgguuacccuucuccuaauuagaaucuuugcuucuccccaguaugaaucucacaaggauaccagaccaaucucauuagaggcaccacaguaugauguggucuuuagaauaagauauacaugggugaaauguggcuucacuccauuuuaucugugagcucuuggaugaaucucuuaucucccuuaugucucaguuuccuuaccuguaaaacugagauaauaccaaucuuauaaauuuaugaaggagaguaaauguguguguugucuguaaaaauccuggcauaugauaagcacauaauaaauggcacuggcuauuacuaucaucaucuuguaacauacugguuucucaugucacuucauacacaaaaaccacaauaagauacccaggucauaucaaauuaaauucaaucucuucuauuguguuuuuaaugcuuucuauauucugaccaguuucaucuucucucccagaauuccagagcauaaauuauaacucuggucaauuuaguuuccuuuuaaucuuuuucacuuagcaugucaauuccugcaugucaauaauguugcuauuauuuucuuucacuuugcuugcuccauuaugccaggaccuucacauuccuuaagauuuuagaucaugucccauccauuuccucuaugaaacagacucuuaaugacacuagcucacugcuuucuucucuagcuucuagggccaggucccuuagaggaacugggaaaggauggaauuucugugugauguacucacauuuuucucuaugagagccugcucuucuuucuauguaauccuaucacuuugagcauuuauuuuacacuguuauggaggccacuagugaauacuaaaguaauuuucuuuuccauugauguuacuaggauuauaguccaaagaaaggaugcaucuauguuuaugcaaauuaacuugauuucagcuaagcuucuuauuggcacacuggguucucuccugcuucaugcaagauaaaagaaguaucacaaaaaucuuaugaacuaacugguaaauauaaguuaaauaauagcacaguguauauacuaaccucaaagaauauuaauaaaugggucuauacaaccaggaaagagaucuuuaguuauauaucacuggggucugaaaugaaccaaugacccuuuuucuguucauuagagacaacaugggguaguguggcaagucucauauacuaauuccuggguucuacuccacauacucuguagaguaaagccuagaaaacauaugaaaauguuccuuguaugguuuuggaugcaccagaaaucauaaauauaguggucaaacuacaugcuucaaaaccaaagaucugaauucagaguuugucucugucuuuuuguuuguacgugauguuguacuuaccugaaccucacuauuuccucauguugaguguuaagugacaugauguauguauagugucucacauauaacagacacucacuaaauaggaaucauuuaucuauuauuuggaugaauacccaaaagaaaugcucauugaacccacuguugucacaccauuaagaaagagaaugaauacaauaaaugcuaaaaugacuuugagucucguacuacuaggccaaacacccauaauauuaacauggauaagauuacuaaguggauuuagguugcaaaaucaauugcauaaguaaaggauaggagaccugcagaauaauaacaguugacaggggagaaaaaaaccacccagaaguuuuuauugacuuuaaguucaguaagagauaaguauaugacucaaacaaucuuugggauaggaaauagaaaguugggaggguauuagcauauccaacgguguuuguaccuuccacagcucuuaguacaguagcuucuuuacagaaaaaacacaaaggcauuauaaugaugugugaugucaauaaaaggucaauaugaucacuguauuacuauuaauaacuaacaguaugauaucuaauacuuauugagugcuuauuuuaggcaauauaauaugccaaauguuuugcauguguuauuuccuuuaauugauaaaacauuuaucucaaaaucuuuguaaauaaccauuucuuugaauccccaauuuuaaacccagacagucugugaccuaagagagcggaauugcuaaaucaugauacuaacucccauuuaauaaggugacugugcuucagguuucauaauugguaaguggagauugggauagugcuagaauuauuuccuuggcuuugaugcuaauuucucugugcaauucacuuuaacaauuacuucagaucugcaauuugaaguauuugcagucuuauucauuguuuuccugccacaaauuuauuccuuaaccaaaguuuagguucauucuguuauuuuaaugccuuuuuaguugucuuuugacuaaaaggugaguaauacuaauuugggagaaucauauuauucagaauuagauaagccucacugcccugcaaaaagaagcucacuucuguuugcuuggcuuucugauuugguggccucugcauggagauucagauuucauuucucauuuacauuugucguuuugucuucuaauaguuugcccccuuauaauaccauguuugcuaauaacucugcuuucaugcuguuugccaaugcagaagggaauauuuuucuuuaauacauuacauuucuucccucccuacuuaagaacuauuuacccagcuuacaccauguaccuguccauuuauuuggaaugguauauguuuugggauccuuuuaucuccuuuccauauuugaauaauuauaguuauugaucucuguggcaaaccuacccuucguaguguuuuauuuauaucuuuuaccuuuucucagugaagagaaaaggauggaaauuauaauaaaauuauuaaaauuuauaaaauccagggucuaaucagaggacagaaacuacaauaauugaacaggaaaaguuuaauguauaaagaauuagcaacuacaacaggggauuagaauauugagggauuggucaguaaggaguaaaggguacucuuaaaauauacaggaauaacagauauaaggaacagccacuacucuagaacugauauagaugcccaacgaagacgcuugccuacccugaaggcugagaucuggaccuugucagggagggcacagccauggcuuguggaauggcaggcacugaauagaaugcugugccagcguaaguugcugaagaucugcccuucagaacuuuauggaaaucugcucucuagaaugccagggaaaacuguuuauaggcaugugucucucuggagucucuccucuaugaaauuguccaaagugggugcugcugaccaccacgcacuggcauugugcgagccugauggugcaguugcuguuuacacugaggagccugcugagagagcaugccagcaucaggaaggaaaauuccuuccuccugugcuucaauugaccaagcugaacguuguacacgcuggcaaaggaaaauauuuaaagggcucaucuccauuuuugcagaacaggcaauggaguauaaauuugcagaugagauacaauaacuugauaacugguacaccagguaaccuguauuuaacaggaauccuggagggccaucugguucaauuuccuaucuuccagcagauugaugccuaagcuaucuaagacagaugguuguuaaugcuauuaauauuuaaacaugaguucccuuuaaaaccugcuuuacucuuuaaaaaccgaagccaguuaagucuauacguguuuacuagagagaauuuuggaaauacuaaaaaauuauaacagaaaacuaaaauaagcuauaauuccagaauuuagagaaaacuaaugcuaguauuuugguccauauucuucuagacuuuuuuuuuuuuggcuacucauguauucauuuaaaacuuauuuagcaucuauuaggucuaggcacaauaguaauuguuagguguacagugacaaaccuaucaaaugccuccucgucaacugagaaucuagugaaggaaucaaauacaucuauuuauguauauauaaauauguauaauacauguaucuauuuauaacacuuuuuaauaauaaaauuggguucauuuuacauaugcugauuuggauucagcuuuauucauuuaacauuauauuaaaaauauuuuccauguuacuauaaguuuuuggaaagugucauuuuuuucaugacuaaauaauuaaauuuuaucauuuaaauaugguuugauuucccuuuuuucuauuguuaggcaacuuuuuagcauuuuaaauaauacacuuugcauuauacccaucccugcaugauaguuaacccuguggauauaaccaugcuccugaguuuaaaucucaucuccagcaugggcugagugauuuagagaaaaaacacuuaacuucucugacuucaguaagaucauaguaccugccucaucuggguguuggguggauaaaauaaguuuaauauacagaaagcaccuagaacgcugccugagaacauaagcuauuuaaguauuaguauuauacucaucaucuguuuaugugucugugucucccugagauguaauugccuuggugguuuugccuacuauuaugucccuaacacauaacacagugucuuguccaugguacaaaauuuaauacuuauuuaauaaauuaggugaaaaaacccucauauauaaaucacauuacuaguugaaagaguauaaacauuuuugaggaucuugauacuugcuaaauuacauuucagaaaaguaucaacucauauuguaacuacaauacaugauaagaaugcccuucuuagccugcucuuagacauuagauauuacaacuuuuuaauguuuucuauuuuuuucauaacauauugcauuauacugcugcuuuaauuuguauuuauucaauugcuaaugagguggaacauguuuuuccaauugaauacuauucuucaaauugucuauuuucuuucccaauuuucuacuaacauaaggauguuuuucuuacuaauuuuuaggaauuccuuuuauuguuaagauaguuaccauuuuuuuaauuuuuauauagguuaacauuuacuucuuaauuuucauacacugcuuuguggcauucagcugaucuuaauuuuuauguaguaaaacauauugauuauuuucuuuauaauuaguugcaugauuuuauuacuagacauucucccccauguagaagucaguaaacacaagacccauacuucauucaauguuauuugaaguuaacuauuuaauccauugaaauuuauuuuacccccucuaaauagugacuauucucaauaucauuuguauaauucauucuucccauaacauguugaugcuuccccuauaaaauaucaugguuuuuauauuuaguaggguuuuuauauucuauuaaguuucauaaauuucuacauucuacugguaucuacaauuuuccaagugguaaguuuaauucauuacauuuucauauuuaguagggucuuuaaacucuacuacuuuccauggauaucuagacccuacuaguaccacaguuuuuaacugguaaguuuaacacauucuaguaucuugccgggaaaaguuccugccugccccucacugugcaugugugugcaugcauacacacacacacacacacacaggcacagaauucuacuccaucacacaucauccaaacaacaaauauuauagaaugcccuauauguagucaggaauugugucagaugacaugaauagaacaacagguaaaacugacauagucccaucccuuauggagcuaaaagaauguggagguagaacuaaacaaacaagcagggaauucuacuacagauaggcuauccuagggcaaguagaguaugcuaugagcagccacugguacagccaugggggagaaagaaaagcuugccacagaagaugaaaugaaacuaaaaucuaaagugugugagauauaaagagaaauuggccaggcagaaacaucaagacaauaaugaaauaaagaaauugaucucucuaccccauuguucuuuucaaaauucuuuuaaauauauuucauccauuuauucauucaaguugcucuaaugauccaguaucucauuugguuuggaagcucgggaugaaauauugcucuguuauccaacuuuaugcauuuccucuauaauucaggcacuugauacaaacuagucuacuacuuuuauaucugguaucuacccuuaauguacauguuagcucccauuuuccuaccuuucucucuuguuauauuuaguaggauauuuuauuauuuaaguagauaguuucauacucauuauucuccaggguucauugcuuacuaccuauguggcuugaauaaaaccauaaauaauuacuuucuaaaaagauugaaagaaauauuuguaguuaagugugccaagagcauaaaaaauacagcuuauaaaaauaauacaauuauucuuucuauaggagugcugaggcuuaugaaaauaguuucuuauuguuaaaaaagauauaaaaaauguuccuuuaaaugaaugauuuccauauauaaucagcuuaacaauaucuuuaaaaauuguguucauuuacauagguaccacucaccucguguaacggggaaugcaaaauaugaugucauuaacccauuuugaccaaauaugccuaaagaaaacuaaugcuucaaguaucgaucaacauuuaacaguauuuuuaaucuuuauauauuuauuucaggcaggauacuaguuaauuuaguguaaaccacguuuaauuauuucuguuuauuuuauauauccugauaguaauauaaauaccaauuacacuuuuuacagucuuguuucucuauucuuuccaugguuuugguaaaguguuaauaguauuucauuacauguuuucacuugcagggcuugcuguagaauacagcucaguuuaaacagucaauuaauuuuagcagaacugaaauugaaugaugaaauauuucuaggcugagaagaaaacuacaguaaacucuuagcuuuucuacuuugaauuggaauuuuugcucuuuuucacuucucagagaauaccuaaucccgacuaaauaauuaacugacuggcagcaaaaugcauuaauuguggagaacaguaagcuggguuugacauccaucuuugucacuaacagaaucucaucauggcaagagucacuuaaugucuucaggucacacuauuuuauuauuugugaaaugaauuaauaggauuacagacucuucaaaguccuuacuaccucuaaaauguuaaaauucugacucuaccuuguacauaaaaagaaccaguaauuccagugugagugcagggguuucuaaaggccaaauaucgaauacuaaauaauauacuauacauaauugcaugauuuguucacaacuauucauccccucccucaucacagcuucucuguggacaaaguauauucccugaccacugauuuugggcuggucccugugauuugcuuugacuuaugaaauauugugaaagagacagugugguaaucccaagaaaggcuuuaagaagugcuacaugcuucucaucacuuucuuaagauuauguccucuuucauaagcacagcauguacaaaauagugguuuucuugagccugggucucucaaugaaaagauguguggaauagaacaacugacccacgccaagcugaaccuagucugagccacuugcaaacuugugggcaagaaauaaaucuuuguuguuguaagccauuaagauuuugcgguuuacuggagaucauucuguuaagugaaacacgccaggcacauaaaaacaaacacacauucucacuuauuugugggaucuaaaaauuaaaacaauugaacucaugcauauaaagacuagaaggaugguuaccagaggcugggaaggguagcugggggacugcggggagguggggaugguuaauggguacaaaaaauaauagaaaguaugaagaagaccuacuauuugacagcacagcagggugacuauagggugacuacagucaacaacaacuuaauugugcauuuaaaaauaacuaaaagaguguaauuggauuguuuguacacaaagaauaaaugcuugaagggauggauaccucauucuuuaugauguaauuauuucccauugcaugacuguaucaaagcaucacauguacccccauaaauaauauauaccuacuauguaaccacaaacauuaaaaauaaaaaaaauuaaaauauuuugugguuugucaucacagaaaaaguugacgaaucaaguacuagguguacuuuuuagaaaacugauaaaaacaaacuauuuuugaaagucucauuucaaacgcuuuauuaaguaacuccuuauuaucagggcuuuuguuccuuccuugaugccugguauuguacuguaucaccuaaauuaaacauaggaaagaagagaaggaaaaguauguugaaugggaaguuaauaaugugucucuaaagcuauuucucagaauuaguaaguguucagaguacaaacagaugagaaguuuggagucaaccuucuagcaguguugucaauauaucaucaauaugauaugguuaauaaacuagcuuuaauaugauucagugaaucuugucuguuucuuuaaauuugaauaucuauauggcauuuucaaauugauugaauaaauguauuauuaaaaccucuaaaaucacauaaucauugggauaacucgugauuuguuuacacuuuguaauagcacacugggggugggggaaaugaugaacauuugaccacauuuaauuucaaaggaaaaauuugaauauauuuucuguucgcauuuccuuaacauucacauaaguaauuaagaugacuaaauacuuauaucaguacaugaaagcaucuauggaaauuccaaaugccaggaagaaagugaagcaaaacauauaugccauguaggaagauaauuauacauuuuaaaaguacauuaucaauccaaaauaauuaugaagaaaauccuaauaaucgacuucauuguagacaauauccuaacacaucauaaggacauugcacagcuuagugaaaugagauagcauauugcuaaaaucuauuggugucuuaaaaaguggaggggauuuuaugacaacuauaaccuuagcaauuuuaucuauaccuauaaaauaacuugauauaauaaaaccuuauacucaccgccaacauuagacgaguuaaaauuuccugucagucugcugagagacuucauuauacauuaucuuuacauauauuaucucauauccaaucuucauaagaaagauccuacgagagggguucugucauuguccuuacuuuauagauaaggcaacugagguuuagaaacauaaaauacauugcccaaacuaaguggcuaaaggucagaaaauaugacuuaagaauuuaaauucuucauguuaaagugugccuaauaaauggaagagaugaaaaaguccuucaggucauaagcuuaauuugaagauauuaaaugucugucauauccaaaguuacauagauggaagcagaaauuaaacaagaacuugaauuuuuuauuacgguaucuuaacacauuuuacuauauauuuauaaaaauaucugcuauaaaguucuugaaauuuuauuuccaagcauguauuuuaccugcaaaguuucagggugauuuuuauagucccauaucuuaauaaacgcagucaaguuaucugcuaauuuuuacauuuucuccucugaagacagcucaacaaccucuaaaagauacauuuuaucccaguagggggucuaggagcauggaaauaauuaaguuuuaaaaugucuuuguuauuuuauucauauuugaugacuuaauuaagggaauuaugagauaaauacccaaagcaaguugaucuuaagaguaaauaauuauuauuuccacuagggucgaauugcacaucucagugauguuuaaaaauuauuguaacauggaggaugguuauagauauccuauuaaauugucaaacauauugcaaagauuaggcaaauuuuuuucauuaccucauuaugguuaaugcagauaaaagacuccuuccucuacuuagccuauaaaaaaaugcuuagaaacuaaauguuuagaagacuucacaaauuccacuuuuaguaaaaaagacaagugauagaauaggaagguaaaacuuaaaggagaaacuagaaacuaggcaguaaaggaagggagaaauuauagaagaaauuauuucccuuaauaacaaauauuucaauaaaauguauuuaguaaaaucuuuaacagacuuguucauuauuuuaccauugacuuaaguaaaaaagcagaugaaaugcuaugauuaacaaaugacaugaugccaaaggaaauaaauaauacagcguauaagugauacaggcuaccaagaaauuuaauaaggugaaauuuagaaguaauaaagacaacauuuugcauugagaugaaaaauagucagcauuccagcagaggcagauuuaccacacaggucaugaagcuuaagcuucaggacccuugauuuacaccaacaccuuucagagccuguaccuaauguauauaugauaauccuauuauuaaaggggaccucuaaaauuauauaagcuuccgaccuccaaaaaccugacuaugccuuuaaguuuuaauuccaauaggauaauacaaacuauuuaacucugaauccaacaaaccuuuaugcaacaaaccuuucagaucaaacaaggacaaauaaaaucaccauaacccauaccagagcauaucuuagagacagaagccaacuuacauguaaacgggagauauauucauuugagaccaccaaaguuggcuccagagcccuuaccuuagugagauggaggggacuuguauauauaagaggaaaacuaggcauguuuccaaauagauacaauuagccucccucucaccaaggggagggcucugaagccagcuuuggaggucuuaaaugaauaucucucccacuuacauguaaauugacuucugucuccaagaaugcccccaaaaggagagaguccaaucaguaccacccuuaaaguuuguaagauccugggcaaauauuuuauuuuuugcaggacuccugucuauauaaacaguuugauuaaagauguacugcaaauucauggacucaugcaaaguacagugauuuauuaaugaagaguuagaauaaugaguagacaagcaguauauauauauuuguuuauuguacauguuuauuguacaaucagugcacaugaagauucuuuguagugucugauuacugccuauuucuguucagauccagaaaccauaccuucauguucccuauugucauaugucccaugccuaacuacuuccgcaucucccaucugagaaaaauguagcaaugcuauuauuguuacugccauagcucuuuggaaacuguguguauuuaagcaacacagaccauuuuguaccuguaguucucuaauaucauuuacuuaaugcuguacauaauuacucaugacacugcaucaucuaucaugcacccuguggauucugacuucggugacucucuugaagguuguuauggcauugauggucaugaacgcaagucauucccagaguauuucagauaaugugaaugaugguuuguuuucuggucauguuuuuacugaugguaguuuuauaucauaaacuuaucuuccaaccauguguuuccucaacuauuuagaucaaaaccacugcauuacugauugcauugcugacugcuuuugauuauugcuauacucccaccuuccacaaacugccaccaaugaggaagauagacaaggguccuaggggcagugagagaagagacuuucuauuucuguaaaugaauguccauuguucauucagcauggcuuagaauugguccccccaccccaaagaacacaauaucacugcaucaauuguagaauacugauugaaaggauccacuggccaugcugagcaacaaucuagaagagucuuaccggaaaacagaaugaucauucccagaggacugcuugacauguggcauggagccugcagagggauugggguaagcaucuugggugccaguggcugggaguacauuggguugaggauaccuccugcagcuccugccgcccacaagggcugcccacaugggcagacacacaccagugagcauuaacacagaggcccaaagcucaagcccaaaggucagugacaaauaguugguagcccagagcucugaaacucauccuaugucagacauugagucacccaaguacauauaucagcacaaucugauagaccaauuucaugugaucccacaaaagaaauacugugguagccagcaggagggauccacuagccaggcugcucuccugaaaucaaggcuggccauggguccugggacaacucagaagggugugagccccagaguucuuacaggucagguggaugauuccggguauagagaguggagaguuguagagugccucaaagguaagaaauaggaacccgggcccauauggauggaucagggcccuuaaggcacagggccugaggcaaaaacuacacuucccugggccuaagggugguucuggguccaauucuaaaugagaaaguauucagaacaggucugaucccuggggaucagagugcugaaugcuggggagucagaagcaacuuagcgggcaagaccagaaguggcggucucuaucagguaccucuucugauggagaagggggcacucuaaauauuaauaguacaagaguuccuuggagguuugauuacaaaggagaagaaagaaguugcuuaaaauagggucguacugaaacaaaauuguauaaaaaaauaagaaaagaaagagaauaauaaaaaucaacaaaugaaaaaauaaacaauuuuuuacauccuuuacaugucaacagaaguagcccuuggacuaagaaaaucagcgucacuggaccuggaucuauuugcccuaagagcucaucuuuucucuucuucuguucucuguauuacagggggcagcccccucuggacuguguuucucuagacucccaaaucagccgggcucugggugggcuugaacagccauuuagaagcacuugugcaagacuggaagguguuaggaagggagaagucagggguauuucucucccuuucuuucugccuugggaaguaucuccauugaugacugucccuuuuuuaugguuccauuauuuccuugguuuucuugguucccgggcucugauaaccaccauuuccuuuugucucucagccucaggacacuaauggcuucuugcuuuugcuagccuguaggucaccucgcugcccccaguauggcuccucuauuauuucaucaucuguguaacuaacucucugcuuuauaucccuguguuguaaaccucuauaauuaaaacagugugguauuggcccaugaauagacagaaggaugaugaaacaaauagaaaguccagaaauagacccagguauauauagaaauuggguauaugacaaaguuggcaucucaaaucgcugggaggaaagaugaucuuuagaauaagugauauugguucagcuugauagacauuuggaaaaaguaaaaaaaauugaauucuaucuuauacauuaucucaagauuaauuuuacauaaauguaaaaaauaaaaccauauaagaucuagaggaaaacacagugaaaucccuuauauccuaagagugagggagccuuucuaacuaugacucaaaauacggaagcaauaauggaaaagauugagaaauucaacuacuuaaaaaaaagaaauggccaaaaaaaaucaucauaaacaaaaucagaggacaaaucacaaaccagaugaaaauauugcaacuuauaucacaggagaaggucuaauccaguguuucuaaagcucagcacuacugacauuuggggauggauaauucuuuguuaugggggcuguuuucugcacugcagggcauucggcaguacuuuuggccucuaccuacuaaaugccaauagcaccccuuucccaggugugacaaccaaaaauacuuccagacauugccaaaaaacguggggagaggagugaggagggaggcaaaaucauccccagcuggggaccacuagucuguucuaauauauaaaaagaucuuaaaauagugaaggaaaaauucaaaauccgaauagaaaauugggcaaaagacgugggcauuucauaaaaagaagagaaauggccccugagcaccuaaaagauugcuuaaucucacucauacuaagaaaaaugcaaaugaaugcuauucugagagauuucuuaccuagcagauuggcacacauccaaacauuugaaagaagucugugagcuacacauuacugauggaagugcaaaauggcaaaagcucuuugaaagagaauuaaucgguauuuuaaaaaauuauauucagauuuucuuuugaccuaggaaccccacuucuaugaauauuccccaagagagagaguuccaggagaacaaaccaacauauguacaagguuacuuacugcuguaaaaggcugcaaguaauucagauuuccaucaauagcaauaauggaauaaacaaugacauacuacccaaugaaauaccauaaugcagaccuuaaaggaagugaagacugucuuuauguauugauaagaaguaauggucagaauguauuaaguggaaaauucaagguucagagcagaguaugugugugugcuuguguguguguguguguguguuguaaaaagaaaauucuuaaaaaugauaacauagcggaugaaugggaggaauaaaguagggaauagauggaaagaagaauuuucugaguacaccuuuuuauauaauuuugacaucugaacuauguaaaugccuuauauaauuuuacaaaugaaaauagaaaaguuaaauccuaaaauuaaaaggaaaccagaauaaauaagccuaacucuauuuuaaauuaguaauacgacucggagagaaaauuauuucaagugacuuuuggcaaagcauucugauuauauuuuuaugacuacaauuuuaggauauacuguaagcacaaaaagugauucaaauaaauuuuaaauuucacucaauaguuuuguuguauuggggacacaugaauguaaagaugggaacaacagauacucgagacuacuagaggaggaggguggaagggggcaaagguugaauaacuacccacuggauacuauguucacgaccuaggugacaggaucaaucauaucccaauccugagcauuaugcaauauagccauguaacaaaccugcacauguaccccaugaaucuaauauaaaaguuaaaauuuagaaaaaaauaaaauaauuaaaaaguauuuaaaaauaguuuuguucucauuagaaccuacuuuauaugcuaggauaaaacaaacaugaaugucuuagaaacuaagauuuucauuauaaaagaaaagagacaauauaagaucaaaguuagaaacuuauaauauuaaaauuuaaucaaaauccuucauaugcaguaaguauuauauaugcauuauagauguauaaaauauaugcguauuuuuucuugcacuaucuguugucauuuauuguaaaacacugaacauauaaaaauucacaauuuuacagugguugagaaaagaaaacggaaaagaaaaaagaauaagaugaagagagugauagagagacacacgacuaucaaagcucacuaauaaaccaacuuuucacucuaaaauuugacaauuaaaaaaauaauucagaauaucgcaccuuuuugggaaaagcugucgccaauacccauuuuauuuuggaaagcucuuuauaagagauuaacagccaauaaacguagaaggaauaauauuauuagagaaucagaauuuugcaaucccaaugaaaccacuguucccaucaaggaucaucaaagaaugauaaacccuuacgugaaaguucacuggggaauaccugaugucauucccaacaguucauuuaccccacaguuuacuugcuaauugcaaagggcaaacagaccuugcaaugaagugaucuaguaguaaccacccuaaaagugauaaaauuuagcaugaccaauagagcgaagccugauauuuuaugcuuccuaaugugaugcaauauaagguacucagaaucaccuaugaaguaccauacucuugccaaaugcuuaagcuagaugugcccaagacuuuggaccuaauauccagguuauaaaaaguacagguauaaaaggacaaguuaaacaaucagacaaauauagaaugugauauauuuuacaagacaauugucaucaucucaacaaaaagucaguaucacaaaaauaaauguugguggacuguucuagacuuaaagaaacuugagugauguaacaaucaaauuaaauaagugaacucuggauccugguuugaaaaagcagcugcaaggucauuuuggggaaaauuggauaaauuagauagacagaugcuagaugaaauaggcugauuagauaucacuugauuaagaaauuauaauuuucucagugugcaagguauuacgguuaagagaaugcucuuuucuauauguauacugaaauauuuaggaguaacauuaucuccagaauuuauuuucaaauuuuucagcaagcaagauagaaagauagauaaauagacagauagauaaauggauagaaagauagauagauagauagauagauagauagauagauagauagauggacggacggacagacggacggacggacagacggacggauagacagacagacagagacagauagauagauagauagauagauagauagauagauagauagauaaaauauggcaaauguuaacucuugaauguagguuguugggugaugggcauacguuaauuacacuguucuuucaacuugacuguuugaaaauuuuaguuaaaaaauguggugaagaacauuguacaaauauaggaugagauacgauagaacauaaagaagacccuuauaaguguguaggagauuaguggggcaugauuguuauucuuagauuacuuaaggaggcacaaaaaauuagucuucagcagcuaacggcauagauaugauaggguugcacuagauccaccuucuagggccaaaaaggcacugguggagcugucucagcugucagugcuaacaacaaaguugauuagacaaagaucuauggaucuagagugcuuggccaugacuuaaaaaauagagagcauuuaggggaaauauuggcagggauagccugccucagcuauuauuguuauggcuuauggaacaugaugauggguacagcaccaagaaauccugucaucauggaccuacaaacaguaaggauuuaggcugaguuuuagcaaagggaauaaagaaagcagcuagaaacccaagaaggccaguggauccagaugaguuacuagaaucucuuuaaaagacaggcaacagacacacagacaugcaaugaauucaauaaaaauuauauagucacagcacauuuucccagucucaggagguuuuugcccucuggauggaagguaauuguuuguuaauaaguaccuggcuucacuacacauacacuaguuucagggugaaauauuacuuuaauuaacuaguugaaauuucacaggucuagaauuuaauuaccuguuggaacuguagcuaagauaucauggucucauaaaauuuuacugccuuuuaaaaaugaccauaauuuaucagaaucuugggggaaauugugcauugugcaugaaaacaacaaacauuggaauauaguuaguccuaagauugaagaagagacuuacaaguacuucgaugcacucuacugaaguucagaugagaggacagauucuguuucagugacaaagacaaacuggguuucauauucacuguugucuucaccuucugcuauagaguuucuggguuuuuuguuuguuuuuguuucuguuuuguuuuuuuuucuugcuaggcucccucaaaucaugggacaguuucugguuuuggaccccaaggaaaaucugaagguagaugaaguuguccuuugucaaacuaccccugcuuuuuuuguguguguguuagcucacuuuguauggcauuuagagccuguauguccuaaucuauuucuucauuaugcaaagcauugaauaguuucccagauucuaauuguccuugucuagguagcauguguaccaggguauuauauuuuacuguauguugucucuacacaugccgcaccagauuaggcucccaggaagcccuaaacucuuggugauaguuugauggaggaaggagaguaggaugaagccuuuccuagucccugagcuuuagugaucucuguaaacgcacaauuuaagagauaagacaugugagaagaaggguaggauuaaagaucugaugaauuaguugcuaaucuauuucuuaggcaaguaaauuuaucccucuugguaugugucaacuugucuaggucacaguacccaguauacacaugugcacacacacacacacacauauacauacugagagagagagagagaauuuacugguuuuguaucucugaaaaagccuaauacaauguacucccucaucugugagaaccuuccaaauucuucaguuuuacaauuucauaucuaaagaacaggucuuuguugcuaaauuacugccugaaaauaguuaagcucuaauuauuaaggaaaaaaacauuccugugaaaaauauuuucuuuccacuuauaaugcaaagguaaacuucaccaguauauaauaagaauaaauuauuaauaaauggcaccuguacuaauaauaaugcuuuacuauuuguuaaaauauuccauaguacugaagacauuuaacuacguuaguaaaugacccaaacuaacacuauuauuauuucuuuaaaauuggugacacagagggaugacuaggcaaagcauagaggauuuucagggcagugaaauauucuauaugauaccacaaugauggauacaugucuacuuacauauuuguguaaacccauagaauguacaacaccaagagugaacucuacuguaacuauggaguuuggguaauaaugguguguuaauguagguucaucauuugcaacacauguaccacucuagugggggauguucaugaugggggaggcugugcacuuguggggaguagggaaauaugggaaaucucuguaccuuccacucaauuuugcugugaaccuaaaaagaaaaaauaugucuuaaaaaaaaaacuaaugacccaagugugaauaaaacauggauuacauagaacuuaaggguuuaaaaucaacuugcaccauacugaaaccacuuaggguucuuaucaugcuguguuucuuaugauucguuuguaauuagucagaauauacugcagcuguuugugauuucagggaagaauaagauguuuauaaagagaaaauguuccauuaucucugcuuuuuaaaauuccuuucuuuguaaaugauauuuuaugauauguuuuccauccucauuucaaauccuaaacaagacuguuaaauagggguuugucauacauagaaaaauugcuacauauuagcuucuuuccccacuuccuccccuaguuuuauacauccauacacacacucacgcacauuauuuuuauaugcgacaauuucuggcucugcauaaaauguuacugcaaaaguacacugugucaaguuuuuucagcugcuuacauuccuacucugguaccagugccaggguuucagggcacuacaauuuccuuuauaucucagugguuauuuugaaauuaucaugucucaucugcacucccucauaauguaugccuuccaugucauauuaagcugcacucuuuucccugccuuaauucccuaauuucuggaaugauauuggaauugguuaugauuaaaacagcaagggucuauauuaaaagcaaguaucuuccucauagauagaucaugaaaguuugagguaccaugaaauaugaugugaaaaucaccuucuucaaauauccaagaagaucacuaguaaauuucaaguguagguucauuuuuacauauaucuuacuuaccccuggaguuccauagcagaggugguagugaacuugaccacuagugagaaauaagaggaacuaugggguaauuguucccaaggaaagggcaggaauaggccauuaugugcauguaacuguaaagagucaguagaugcaucaagagguaucguaugacaauuggaagauacagaaauaaauucccaggguuucaagauaauugggagaggaaaaaaggaaagacagugugguggacaucuuuuguuuuugcuugacuagaauccuccuucauuaguaacagcaucugagaaacuaucccuucccuauuagacggguaagagucucaguugcaauggcccauccuccccugaccaagaauguagauuugguccaauacaggcaagucagacacuucaugggauaugaaucuuuaacugaacaacacaaaggcugaaauuuuuuccagcugauuuaucucaaugaugguguuuuaaagagacuuuuucauuaguuucuucucccuagauaucccuaguugcuccaguuacugcucuuuuugaauacuuguuucauuuuuuguuuuuuuuuuaaauccugcuuacauuaguugcaugcaaucuuacaagcuuaacugacaaaucauuaccaacaaauuagauuucuuuagugacuuggcgaaagugagaaagaaaacuaccuuugagaaaggguggacuggauuaaagaaugaaaacuuucagccaaauaguagagaacuuugccuaagaaugacuuagaacuuugguccacuucaaggaaaggaaacuaagccagaauguaaaucaaugcauugcuucuuucauugagaaagucauguaacaaaaaaaacaccagcugaacuaaccuggaugcuuagugauguauuuggauuuacaccaugcugccaguuccuuacaauuucagucucaguaacccugaucuagcuuagguuguuuuaauccaaagaaugugcugauugagacuuuuuauuggaauaacuagaauuugacacaugauuuccagaaguauagagguucccagaaaauacauaaaugaauggaaagaauaguacagcaggcccuugaauaauguuguuucauucaaaugucauuucauuauaauguuggugaggaaaaaaaaaucuauucccaguuagagccacugucuguguggaguuugcagguuuuccccgugucuggauggauuuucucuggguauucugguuuccucccacaucccagagaugcacauguuaggugaacuggugugucuacagggucccaggcugagugaguguagguguuaauaugaguguaccccgugaagggacagcauccuguccagggugcauucccaucuuguacccugagcugcaaagauaggcuccgaaauaauagaguaaauaauugucuggcuuguuuuuauuaaucuuaaauguauguauaguucacauuuauuucaauguuuaauaugggaaguguuuuggucuuuauucagaaguuuggugauguuuuaguaaccagaaauaugccauagaagcuacaauuuucuagcugaacaaauuacagcaauauaagcuuucuuaugguuaucuuaaaagaucuuaugguuaucuaaaagaucuuaaaucacacaucuucuuuguguuucugguaugccaaguuuuguuguuuauggguuucaaugugaauuuguuuacuuauuuauuuuauuuuuuuaccuaagauccaggaacuauagaucaauguaaauuaaauaaaaaauugacuuggauucuuguccuugauuaaacugcaauucauguguuuuugaauuuuuaaaaguaaauuuucuguuguaaaguaauaaugacggcuaccucccaaugggacacauucuguuuucuagagucaaugaauucaaguccacuuggagucuaugaguuuggaucaccuuaucuuaaaggcuacuuggugaacagaguugaaguuuuaagauaauccguuaguugaguuaaaaaagcacuuggguauaucagggcuucuuaacuucagcacuacugacauccuagagcuagauaauucuuugcuguggacaguucuguacauuguaggauguuuucagcagcccuggucuguaucccuagaugccaguagcaaucuuccuuaauugcccaauaugcccugggaggaagggguaaaaucaccccaaguugagaaccacugguguauaucauugcuauaagggcauugguuuuuaaaccugacaaagcugagcucaccucucaggucugucccuuucuuacguugauuugggaaaguuacuauuuuccuugucugagaaauguugauaucuccugggaauucuugaagagauuagaaaauguacuuagcuucaugacucaccuauaguaaaaacucaacaaaguaaucauuguuaguaauaguaucauaauuccuaaauccuaaauacagauuuucugaucuaaaugugcaaauaauaacuaaucaaauuuccaacuguguuauuugacaaagguauaaugaacuaaaacucuaagacauguuaaaaaaaaaacccuaaauacaauaauuucuaaaugggacaaaggcuuuauagcuaacucuuugaacuugaaacuauuuucagaaaaaugacuggaguaauguugcuuuccauacauaacuguugaggaaauguacuaacacagacgagaucaaacugaaaaagaauuauauguccaauguucuaguccuagaaagaauacacacacuuccucucucuuccucuaaauccauagauguuagcagugaaagauacuaagaaaaugaagaacuagaacguggaauauugucacauggaacuaacauaagaaguaaaauguaaaugaaggaauuuuauacaugugcauuucaaaugaucucgaccacaaaaucagagaaaugacagacgaauacaugaauuaucaaaccauucgcuguucaaaaauaaacuucugaacuuuaguguuugcuuaauggaaaguucuuucuuuucuuuacucaguuaugaccucagacaugcaucagaacucaaugcauaugauaaaacauuaucaugccaacucuguggauacgaaaaaaaaugcaugaguggagugacauuuaaaaugcugauuuaaauuccuuagcauaaauuucaaccaucugggaauuuuauuugcuuuccucuuggauccuguugcacacucaggugagcauagcuguuauccauaaacgaacaguuguuuugaaggggcaguuguacagucucuuuaauaccaaguucacuuuaucugggguguucagauagugcuuucauuuucagguuuguggaaaggugaagagacaaaaagcucaaaugcuuuguuaggaaaugcugcugaggaaaggaauccugauuauugcuuugaacuucaaaguauaucaguaacagggucucuuaaaaggaagucucuugagaguucagauuacagugaauaaucuuagaaauguuccugaugaaauuaaauugcaugguucaaguaaugggcuacucucccauaugagccuugccaugauuaaaacugcuuuaacacuaaaucgcacauggaugccuuguaaauacaagauauuuaacaaauauuucucuugaugacagucucaucucaccucauuucagcaaauuaaaguaaguugccacggcuuuaaagaagucacacagcuaguuaauugcaccguuuguccaggaaacucauucuccugaaucaaucccaguacagcucuggguuggauugauuaaaucauggauacauugauuguuuuaaugaaaaaaguuuacauguucauuuaaucuaagacaaccugcaccuuacacacacacacacacaccccacccacacaccuaucuuuuuuuuuuuugagauggagucucgcucugucgccaggcugaagugccguggugcgaucuuggcccacugcaacuuccgccucccagguucaagcgauucuccugccucagccucccaaguagcugggacuacagucgcgcgugaccaggcccagcuaauuuuuguauuuuuaggagagacgggguuucaccauguuggccaggauggucucuaucucuugaccucgugaucugcccgccucagccucccaaagugguggauuaugggugugagccugaguuaacuaaaauguugaaaaguuaagggaauuggucauuauucuucagcauaucauucuugaacaaaaugcgguuucuauuauacucuggcuuuuguggggcuagcaguaucugaagaaacacugcagaaaacauuguagacaguuuuauuuccuaggaacaucaguaagauuuccacaauauaaaaacuuaaaaaaauauucagagcaaaaauaauuaaacuaccauaaaaguguucuuugccaacgaauugugacuaguacaaagcauucagucauaauaaaucuuuuaagcuuuucaaaagcaacuccagaagcuaaguuucaaaauuuguuuagacaaaagcaaauuuuuaagaaaaagaguguauauuuucuucaagcuacauugaaggcauuugcauguuuaaguaccagugaaccauuuguuuauguuuaaaaauguuuaaucacguuaguguuuuuuuaguuugauuuuauuuuccaaagauggcuacaacaauaucucccaucccauacuuucuucuagaaucuuguaaauuucccauuaagaaauacaaucugauuccugcccccuuaaaccuggacagguuugugacuugcuuguaacaacaauacaagauuucccaagcuaggucagaaaagguaguacaacuuucaccuuauagauggaauacucaggccauuccuagccuuuccagauggcaaacaauucuuuaauuaaaagagagccucaagucaaagaucaaauccagggugggacuauaagaucauuugugaagacuucaaaaagaucuaaggcuauaccucauagaucauuuaagaaccacaaaaggcucucugaggaucuuaaaaacaugccucauagguccucccuguuaaacaauauaggguuucuaaguaucuaaggaagugucuuucaucagacuuacagggaacacaaaauagagaauggauuaucuuaaagagauuugugacuguggcuuuuguuuaauggacugaaacccaaugagauucauagaaaauccacgaaguucuuaagaauuguguugcugaaaacacugccaguuuaaaagagaaggccgggcaugguggcucaugccuguaaucccagcacuuugggaggacgaggugggcagaucaugaggucaagagaucgagaccauccuggccaacauggugaaacccugccucuacuaaaaauacaaaaaauuagcugggcguggugacaugcaccuguagucucagcuacccaggaggcugaggcaggagaauugcuugaaccugggaggcggagguugcagugagccgagaucacgcacugcacuccagccuggcaacggagugagacuccaucucaaaaaaaaaaaaaaaaaaaaagaaaaagaaaagaaaaagagacaguacaaaaugaaaggaagccucugaauucuagaacugcuauaggcaggaagcaaacugagaagauuuaguuuuaugcauaggucacuuauuauaacaauaaagaaaagauuacucaaagaaaguaagacuccagagggcagagccaaaagucguggccaacucucagagaguagaaccaaacccuacugacaaaacuggcaacacguaccuggcuggacuucagaauuucuauuggccagugacuucuauguaccuauacucuuccauccauuuguaauggaagcaucuauugugguuaaccuaugcgucuggccuuuacaugauggauaugugggaggcaccaagaggaacaguacuugaaugcuuugcuuaaggaaacugacuuaaggagacucaacugcaaaaggaccuaacuuaauuagagaaauaaaagguuugcuucucgaggucuauuuacagacuaagaauuacaaaauaaaagaucuaguguauguggauuaauaauuuuaauaagcgaaagugguauguacuuucuaaaguauaucacaaaugugauauaaagagauaauugagaggcagaauaauguguuggucaaagugcaagcccugaaucagaauggauggaaucaaaucauggcuccacucaccucuaguucuaucaaugaaggcaagucaguuauaugcucugugcuuucaucccccauuuguaaaucagacaugacaauaguacuuaccuaggguuguugugagaauuaaauuagugagaauaugcaaaacauuuagaaaaguucuuaauaauuauagagauaauuuaccuacaaaaaucuaauugacaaugaugacuuuuauugcugaaaggaaggaaacuuuuaacuccucucaaauuacugggaguucaaaaaugaaucuuguugagugaagaaaauugcuacagaagacuuuggaagugauuacacaaguacaacauaguaaagcuagaaucuucugccacuugucaaaauaaacuaaaaauagaugaagaauaauaaacacuaaguugugaauccuagugucuacuuacgauaauuuaaugacaauaaaucuaggcagaucuacuggguuaugcuaagacauuuuccuagcuguaucuaauuugauugacuuuuucuguuuaauuagugaauauuauaauuauguguucugaaaguuguaugaauuucauaccaucaaauagcacuaaugcaaaauagagcaaaauaucaagacuuagagucucuuuugugaacuugccuucuugcaaagaauauaguuaacucccuggaguaauccuuauuugucuacauaaugaaugcugugggaaaaugaggcacuuccacucuuguucucaucggcauugauaugaccuugucugauuuaguugaaccaagggcauuuucaauaauuacaagcucagaggucuaccacagauccucucaugggaggauuacuuaauguaggcaaaguagauacaacccuucaugucugguccauuuuaauuuauugguugccuaaauauucaaucagagcuuucaccagcuauauuuguagagcugcucaaauguuuuuauaaaaguaagcacauagaaauuacaaacggugcuucuuuucauucuugcaggcugacaccuacaaaauauauuuuguuagguuauaaauaguuaaaaaacuuuuuugagcuacaaugcuuuuaauugcuuaauuuuguaguuuuuagaaacauguucuagaaauauuuaggaaacaauaucacauccuguggcaucaagaaaggcaggaacuuuguuuuucuaauuaauaaagaaggcuaaaaagagucaguuguuaaauaggcaaugggaaaccauaauuguaauccaugggaaccacggauuuuugcuggaauauaaaggaugauuuaaaauuagcuuaagauuucacugauucuuaauguauuuuguugauauauugauuagaaaaaaauuacauuuagccacaccuaaacuuauuuuggcuuguuuaucaaauuuucagauuaauucuuguugaucaguuuccuuuccuccuuccuuccuuccuuccuuccuuccuuccuuccuuccuuccuuccuuucucaugcuccacaacaaacauuuguuaggcaacaguucauuuacuaacaccauaauaggugcuagagauuccaguagaaaucauaaucucugucaccaugaaguucaugaauuuacaauaaaaacaaaaccaauuaacaaaggugggccccgaauucaaugacuggccuccuuauaagaagaggagaggauacagagacccagagaagaaggccaugagaaaacagaggcagagauugaaauuaugcugccacaagaggaggaacaccuggaagcuggaagaggcaagaaaggauucuuuccuagugcauuuggagggagcauggucuugcugacuccuugauuucagacuucuaggcuccagacuugugagagaauaaauuucuguuguaucaagccacccaguuugugguacuuuuuguggcauccuuaagaaacgaauacagacauguucacuuugaaguaccuuugggacaacugagucgaauggucaaaagaaagaugaauucagggauuuggaauuccagcuuaggcuggagauaaaacuuugaggauuaucaguaugcgauuuggcaauaaagccauauaaguggcuaagaucauccaacgcacuguguagaaugagacaagaauuccaucuagggccaugaagaacaguaccuuuuaggaagagaccaagguggaggugcucacaaagggagacuggagagguagaaggaagaccaggauaguggaggggcacaugcagaggguuucaaggguuaagugcagcagacuggucaaguaaaauaaagacuuuguccguugcauuuaggaaaaggcaguuguggugaccuaacugagacuucagugcaagaguggaguaauuuucaggaaugacugagagauccaaaagugaguccaggaaguguagacagcucuuuccaggggauugaaugugaaagguggaaaaccgacugcaacuagaagcaaagaaugaagaagaccuuucacauugcuuaauugucacuauuuggauuuucuuacagaugauuaugcucuuaacuaaugagacacuuugauguuuagacaaugaugauaaaacaaaacaguaccucauuuuaauuguuguuguccacaaaacugcucacuaaauuauggcaaagcaacuagaacauguuuuacagauacaaaucuaaaaagucaguaaaugagaaucuguuguugguagaaauuuucugcauaauuuacaaagagggaaauuauaggcagaauaauguuuugaaaugcaaaacaucugacucauaguagagaugaagagcagugaaugacccaugagagaaacuuaucuuauuguucacacacaggguagagaaaauucaaaccgauaaggcaucaggcaaagcaaaacugcuuuaacgaaggugagucauaaugccacucagggagaugaaucaggugcccacauguccaaucacuuucauaauuacagcucccuacaucuuuuaaauuaaaacugaagucagguaacaacuaaugucccuuuagaacaaacuuagccaaauggaaauagacagaguccuaagaaguaaaaugagcauaucaaagagaugcagcuuuucuggaaaggaaaaaaagaaagaggggcaguggcucacacguguaaucccagcacuuugggaggccaagguggguagaucacuugaggccaggaauucgagaccagucaacauggcaaaacccugucucuaccaaaaagacaaaaauuagccguucauaguggcacaugccuguagucccagcugcuccagaggcugaggcacaagaaucacuugaacuugggagauggaguuugcagugaccugagaucauaccacugcacuccagccuggguugcagagugggacucuguauuaaaaaaaaaaaaaaaaaaaaagagagagagagagagagcuugcacaaaagcaagccaucccuuuaaguguaaugucaugacugcuggccccaaaagacuuuuaaaugcuuuuauugugcccucuguuccaacugauuuugauaccuucccaucauggaaucacuacaguaguuuuugcucaacaugaagucuuagauauauuauaccugaggccccuaagguuuccugcucaagccaggagaguaagcagccucccugcccccucccacccacuucccuucuagcuuucacagucaaucaaaagccuaguaaauucuacaucuuagacaucuacccucuguccuuucccagagauacagccugaucuaagcugcuacugacuuaccuguaacaacuaguuucacucauccugguugccuccuuuaggcaaagcuacagcacagcuagcgugaacauggaaacauacaaaucagauaucauucuguugccuaaaccuuagaugguuucccgccaagaccaacacaagcuuauaugagccucugugagaauuuugaaaaaaagguaauugccccuacuaugggauaagcagaaaagagccacauuucagacccgauuuacccugugguuaggcuuauuuauguggcgaugaaaaugcagcagacguugccuguagaauaaaauccagacucuuuaaaauggcuuaugaagcccucuacaaccuggccccugccaaucucugcagucaccucucaccauucuuugaucuugcucuuacagaucaguuucaguuccuugaccauaucauguucucacuuauaucuuugccaaaccugccacuguuuggaauagucuucccuccuuugugaccacauaauuccugcucacuuuucagguuuugacaaaaauauuaccucccuuuacaggucuuccccgaugcccuugauuaaaaaugcuuucuugccauacacucccccagaucaccuaaauguguccuugcauaacagucauuaggauucauugaaauugcuggcauaggcugagugcagugcgcaugccuguaaugccagcacuuugggaggcugaggcaaguaaaucacuugagcccaggaguucaagaccagccuaggcaauguggugaaaccccaucucuacaaaaaaaaaaaaaaaaaagaaaagaaaagaaguaacugggcaugguguugcaugccuguagucucagcuacucaagaggcugaagcugggggguuacuugcgccuggaaguguaggcugcagugagcuguaaucgugccacugaauuccagccugggcaacacagugagacccugucucaaaauaagagagaaauugcugguauaacgucaacauuuucuaaugaacucucagcucaaagagagcagagauuuugucuguuugcuccccacuguauuaucuguauauaguaaugugucugaugcuuagaagcucaagaaauauuuauugacugaauaaauaauuacaugaauaaaaaagccuggaauccuuguuacaguauagugggaagaggucuaguccaggcucuuccacuaacuuauugguucugugacuguaaacaaguuuccuaaccacggugagccuacucuuuaaauguaaucuuuaaaauguugacaauaccguuuguccuaucuaccaucaaaauugucaugaggcucaaugaagcugaggacaacuaauguguacugacagccuaccacgugcaaagcuuuaugcuagguacugccaucuguauuaucuugaaaaauagaagaaucucugaaagacugucauuuacccaaagaucauuuuucauaguaaguggcaaacuaaagacuuaaguaggaauuucugugauuccaaaggcucuuuucuucucgucccuucccuuccuuucccugcccugcccugccuuccccuccucucccuccccuccccuccucuccucucuuucuccuuccucaccauguuccaucaauaucuaucugauuaauacuucaagucacaggacaagcaucacucguuuugugaaaccaucucugauucuucugaccagauuuaugugcuccuauaacuauguucauauuguacuuacuauaauaacauuaguuuuaaauuuuuuuuuaccacaaaguuuuugugagaggggagcaugucuucccacuauuauauuauuuccaguaucuugccuggauauuaacauuuuauaaguacuaaaggaauauuuguuaaaugaaugaaugaacuuacuuucucuggcuuuuuuagaaaauuugauaauacaccuaauuuuuguucaguguuuacaguuuuauauuuaauuuauaaacagcaauaauugaggccccaaccacaguagcucauaugcuuaaaguuguuaagauaguauuaugaacauacgacaucagcucuugcccaauaauagacguuugguuuuagauuaauauauuuaagauuaaucuuaaagugcaacuaauaggcugaguguaguggcucacgccuguaaucgcaccacuuugggaggccgaggcggguggaucauuugaagucaggaguucgagaccagccuggccaacauggcaaaaccccaucucuacuaaaaauacaaaaaucagcugggcgugcuggcacgugccuguagucccagcuacucaggaggcugaggcacaagaauugcuugaaccugggagguggaggcugcagugagcuaggauugugccacugcacuccagccugggcaacagagcgaggcugugucaaaaguaauaauaauaauaauuuuaaaaguacaaauaauuauugccugaaagggaauaugcuaaauaugagauacagggaaaugauucagguucacuucaaauuuaauauuccaguuuuaauuugauauaaggcaaccucagggaacaaacauguuguuaguagcaaacuacuuagcuuagagaacuuaacauaguauuuauuguaauguuccccuguucuagaaaaucauaacuaauaauagaaauaaaacccagcugcauaucaauggccaagaacauaucaauggacuagaaaauaugcuaaggagacuaaaacagaccugaacauuuccuucaaauuuaaauaaaguaaguacuuuuuacuuauuacuaagaucugaaagauauauuaaaaauacuuugaaauuacguaacaugugaucuaaauuguucaucuaaaacaacagcuugucaaaaugcuaaucacuaggaaccgagagguuuguuuaguuaauagugcuuccuuucacaugugcuuaugugcuuuucagaaggaaaucugaaaucuauuauuagcuuuccauagucaacuccugauuauccgaguuaauaaaauagaacccagacaucugugcuaauagagagaacacagacauacaauagaccugauucagauccaaaaaagcagauaacacaaaaauuacaucuuugacuccggaauaaauguugauucuuuguagcauaugugccuuccuaauaacacuccauuaguuuuucuacuauagcacaggggaacuaugcuacggaaaacucaccuacacauguaagugagaguucacucuagauugugugaacgcauuguuagauguuagaauucugucagugguauucauuccgcacacuggauucugaucaucacuaauauguugaaaggucucauucucuucaaugcuccaggcccuaauacaagauucccaaccucauaaauggcuccuguagaaaguaacaacaucagggugaagaaaaagucaguuaugggaaagaaaaaaaaaagccaugcuaugcuuuguuuugaccucgugaaagaacagggaucacucaaguuuuuacuguuauuuucaaagucaagccuuagauacuuguucacuaaaggggaagaaaauuauaaauuauuguacauuauuagauacauggcuuucuagagugaaauuaaugauuuuggaaaugcugggccaauuacuuuauaaaugucuaagaaaaaugaauaucuuccucauguaaauaacugcaaucuuuucaucuguaaaaucagaucaguuauguaacaaaaacuuacauuaaaaaugacauaucucccugaggcaacuuaugaaauaacgaaugaaagguaggcucaugcuuccgaagaaagcaauguaguucagaaaaaacuacagagcucaccuuacuauauacauagcaauaggcacauagguggcagaaucccagcaaagcaaauauucuuucagugauucaauaauuugccauuuauugagcaccuauuauaaggucagucaucaugcuggacacuguggauacacuuuauuugagacauggucccugcauuuaaggagcucacagacauguaaauaauuuuguguaagagaugcaauagucgaagcaugugaagaacgcuagggggaguauggaugcaagaauuggugggaguuaaagaaggcuucacaaaggagguuacuggcauagacauaauguuuguacccucccaaaauucauauguuuaaauacuaacucccaaggugaugggauuaggaguggggcacuugggaggugauuaggucaugaggacagagcccucaugaaggcgauuagugcccuuauuaaagaagccuggccgggcgcgguggcucacgccuguaaucccagcacuuugggaggccgagguggguggaucacaaggucaggagauggagaccauccuggccaacauggugaaagcccaucuuuacuaaaauacaaaaaauuagccaagugugguggugcgugccuguagucccagcuacucgggaggcugaggcaggguuguugcuugaaccccggaggcggagauugcggccacuccggccugggcgacagagugagacucugucucaaaaaaaaaagaagaagaagaagaagaagcccaagggagcuccuuugcccuguccacugugugagaacacagagaaaaugcuccgucuaugaaccagaaagugggcucucaccagaaccaaaucugcuggugccucgguguggccuccccagcuucuggaacucaggaaaguuaauuucugugguuuguaaguuacccaguuuacgguauuuuguuauaacagcccgaaugaacuaaaagaguugucuuuagccacaguucauguaagaauuguaauuuaccaaguagauuagaugccaaggcauuccaagaugaugaaaaaguacuuaaaacaaggagccaugaacucuaagaacaacauacuuagaaguccaugauauauuuggauagaggugaacaggaaguuauauccaaauuaucaaggacuguguugagcaugcuaagacauuuggauauucuuauauaaaaguuauuaagcagggacaaagcauaagauguucuuaaacagcggaauggcaugaucagauauccuuuuuaaaaaaauaaaaauaaaaaaagaacucuguuagcuuuaagagacugucaaguccuggaggugggaagccuaaaugagagacaucaauaguuuauuuaggucuggaugaucccuaauauagucucccacccucugucuuaugucuuaagauuucauuaucagagcuuuagcuuuauaauuuaguaccuauuaaaguaaaaauugguauuuugggaaugauaggauagaaaauugcauaagugguuaaguugagcuuggggauguggggcaaaggugacaguuuuaaaauccuucccucuuuauuguguaaucucaaaaagaucaagggacugguauugaugggagaggcaccuugaggccagagcagauggagagagggacagacacucucuuuccaaaaucagaggagcaugggauauguuuguuuucugccucuccauaauauggcacaacgaacuuaguggcuuacaagagcaugcauuuauuaucucacaguuuacaagagucaggagucuggguggcuuaacugggcccucugcucagggucucauuuagauauuggccagggcuccagcucucaucugagggccaggguccuuuucuaagcucacagacuguuggcccaauuugcuuccuugcagcugcagagcucaugugguuuauucuccaaagcuagcaacaaagagagagaaauucagcugcaucaaguugcuaacuucuaugcccgaaauuuaaggaaucagcuuauuaucaguucaucucucuuuugauuaacuuaaaaccagugauuggagaccuuaauuacaucugcacaauccauucaccuuugcccuaaaacaucugggaguuauauccuaucaccuuugccauuggcuaguagcaaguuaugggccucacacacacucaaaagaaggaccucacacaaaggccuggagacagggagcaggaucacagccuucuuagaauccugccaaugacagauuugaagaguugaggucacuagagucuaggagaggcaaggaacaaucagucuauccaguagguagaaguaacuggggagaaugucuggaacaaguucuguuacaggcuggcucacuguggcaugacaccuaaaagugaagccugcguuugaagggccuggccccagguaaacacaugaggcacccacccaacauagacaagugcagagagcaagaggggaagauguucuccccaaagaagacuguacagauagaagaucugaauagagaaaaaggacuuguaguuugaaaacuguuuucaacuagggggaaggaggggauuuucuccauagcaccaaccugggaauaccaaaagacucuuuuccuccuuuuguuuuaauuuuucaauuaccguaagcuuuucucucacagcuuuauuuuuaacuuuaaugaucacacauauaucacacaaauauaacuaauacgcagggagauuuuucaagagauauaaacauccugguugagaaagucaggagagaaaaacuacuaaguaaacuaaaaaugacaagauaauuagagagaagauauauacagcaauaaauuugaauuucaaagaaaauuucagguaacaaaucuguuauauuuucacgugcauuaauagaaguuaaagcaagagaaaauugaguuaauaaaaaauugauuuaaaaaaaaacagauuuucaacacaaaaucucucugaaacuacugcgcccuugccucugcuguaauuuuggaaggauuagcgcuuguaggacucuggcuguccccagcagugacacaccuucccaccccaggauacauaaaacuggggcacagagcagauggaauuuucagcucugcucaucagcagguugaccugcuuguuccaagcaauuuugugaauuuaagacucuggugccuggcuggacucauagcacccgggugcucugcaauuuguacagaauucuaaaauuucaggcucugcuuguugccuagaucuuuaguaauaacagcaauaaaaaaguaauaauacccacauguauuaagcauuuaugaagcuacauuaauuaagcauauguuguguuuauguaguuugcaguuaauggcacuggcuuaauguaauagggauaguauuuuuuaaagaagaacuugauauauuuccaucuucaaauuguguuucacuggaaacugcuccucuuccagggcuggacaggguaccuaaugcccucacggaagaaaagguggguuagcaagucaauagacuuaaaaaucagaguccugcuuuagaccaaucagaaugacguaugaagaucuauuguauagacaaaugagaagcccaucccagaagagaaaggacauaccagcuucuggagaauuucaaaacggaaaaggcugaaugagauggggaggauagggaaauaguucuacauuugugucuggaacuuuccuuucugggcacuggccucgagagaauguagcauaauaaauagguauugggcaaacauaagaaaagagagcucuggguucccaaucccaucuagauucugggcagggccacaucccauuaaacuugauaguucccugugguaaggacuagcaagauuuuggggauaaaucuuucugagucccacugauauuccuaaauuacgaaugagacccagagguaccuggagccuccagaagggggccucagcaggcagcuggucugaaagccaacuggacugcccuggggccagcuuggcaaggggagaggugaccgcugcagaggcuaggaaagacagauggccgaccuggcagagacucagagggaccacuuugccagugcgaggcgagcugaggugaccagccagaaagagcuccaggcucuggccagaauggucuugaccuaaauaugccaccugcaggccacagguauacuggaagggaugcccacucccuauuaucccuuuuccugugugucucuccggccccauguaccagccauucauucguuaggaguuugaacaaaaagcuaauucaaacuuucuccauccuccucaaauaucucaucuuugcccucuuuuguuacucuccaaagacagccuugcucuugguucacagagaaaauaagagccaccggacaguaaaaugcaaaucagaucaucucucuucguuuaaaacaccuaucaaugacuucucauugcucuuaggauaaauaccaaaauccugaagguagcuacaaggguuugauugggcuuuuacucgcuuugcagcuucaacugcugucauuucucuccuuucucucugaccugcaguuucauguuaauuucuaccacagggauuuuuuuaaauaugcuauuccuucuuuaaagaauaaucuuccuuccccaccuuggccuacuuaauucuucuuugucuuucagagccccacucauuguuggcaugagaucagucacccccuugagauacucucacagcacuuucucauggcacacccugaguaaacauauuuauuuaauauugcuuagguaagccaauaguauuauaucaacuaauuucauuuggaguagcaagucccaugcacuagcuaacuaacaucaccccauuaucuaacuauauauuuucauaauuuuaagugcugaaaagcaaucaacuuuucuucaucaagcaucucguaaccuguaccuugccuucuaccugaugugcaauuugucacaaaggcacugggugaaagucaucaugugacaccacaggaaaacaggaaaaaguacaggagacacauuucaugauuuaucaagaagugacaagaauauaauuuaccauuacaucuauaugcagcauuugauauaaaaauacuugccucuaggguaccuaaaauccuggucuauugaaaguacugaacuuaccaaccaauaacucagcuaauauauuuaauguauauauuuuuaggaaaacaggucccaaagauguaaucucgcaucauccucucuaacccuuuacuuucuccauaucagcuugccccgaaucuuagcuuggaguugagaggucaucucagcagccuguuccuggccuuccugucggcuggaggccaaagccucccucagcugccuguguccaguggcugcuguaauaaugaugucucagcuucaggaggucuauuuccaggccaugugagcuaauuaaaacacaggccuucauuugccuuucuggcaaucccugaucagugugagaggccuaugccacccucuccauucuaauuuuaguucuccucuaguguuuucucuccuuugcagaaaagcguccuaugcugcuaagcacuuacaggcuuuuguuuuuguuauuucucccacuuggaaagaagcacuuuuccacuuuacuccuuuuggguuuucuccucccaucaguuuucuccugcaggaggugaugguuugaaacuacuagcaaaacugaagauaauuaguuacccaagguaguugacuugcuuagcaggugcccuugagaaagugcuaaugcacaaaauucuucauguggaaacaacuuuuuggacacagcuuucuauaaagauagagaacaccuguuaucacuggcgaugcucagcuucuuuucccccagcaauucacaacacaacuauccagaguucagaacucauaaauucacucacaauaggcugagaugcuauuuuucggucuuuuaaaacggauacucuuuacuucugauaagcauaaaauuaucacauggcuuccucccacccuacccucccucacugaaaaaaaaucauuaucucaacuaucuacucuacauaucuacuugaauauccaacagauuuucaaauuaaaauguucaaaacugagauuuccccaucuccacuaauaucagcuccaucuuuccaaaggucaaaacaccaaauaucuuugaauuacaacuuuggucccuuuuauuuucuuauauccuaccuccaauucauccaaauauauauguagauagauugauagaucaaucgauagacagaugauagauagauagauagauagauagauagauagacagauagaucuaccuuuaacauagauccagaauucuaccacuccucaccaccucuauuuaaaaaaaacuguuacccgaggaaagaagaacacacuggcaaccauuaaggggacccaagagauugaaauaucuuagcagauggguucucaggucauucaaagguuucacaugagaaugagacacauaguggccaugugcagagagagccccuuagggaaguggccuugaaugaaacaccucucuuagggagacuuuggcagccagggaaugacaugaggagccuuggcaccucaaggaagagugggacaaaguauagaagaagugaacucagauaaaggugaucuauauuacaauguguuaaacaaauggaaagauuaaauauuaugaacgcagugaauguuaugucuuuagaaguaucaaacauuucuuccaggaaauuguuguacugauuuaauugcaguauuuaagaauauguugauggaggagaggcuaacucagcugcucagucccauggucuuaagacaauugcugauaauuauaaucauuccuaguuccuugugcaucccauucuuugaauccaacaauuauuccaacccucuucuuuaauaccuugacuccagcaauacuuugaccccacuggaaucuccaguccuaagaucuuauugauuuuucaguguuaauuaucuccuuguucucuuucacuucccucuucaucuugaagucuaugguuaaauauuacacucccuugcauuuauauuuccuugcucuucaaucacuucaauauaccaauuuagcaaaaccacaaccuauguaaaauucaacucuccaaauacucugcaccugcauccuccagcugacauaggcuggagaaaaacacagaaccacauuggauagucuaauucuaaaugcaugaacacagacuuuaaauaggccuuuaaugcugccaggugaucacaucauauaccuccuuuguccacucacuguuucuucuaaacaacuauuucacacuguucucucuuuccucaaacucuacauuuccuucucugucuuugguuucaauugaagcugcugcucucuacuuuguagaaaaacugaaaacuaucagaacagaucuuccccagauucccaccacauggaucuccugccaguauuugcacccacaaccaaaacaucuguucaugcuccuguccaaaaccagucucuccacuugguuaauaauagaauucaucauccccucuuucuccuccaucguaacuuaaaaauuccccugugaagaaauuccuucaaggguagucuaucauuacucuaaguccucuccucccuuucucccuuaaaaccaccacaugaggcucuaucauuuccaaccaaauugcucuugucaaggucagcagugacccccccacccccaauauuguuaaauccaugaaccuauucuaacuuaguccucauccuacuuaacuuaucagcuauauuugacagaguugaucccucuuuccuucuuaauaacuuucuucaccugacuucagaacaagacacucaccaaaagauuuccuucuaucucacagguugcuccuuaucagcuucccuugcuggugcugccuuucauuccauccuuccucaagcucaguuauuggucuucuuccucuacacacgcugcauaucaucuguauaaugacgacguucacaucuauaccugcagacuggaccuucugcugccuacuugacacaucuauucagauauucaguaggcaucucaaaauuaacuccugguauuucucacuguuuaccaaaccuucucuuccccaaaucucuugugugucaaacgauaggaaauucauucuuacaguuguuaaggagaaaggucuuggagucauccuuaauucuucucauuuucucauauaccauguccacuccaccaugaaauuccauuggaucugccuuaaaaauauguccaacaucucuccauuucucucuaacucugcugauucaccugugaucuuagcugcuuucccucucuuacugcaaugcuacaauugccuucuaacuggcuuuccugcauccacccuuguucccucuccccauccaugaucgacauuauagccagauuaauccucauaaaauagaaguuagaucaugugacuuuucuucugaaagaacugaauaggcucuaagaaaaaucacucuggguuaaagccaaaguccugaaauggcuuauuagggccuuacauaaucuaucccucacccucucuucuuaccuacaaauauucuacauuucaaggaagagcauccaccuuucacucaucagcuuaagcuagaaacuuuagagcccuccuugaaauauuuccccucaucuuugcacauccaauuaccaugaccuguuaauuacucuuuccuuguaucucuuaaaccaauuuacauuuucccuuugcuaugaaacuauuucuccccuucuccaaugucauuucaucucaaaucuacuacauauuaauacuagagugaacuuucuaguuaaaugugaaccuauuuauaucauuccccagacuguauaacaccaaagcuuuuuaauucuaacaaccuuuuuugaugauucacaaguugaagcuuuaaucacaauucaagcuacuuuuuaaauggcccucuguuauaauaaauucauugguucacuuaaaaguguuuugcagcauacgauuuauuuuugaagauguauuagucuuuguucuguuaaaugccauuuuggucaagauuaauuuuuuguguaugcaaucauuuauaaaaugaaauguagauuaaucaguaaauuuaaauuauacuucuaagucaagaaaaggucagcuaucucggcauaagcuuggucagcuaccuuggcauaccuuguacagacuuacaacaggccccccuaucuuaaagcuacuacagauuucaaauaauaguauuaaaaacaaaaauaauauuaagcaauaacugugauaauauuaaagaauaauauuaguugccaagguuuacaaaauguauuaacauaaacucauuuauuacuacaaauaccuaaagaguagauauuauuuccacuuucagaggagcaaauuaaaugucagaaaaguuaaagguuuugauggaaaauaucuagcaaaucagugauggaacugacucuucaacucauucucuuuauauacccaguggcaaugucuguaaagcauaacaaauuaaauauguguaagcuaauaaaaugcuacuuuugcaaguacaaaugccuuccuuacaaguuuuccuuuuuaauguaaagcaaagcaaauugugcuuucacauuauuacuaaauaucagucuauccuaaaauuguuuauguaauguggaggugauauauuaucuuagaaaaccacuguaacaugguauuggaaaccauuucaacuguuaaaagguuagauuucaguucuguuuaaaggucagaccugaaaauauccugaugauuacaauuucuccacacauuuuggaugaugccacugaacuccuggcagcagcaaaauguguuuguucugauccucugcuucugguggucaguuucagaguggagaaaaggcgccagggcuuugggacuagaccuaaauuucuauugcuuuuaauuaaaauaauaaaggggaaaagguaauauuccuauccaacugagacagaaaaauuuguugaaaaccgauucuuaccuguugaaaaauauucagaaaaucgaucauccccaaaacaauguacuaacuaaaacaaaaccaagaaaggcauucugaaaggcaaguaucaaagcaucugucauugccccauuuuagguuuucaaaucuggaacuagucauucaaauaaauauuguuugaauaauaauuauaugcccagaacccuucccagguccacauaccacuauuuuuuguuuuuacaaaucacaucucaucucuccuguccuauaaaacugcauuuaguacauagcagacaauacauuuuaaugcucacugaaugaaugcuaggauugauguagaauacaaagaauuauguuaauaucauuguuauugcuacuacuacuaauaguuacuaacauuuauugagcacuaacuaucugccaggcacuguguuagucacuuuacaugcaucaccacaguacaggguaaguuaaucuaauuaauucauuguuaaucuaauucuauaguaagaaaacuauagcauaaagagaucaagucucauagcuagguaagaggcucaguuucacaguuaguaaucaaacuuuggcagucugaccucagugcuuacaaugggccagagaccaaccuauugcagcuuacauucuagaaagacgacaagaaauaaguaaagaaguaaccaauauaauuuuacauaggagauaaggcuauggauaaaagaaaacgggaugauuugauagaagugacuagagugauauagaaaaaugguuaaaaacaugaacucuaguaccagguuugaguucauaccagaacuuuuuccagcuuugucauuaugggcuguuauuuaguuacuuauguucuuuguguauuuccuuaucuacagauaauaccgaauuuauauaacagucaugagguuuaaaugaauugauauacauaaaaugccuaaaacaguuccugacacauagugucauuuaaguauuuauuauuauuguuauuuuugcauuuuuauuguuauaauucuuaucacguugaggacaucuacuugagauagggugguaugggaaggccucuaugaggaaaugcauuugaaccaaaaccuaaaugacacuuaggcacaugaaaauuuuaaggcagagauuccaggcagaaggaaacaaagugcaaaagccccagggcuagaauguucagcaaagaaagccaguauggccaggaugaguucagucaaguuacagagcuagucaggaaccaggcuaaauuaggcaucacuggauaugguaaggaguuggguuuuauucuaagugcgauuagaagacaugggaacauuuuaagcaugguaaugacaugcuuugauuuacauuuuauaaauaucacuccggcuuccaugaaaguuuggauuauaacuuccauagaaugucaaucuuaucauucccauuagucauuguuuuuaaaaucuuagcuuuauuccuagggaaaaguaauucucugacuauauuuccagaauguuuguguuagugcuuuuaaacauagaguccgauuaaaggacuuaaguagguauaugaacauacauauauacacauacacucacugugaacaaagauuauauggaauacucacauagaccacacuucauuauucuaaauucaaaucagaauuugaauucacugaaugaaugcuaggcuggguuuuugaaucauguuucuuggaaggaaaguaauuguuuacuuacaugaaaguugaccauaugaauuaggucauucuuguuauacccaacuaaaacaguugagaggucaaggggagaaaacaucuagggcacauaacacuguuccaacaauguaauucccugugagcuuggcugcugaagcugccugcuguaaccugaaaccaguuuuaucuaauagcuacugaaacaaccugcugcaacucugagaaucauuuuacccauagccaucacuuaccaaucaaaacuuuccagcucaccaacauauuauuagugccaaugaacuuccucaaagagcaauauguaacuuuccccuuuuuuguaaaaccucuauccgucuguucucuggacauaaugaagaccauccagccuaugaguaugccacaaaugcaauucuugauuuccaaauaaaacauuuaaaauuaagacuuuugucucuauauuguauuugucuuuaacccuuauuguaaauuauauggcaggggaggauauucuuugggucccacuucucuuauuucuaauaugucccuuggccuugccaggcguuagcuccuugucccccaaauaaagaaagcuuugcaaaucugacugcauggaacaauguauguuuuacuagugggugguguuauuuuucuuaaucuuacccucacacccagcauuuucucccccaacacacuuccucugcaaguucaccaugguuuaaauagguugaaagccagccuaggccacauuguacaauuccuucuuaccagacauccuugauauaaguucuccggcuucaaagcaucucuuaauaaaguugucuguugauuaguugauaccgcuguguggugagggguaaauggcaguggaagaacauuuccaggucccugguauuuuuacuacuauaaucacauuaaaucaucaucuuuaauaucuaacaccaaaaggccauccauguauucaaaaagaauauuacagccacacugacaagaaucuuaaagcccuacauugccacacauggaggugaacuaaaaacacaaugcaauuuguacgaagacuccuccuaauuccucuaacucauaaauacuucagucuuaaaauaaaaauacagcugcauaaagugaacugcuuuaccuguaugguuaguucccucauucuugacuucugugguucccacagaagagguggguggacuagcaggaggacuggcaguaaagcuugugcacccuguagauguguugauuucaaaauauucuugguugugauucauucggugaaaauccagagaagacacaauggauguucgcuguuuaggcuaaaauaaaugagcaugacgagaguauuaauaugaucauguucaucuucagcccaaucuccccaucaauuuaaucuaagugauaauuuuuuucaguuaaaaacuaucuggguuuuauacuuaaaauauaauugugcuuuacagagauacauuaauuucuugaugaauuaaauaauaaaaaauuauuuaaugagaaaauauuauggcauaguugaugugauagguuaggcuuuucauuugcuuuccccagaagauuguaaaaauauagugcacaaaauuucucuugguaaucaauuuugaaaguugcaauuuuaagucaccuuucauucaacuaacauuuauuaagcaucuggcauuugccagacccagaggauauagaaucuaauaauaaaagggccuuacaacauagaagaauaauuaaggcaguuccauuuuuuuauucuuuaaauaguccaaggaauugguggcauuagauauuguucccaaguacaagaugcuggaauuuuaucaucagaauuaaauaaaguuauauggaacauuuucuaagaucuaagaauaugcuugguauuuuuagugaacuuugauuuucuuuuuuaagaauuuuaauuaauccccaaauagcaagaaaagucaauuuaaacauaaaaguuaaaaucauggaguaauagcagauauaaucuauacccuuugucaguaaugaauuacuccccguagcaauuuucuggggcuuuuuccccauaguuuuaauuauauucacuuucuuuucuugccuagcagagcuucuaacauuguccuucagaaaaacugcaguuuuuuggcucucaaauguguguguuuuucccaggauucaacucuaccuuucuuacuuuuuauuuuuuaguuuauauuacugaaauacuaaaaaucucuuauaauaauuauaagagaucaaauguaaacuuuuuauaauaagguaaaguuuauuguacuuuacuuucuccaaaguacaauuaacuuuugguuuacuaauguuuuuauuacccuuaaauauguguuaaucccuguacuccauagauuauuuuccugcaaaauauucaaauugcugucucuuccagcuuaucauuuucuuccaaguagauaucauuuaaucuauaaucuaaaauagacaaucauauggaaaauaucugcacaguauaggguuuuuaaaaaaauauauaagguguguaaauuaucacaauaugauuuauucuuucaccaauauuucaccaaauauuuuuaugaaagacauugagagguauaaauauuguuaugcaagagagugcaagucauuuauuauuaugacacaucaacucaguaauagaauucaaauuagcacccacagaggacucaguugcuuuugaaauacaaaagaucaggguuuaaugucaggcuugguuucucaugaaaugucuguccuugggacugcugaaucucaauuucacauucaauguccuuuccaccacauucuauaauagcaauuagaaaggcaugagcuauagcgcuggcuccaauggagcccaucauucuaggcuuuguuuuauuguguuguguuuuuguuucacuuuauguguaggcaauggaccacauuucuauguuucuucucauaaauuuuauaaaggucaagccaaaugauauauaugauucccccauuucuaauuguuucuuaaauacauguuucugaauccugaccacccaugguucuaacugcuuuaaaaacacaauguuuuaugcaaucaugaaaacaaacaagcuauuuugugcaauauuaauucauucuacaaauauuugcugaacauacacuaaacugcagauaucaugcacguaagcacugugauaggaauaaaacaagacacugucccuguuuucuguaugaauauaaacgaggugggaggauggauggcacaugagucuucgaaaaagagacaagcaauccaaugauuaugcuucaguaucacauagcaguaagggugaugaaaaauuagaagcauuauacuuagucaugcccuaaggcaagggucagcaaacuauggccuguggcucaaaucuggcuuucuuccuguuucuaaaaaugaaguuuuauuggaacaaaacugcacccauugcucccucauuuaguuauggucuaugacugcccucguacuauaauugcagaguucaguagucgcaacacaggucauauuuuccacaacacuugaaauauuuauuaugucuggcuuuuuagagaaaauauuuggccacuccuguucuauggaauuguuucacaccucaauuuugugcucaauaaaaccguaacuauagguuuccuuuuauuuccuagccugacuugccuuuggguugggcaaugugacuaauucucaucaaauacaauauuaguagaagugacauuuuucuaucccucucuuacucuccuaaugauguaguugaaagaugaaggaaagucaugaaacucacuaauuaguuuuaugagauguuaaagugaaccuuccuuuuuuauauuuuuauuuuaaguucagggguacaugugcagguuuguuacauagguaaaggugugucauggggguuuguuuaacagauuauuuuaucgcccagguauuaagccuaguacucauuaguuauuuuuccugauccucucccuccucccacccuccaccaucugauaggccccaguguguguuguuccccucuauguguccauguguucucaucauuuaguucccagugaugagugagaacaugugguauuugauuuucugcuccugcauuaguucacucaggauaacagccuccagcuccauccaugucccugcaaaggacaugaucucauucuuuuuuauggcugcauaguauuccgugguguauauauaccacauuuucuuuauccagucuaucauuggugagcauugagguugauuccaugucuuucauauugugaauagugcugcaaugaacauacgcaugacgugucuuuguaauagaaugauuuauguucuuuuggguauauacgcaguaaugggauuacuggaucgaaugguauuucugacuuuaagucuuugaggaaucacugcauucucuuccacaaugguugaacuaauguauacucccaccuguaguguauaaguguggcuuuuucuccacaaccuucccagcauguguuauuuuuugacuuuuuaauaauagccauucugaauugauuugaaaugguaucucauugugguuuugguuugaauuacucuaaugaucaaugauguagcacuuuuuuucauauaauuguuagcugcauguaugucuucuuuugagcagcagugucuguucacuuuucuuucuuuuuuuuuuuuuuuuuuuuuuuuuugagacggagucucuaucacccaggcuggagugcaguggcaugaucccagcucaaugcaaccucugccuccuggguucaagugauucuugugccucagggccucgaguagcugggauuacaggcaagcauuaccaugucuggcuaauuucugucuuuuuaguagagacgggguuuugccguguuggucaggcuggucuugaacuccuggccucaagugaucugcccaccucauccucccaaagugcugggauuacaggcgugaacgaccauacccagcccccaaugcccacuuuuuaauggggguugauuuuuuuuucuuguaaauguaaguuaauuucuuauagaugcuggauauuagccuuugucaggugaauaguuugcaaaaauuuucuccccuucuguggguugucuguuuacucuguugacaguuucuuuugcuguacagaggcucuuuaguuuuacuagauuucauuugucaauuuuuucuuuuauuccaacugaaggaacacuuauacacuguugaugggaguuuaaauuaguucaaccaugaagacacuauggugauucaucaaacagaaauuuugaggauauuucuguuccuaaaaacaaaaauauaccauuugacccagcaaucuaauuacuggguauauacccaaaggaauauaaaucauucugucauaaagacacauacacacauauguucacugcagcacuauucacaacggcaaagacauggaaucaaucuaaaugcccaucagugauagacuggauaaagaaaaugugggauauaauauauagcauggaauacuaugcagccauaaaaaagaauuagaucauguccuuuucaggaacaugguuggagaccgaggcuauuauccuuagcaaacuaacacaagaacagaaaaccaaauauugcauguucucacuuauaugugggagcuaaauuauaacuaauggacacauagagaagaacaacacauacugggccuauuggagaguggaggguaggaggaaggagagcaucaggaaaaauaacuaauggguacuaggcuuaaugccugggugacaaaauaaucuguacaacaaaccccaugauacuauuuuaccuauguaaccugcacauguacuccugaacucaaaauagaaguuacauaaaaaauuuaaaaaaagaaaugagaacaaagaagcugcuuugaggaaacucaacaaaauucaagauaacgcagaugagguauucagaauccuaucagauaaauuuaacaaagagauugaaauuauugaaaagaaucaagcagaaauucuggagcugaaaaaugcaacugguauacugaagaaugcauuagaaucuguuaaaagcagaauugaucaggcagaagaaagaauuagugagcuucaaaacaggcuauuuguaaauauauagucagagaagacaaaagaaaaaagaauaaaaaagaaugaaucauggcuucaagaucuagaaaauagcuuccaaagggcaaaucuaacaguuauuggccuuauagaggagggagagagguggguggaauaaaaaguuuacucaaagugagaacagagaacuuccuagaccuaaagaaagaucucaauauucaaguauaagaaggccauagaauaccaaggagauuuaauccaaacaagacuaccucaagcuauuuaauaacuuaacucucaaaauucaaggauaaacaaaggauuauaaaugcagcaagagaaaagaagcaaauaacguacaaugaagcuccaauaugcuuggcagcagauuucucaguagaaacuuuacaugccaggaaagaguggcaugacauauuuaaagugcuggaggaaaaaauguuuauccuagaauaguauauccagugaaaauauccuucaaacaugaaggagaaauaaagacuuucccagacaaacaaaaguugagaaauuucuucaacauuagaucuuuccuacaauaaaugcuaaagggaguucuucagugugaaagaaaaugacguuaaugagcaacaagaaaucaucugaagguacauaacucaugaguaaaaaaaacacagaauaguauaacacuguaauugggaugugugaacucauauuuugaggugacaaaugaaaaaauagacugauaauaacaaguaugaaaacuuuucaagacauagacaguacaauaagacauaaauagaaacaacaaaaguuaaaaaguagggggacaaaguuaauggcuacaauauuuauuaguuuuuccuuugcuuguuuguuuauguaaucaguguuaaguugccaucaguuuaaaauaauggauuauaaaaaauuauuugcaagccuuaagguaaauucaaauuaaaaauccuacaauagauacauaagaaauaaaacaagaaauuaaaacauaccagcagagaaaaucuucacuaaaaggaagagagggaggaaggagagaaggaggagaucacacaaaaaacuagaaaacaaauaacacaauggcaggauaagugcuuaucauuaauaucaauaauauugaauaauuagacuagaaucuccagucaaaagacagagaguagcugaauggguuaaaaaaaaaagacccaacaaucuauugccugcaagaaauacacuucaccuauaaagauacacauagacugaaaauaaggggauggacaaagauauuccaugcaaauaaaaaucaaaaaagagcagucguagcuauacugauaugacaaaauagauuucaagaaaaaacuauaaaaacagacaaaaaaucauuacauaaugauaaagggugaaaaucaagaagaugauaucauaauuucaaauauauacgcacccagauauauaaagcaaauauuauuaaggguaaagagagacauaaaccccaauacaauaguagcugaagacuucaacaacccacuuucaucauuggacagaucauucagacagaaaaucaacaaagaaaugucagacuuaaucuguacuauaggucaaaugggcuuaauagguaucuacagaacauuucaaugaacaguuacagaauauacauucuucuccuuaguacaugaauaauucucaaagauagaccauuuguuaggucacgaaacaagucuuaaaaaaacuaaaaaauaaauugaaauuauaucaaguaucuucuuuauccacuauaaaauaaaacuaggaaucaauaacaagaggaauuuuggaaacuauacaaacacgugaaaauuaaacaauaugcuacugaaugaccaaaugggucaaugaagaaauuaagaggggaauuuaaaaaugucuugaagcaaaugguaaugaaaagacaacauagcaaaaccuaugggcuacagcaaaagcagaacuaacaggaaaauuuauagcuauaagcaccuacaucaaaaaaguagaaaaacuucaaauaaccuaacaaugcauccuaagaacaagaaaggcaagagaaaaccauacccaaaguuagaagaaaagaaauaauaaagaucagagcagaaauagauaaaauugaaacaaagaaaauaccauaaaugcuaaauaaaauaaaaaguugguuuuuugaaaagauaaaauugacaaaccuuuagccagauuaagaaaagagagauaagccucaaguaaauaaaaugagagaagaaaaagacaacguuacaacugaugccacagaaauucaaaggaucauuagaggcuccuaggagcaagcaguagucucccagcaaagaaaagcccaggaucugauggcuucacugcugaauucuaccaaacauuuaaagaauaacuaauacaugccuuacucaaacuaugccaagaaauggaggaggaggaaauacuucugaacucauucuacaaggcugguauuacccugauaccaaaaccggacaaagacacaucaaaaacagaaaacuacgggccaauauuccugaugcauguugaugcaaaaauucucaacaaaauacuagcaaaccaaauucaacaccacauuaaaaaggccauucauuaugaugaaggggaauuuaucccagggaugcaaggaugguucaacuuauguaaaucaaucagauaauacaacauaccagcaaaauuaaggacaaaaaacuacauaacugauuuaauugaugcugaaaaagaauuugauaaaauucaacaucccuucaugauaaaaacccacuggguauagaagaaacagaccucgaauaguaaaagccauguacaacagacccacaguaucauacaaaaugggagaaaacugaaagccuuuccucuaagaccuggaacuugacaaggacgcccacuuucagcacucuuauucaccgucauacuggaaguccuggcuaguaaucagacaagagaaagaaauaaagggcauccaaguugaaaaggaagaauuugaauuagccuuucaaaaucuuacauauuuugaaaaaccuaaagauucuaccaaaaaacuauuagaacugauaaauucaguaaaguugcagaauacaaaaucaacauacaaaaaccaguagcauuucuauaugccaacagugaauaaucagaaaaaauagaacaaagaagucucauuuacaauagcuacaaauaaaauaaaauaucuaggaauaaacuuaaccaaagaaguaaaagagcucuacagugaaaacuauaaacacggaugaaagacauugaaaaucauauaagaaaaugaaaagauauuccacuuucuggauugguagaauaaacacuguuaaaauauccauacuaccuaaagcaaucuacagauucaaugcaaucauuaacaaaauacuaaugauauucuucacagaaauggaaaaaacaauccuaaaauguauauggaaccaaaaaagacccagaagagaauaagccaucaugagcaaaaagaauaaaacuggaggaaucacauugccugacuucaaguuauacuaccaagcuauaguaaccaaaacagcaugguucuggcauagaagcagacaaauagaccaauggaacagaauggacaacccaggaacaaaucuauacacugacagugaauucauuuuugacaaaggugucaagaacauacacaagguuacauaagggaaaagacaggguggugguggaaaaacaggauauccauaagcagaagaacgaaaguagaccccuaucucuugccuuauacaaaaaucaaaucaaaauggauuaaauaauuaaaucuaagaccucaaacuacaaaacuacuaaaagaaagcaucagggaagcucuccaggacauuggacuaggcaaaaauuucuuaaggaacacuucacaagcauaggcaaccaaagcaaaagcggacaagugagauuauaucaagcuaaaaacuucugcacagcaaaggaaacaaccaauaaagugaagagaccaccuaaagaaugggagaaaauauuuacaagcuauccaucugacaagagauuaauagccagaauauguaaggagaucaaaaaacugaaaaggaaaaaaaaucuaagaaucugauuuaaaaugggcaaaagaucagaauagacauuucucaaaagaagacauacaaauggcgaaccgauaugagaaaagguguucaauauuacugaucauaugagaaaugcaaauuacaacuacaaggaaauaucaccucaccccaguuaaaauggcuuuuauccaaaagacaggcaacgacaaaugcuggcaaggauguagagaaaaugaaacccuuguaaacugcuggugggaauguaaauuacuacaaccaauguagagaaaaauggagauuuuggagguuccuuaaauaacuagaaauagaacuaccauaugauccugcagucacacugcuagguauauucccaaaaguauaucgaaaacauagcucauucucucucauguuuauugcaggacuauucacaauagccaagauuuagaagccaccuaagugucuaucaacauaugaauggauaaagaaaaugugguacauaaacacaauggcauacuauucggcuauaaaaaagaaugagauccugucauuugcaacaacauggauggaacuggaagucauuacguuaagugaaauaagccaggcacagaaagacaaacauugcauguucucauuuauuuguaggaacuagaaaaauuaaaacaauugaacucacagugguagagaguggagugaugguuaccagaugcuaaaaaugguaauuugggugguggggggagugggaauaguuaaugggcucaaaaaugugguuggaaugaauaagaucuaguauuugauagcacaauauuaugacuagagucagcaauaauuuauuguaccuuuuaaaauaacuaaaaccguauaacugaauuauggguaauacaaagaaaggaaaaaugcuugaguugaugaacaccccauuuaccccaaaaugauuauuacacugcaugccugugucaaaauaucucauauacucuacaaauauauauaccuacuauguaccccaaaaaacuaaaaauuaaaauaaaaaagagauaucuauguggagaaauggaauaacagcaaugggagaaaagaauaaagagauggucauaauauuaaaauggagauaaaaaagaauaggucuagaauauucauuuaaacauguuugauuuaauauaauuuuuacuacucaaauagaauugcacucagccauucaguauaaaaaagaaaaaguguuuucacaaauucacugaaauuacauauugaauuugccaagcuuugauauguagaaugaauugcacuuguguucguuguggcuucuccacuuuaaaacauaucccuccacugugguccaguccucauaucacccuacuuuccagaggacuugcuucuauacauauuuacuuagcaggagucagcaaacuacaucuuaugugccaaagccaggcuucugaauauuuuuguucagccugaaagcuaagaaugguuuucacauuuuuuaucguuuuuuagaaaaggaaaaauaauauuaguaacacaugaaaauuguaugaaacucaaacuucacuguuugaaaacaaaguuuuauggagacauagccauguccauucauugauguauugucuauggcuguuuuccugcuacaguagcagaguguaguaguuguaacguagaccuuaugaacgaagacuuaacuauuuuacucucugaucuuuuauaaaaaaaaaaaauugugacccuuucuauaaagugaauaggaaauuucagcugggcacagugguucacgccuguaaucccagcacuuugggaggccgaggugggcggaucacgaggucaggagaucgagaccaucccggcuaacacggugaaaccccgucucuacuaaaaauacaaaaaauuagccgggugugguugcaggcuccuguagucccagcuacucgggaggcugaggcaggagaauggcgugaaccugggagggggagcuugcagggagccgagaucgggccacugcacuccagccugggcaacagggcaagacuccaucucaaacaaacaaacaaaccaacaaacaaaaguuaacaggaaauuucucugaggagguaaaguugaacagacacaggaacgacugugauugaaucagggaaccagugcaacauaaaaagguaggaccccuuguuucaagagcagguacaaaaacuuuuuucuuuuucccauguucucucucuagaucuguuaugguguucuuuuauuugcuacuuaacguauugcucccuuggucauggaaacacucacagggugagggcagauucuuacaggaaugcaguggcucugcccugcaacucaguaagugcaucugaccuugacccuuccccacacucauggucucacuacugcaucagcaguuucugggcaggccaggggcaccuggguuggaggagcagguggaaaagaauuuuacucaguaaagaaaguagaaauaggguggaaagugggaaaacaguuaagucaagauuccaagccccaacacauguucaauuuucccauaaaccgccuuacaaaacccugggccaggagcaccaggguugggggagcugcuagaguccccagugucuacuguucccaucuuuaugucuguguguacccaauguuuaggucccacuuauuaguaagaaugugugguauuugguuuucuguuucuguguuaauucacucaggauaacggucucuagcuacauucaugcugcugccaaggacaugauuucauucuucuuuauggcugcauaguauuccacaguguauauguaccacauuuucuuuauccaauccacuacugaugggcacuuaggcugauuccaugucuucucuauagugaauagcaccgcaauaaacauaugagugcagguguuuuuugguagaaauauuuauuuuccuuugggucuauaucaaccugggauauuuugugugauacauaugacgaaaauauuuaauucuaaauauuuuuuucucaaaaugauagccuacugucccaauaccauuauuuauccacugauuugaaaugucaccuuuaucauauacuaaauuuccaaauagagauugggcuugcauuuuuggacucgacuauauucccauugaucuauuugucuauuccuguacuaacaucacacucucuuacuuacuguauggcuucuauuucuagagcuccuagugcguggauauuggaucucuuugacccuuccuguuuuauauacugggaguauucuacaguucauuguccuaaagaaccuucauuaauuugcuaggaaauacuuauugaccauuaucagcuguguggucaggcgcuguuguagccucuggggauacaucaaugaacaaauaagauaaggcacauaauuuuaggcauuuuguuuuaacuuuuggugugauuaugcuauuuuuaauuuuaaaaacuuuucuuuuuuuucaaguauuccauuuuuaaaauagccuguuauuaacuuuauaaguucaaucaccucucaaaucuuucugaggauacugauuagagucuuuuucuggcauuaagucaguuuucuuaaagguuccuuacuuuguucauuaagccugguuucucucuuuuugguuguuaauuuuuccucaaccaucuggugucuuggucaagcacuuuuuauaccuagggcacuguccccacauuaggagcuucaggggguccuucaccuuccuuagauacuuauuaccaucuggugggcaaacaacaaagcugauugcuccacauaggagaugcuaagguucugguugcccuguccacucccuggcuuugauaaccaugcccuguugcucaggcuugagauucuucgcagaggucuaaugaggaugucaaauccacucauuguuccagugacaucuuccccucuuccaccaguguuggauggugggcuuuuuccucuuguuuugucuaaaucuagcaauauuugauuuuaucuuuuagaauuucgcaaaugccucagguaguaacucucccuguuuuucaucacugcuaugaauuuauuguuaauuuuguauuuauuuuuaccauuuugauugcaaguaaggaggaggaaaauguaaacacuugcgauccacucagcuuuaucaguuagaauucucauauuucucugucuugaucacuuugaagacuguauauaagagauuugaggaagucuggacaacucgaagaaaguaaguaucauugccauuucaucacagaugucaugcaaauggaaaauuauuauauuuucuugauuuuucaauaaauggaaaacaauuuuaagugaaguacaauuuuuugguuguuaugaauaugauguuaaugugaucaagacuugcucuaaagauguagaacuccuuaucuucagguaggcaaaugcaauucuucugcuuuauagauuauggccaaacauagacaaaaaauauaugaucaccacaagggaguuaaagaagucgugagugaguauugaguauuuaagagacguggacauucuucuaggcacuugaaauuuguugucucauugaagccuauaauguuaguaucaaaaguagcuauuacucuuuccauuuuauagacuugagauucacagauaaucucaguuaagugggagagcugaaauuaaaguuaagugggagagaugaaauuaaaauuaagcgggagagaugaaauuaaaacacaaaucuagugaauuucaaauugauugcauuuuccccgaaagacaccacacuauagguaaagcaaagagaagcaaacauauuuacaaguaaagccaagagccuaauaacucuugaguuucucaucuuuauaucaacgcacaauuuuccuacucuucagucuauugguagcauugauuuuuuuaaaaaucuacauuguuucaaaagcuguugaaauaaaacgcaaguggguggaaaaugggaauaaauaguaucuaauucugcuaugcauuaaacucuuacagucacuacauuuuuuauaagagaaaggcagaaaauuuuuaaaaaucuuuauaucuccugacuuuagcucuucauuucauuuuuauauagagguaucugacuaugaaauaauaugcauacucaucuucuauuuaaaaagacaaauuauaaaacagacuguagggacucuguacugcuucucagacacugcaaucccacauaggagcaaggucagauuuacugauacaggcaacuguccaaagcagcucuucuccugcuagcuguugauguucucuuccucucugccagcuccauaacaagggcccucacccggugcaccacccucgcccacacacacacccugaccgaggcccugagaguuccagguuccugcaccugccuuuccugcccagggcuuuuugagaacagacaguugcucucaagcccagggcuuucugagagcagacaguugcucuugagcccuucucugagguccucugaacaccccuacuccaccaucaaucagagcaguuauacuuuuuuuuuuugcuuuuaccuauuagguuucuguuagguugaaacauaugaaacugcugauauucaaccguauuaccugcaaaaauagcaauuucauauaacucagccuacauaaacuuuucuuuuaacagaguucucuggcuaaauaauuugaaaaccauuucucuaggccuuaagugagccugacauuuugcuggccccaguaaaauugaacucuuucccuucuuagacaucacuaguaagaguauaaagacacaugcacauguauguuuauugcagcacuauucacaauagcaaagacuuggaaccaacccaaauguccaucaauaauagacuggauaaagaaaauguggcacagauacaccauggaauacuaugcagccauaaaaaggaugaguucauguccuuugcagggacauggaugaagcuggaaaccaucauucucagcaaacuaacacaggaacagaaaaccaaacaccacauguucucacucauaaaugggaguugaacaauuagaacacguggacacagggagggaaacaucacacacuggggccuguccagggggugagggguuaggggaaggauagcauuaggagaaauaccuaacguaaaugauguguugaugggugcaacaaaccaccauagcacauguauaccuauguaacaaaccugcgcguucugcacauguauuccagagaguauaaauggguauaugcccuuuucagggcaacuugucaaaauagauuuuuuaaaaguguuaagucuaucccuaguauuuaacauacauaagcaugaguguggaguuuguuagauggaaaauuuguaauauauguuucuucguaugaguuaguuucuucauacaauguauucaaaucuucauuggaaagacuguauacacacaugagaggauaauaaaaguucuaguuuuuauucuaguuuuauuuaauaaaggucaaaaguaguuuuggacucaauguagauauuaaagaccugaaaagcauuuugaccuccaaaccauggaguuuguccucauagaagcuuucccagcaugaaaauagucacaacuauuuugcaaaaaauacuuuuugacuuagguauugcaaauacuuauauauuaauauuuuauagauguucaugucaacuucaaaugcauccagaauuuaaaauaaguaaaaccagcuuuauuuuccacacuuaaguucuuuuuuuaaagcaacaauuucaagugauuuguuucaucuuaggaacagcaggaaauaauuaugcaauggauuauagaagauauauucugaacagcuaaaauaggaagcacauaucacugugugggugaaagaaagacauuuuuacaaauaaaggugcacacugcuuuuuaaauagcuuaauuuuuuaauuaaauuuuuuauuuucaauaauuguagauucauaugccauugugagaaaucauagagugcacucauguuucuuuuuccuagauucccucagugggcacaucucacaaaauuauagugcaacaucguaaaaaggacaagaaacagagcaauuccaucaccacgaggaucccucccauugcccuuuuuuuugagagggagucucgcucugccgcccaggcuggaguguaguggugagaucucggcucacggcaagcuccgccucccagguucacgccauuuuccugccucagccuccuaaguagcugggacuacaggcgcccgccaccacgcccggcuaauuuuuuguauuuuuaguagagacgggguuucacuguguuagccaggauggucucaaucuccugaccucgugauccacccaccuuggccuccuaaagugcuggaauuacaggcgugaaccaccgcgccaggccccauugcccuuuuauagcuacacucacuucucuccugcccccaccuccaccuuaacuccugguaacuaccgaucuguuauccaguucuacaauuuugucacauuaauaaugcuauauuaauaggaucacacaguauguaaccuuuuaggacuggcuuuucucacucagcauacuuuucugcagauucauccaagcuguuguguguaucaauagcuugcuccauuuuauugcuggauaguauucaaugacauggauguuuaaccauucacccaaugaaggacaucuggguuguuuccaguuuuuagcuguuaugaauaaugcugcuauaaauauuuguguacagauuuuucagugaacauguuuucauuuaucugggauaaauucccagaaguacaaaugcugguugguauggcaguucaauguuuaauguuuuaagaaacugccaaacuguuuuccaaaauugcuguacaauuuuacauuuccaccagcaaucuaugagcuucucuguauccuugccagcauuuaguguugucacaauuuuuuauuuuagcccuucugauagguguguagugauaucucauugugguuuuacuuugcgucucccuuguggauaaugauguugaauaucuuuucuugugcuuauuugcugccaucuacauauccucugcaguaaaacgucucuucaugucuucugcccauuuucuaauuggauuauuuuuauacuauugaguuuugagagugcuuuauaaguucuagauauuauucuuuguuagauaugugauuuauaaauauuuucuccaguauguaccuugucuucucaucuucuuaauaggguuuuucacagagcaaaaguuuuuaacuuuaaugaaguacauuuuuuuuuaaccagaggugcuagucacaccuuauucuuugauagagcauaaacagagguggggagggagacagugcaaagggagaagggcaggcucuugagagcgagguuacuggcaugcagucaggcccccucugauuuggggacuaucacuucuuaaacacgugcucuguggccguugccaugccaagcucauuuauauuugggaggaaggagaggaucaggacaauuuauuuuuuuauggauuaugucuuugguaucaaguauaagaacucuuugucuaacucuagaucccagaaauuuuuuuccuauuuuuuucuaaaaguuuuauaguucuauauuuuaagucaauuauccauuuugaauuaauuuuuacauaagccauaugacuuaggucaaguuucaacuuguggccuguguauguccaacugcuccagcaccaggcuaucuucccuccacugaacugcuuuuguaccuuugucaaauagcagucagguuuauguguauggguauauuucuggguucucucuucuguccuauugaucuaagugucuaucccuucacugauaauacuacauugucuuaaguacuguagcuauaaaauaaaucuugaaacuggguagacugauuccucccacuuuuuucuucucuuucgauuuuuuuuuaguuauccuaguuacuuuacguaucuaugcaaauauuagaauaaucuuauauuuacaaaaaaguguugcugugacuuugauaggaauuauguuaaaucuaaauaucaauuuggaacaauuuacaucuuugcuacacugagucuucuaauccauaaacagguaugucuuuccacuucuuugaacauuuuuuuucaucaguguuuuguaguuuucaguauacaagaccuguacauguuaaagaggaguucaccgaggcucauaaucaaacuaucaaaaauuaaagacgaagaaaaaauucugaaagcagcaagaaguaagaaacauaucacauacaaagaaguccaauguaacuaucaguggauuuaucaggaaaaacccugcaggcuaggaaagggguaggaugauaucuucaaacugcuaaaugaaaacaaauugccaaccaagaauacuuaaaucaguuaagcuguccuucagaaaugagagagaaauaguaacuuucccaaacaaaagcuaagggaguucauuaucacugggccuguuucacagaaauuacuaaagggaguucuuuaagcuguaucaaaaggccacuaauuaauaacauaaaacaugcaaaagcacaacacucaaugguauaagcauuacagaaucacauucagaauacucuggacaaaaauguugguaugcaaagcaauuuuaucucuaguacaaugguuaauagacaucuauuaaaacaacuauaaauaaaauaaucaggggauacaaauuacaaaaugauguaaauuuugacauccaaaacauaaaaugagggauuuggauaaaaguguuagauuuauaucuaauuauuauuuuuucuuuuuguauuugugauuauaaaugaccuuguauuuuuaauuucuguguauauauguucauaacuaguucacagaaauacaauuuuuuuauguguaucuugcaucccgugaccuuguugagcucacuuauuagucacaggagugcuguuuuuguuuuguuuuguuuuguuuuuuagcuugcuucggauuucuacgaagacaaucaugucaucugcaaauaggaaguuucaguuuuccuuuccaaaucuguaugccuuuuauuuuuuuguuuuucuucuuggcacagguuagagcuuccagcacuauguugagugacaguggugagcacaguggacauccuugcuuuguuccuaaucuuagaaagaaagucuucauguuuuuaccauuaaguauaauguuagcuguagauuuuuuauagaugcucuucaucaaguugagaaaauuccccucaauuucuauucuuuuaagaggucuuaaaaaacaaaacaacaugaauggguguugaauuuuguugaaugcuuucuguguaucaauuaauaucauuauguggauuuucuucuuuauugauuucaaauauugaaugaguuaugcaucccuaaaauaaaccucacuuuguaauuguauauaauuuuaaaaauacauuucugaauacuauuugcuaauauuuuguuaggaauuuuuugucuauauucaugaggaauauugcucugggguguggguguauguggaauugggaauacuaggucauaaaaugaauuagaaaacauucccccauuuucuuuuuucaagacaagauuguuuagaguuaguguuaauucuucuuuaaauguuguuauaauucuccaacaaaacaaugugagcuuggagauuuauuuuuugaaagcuuuuuugauuaugaauuccauuucauuaauaguuguagggcuauucacauuauguauuacauauuggguaaauugugguaguuuguuuuaauaauugauccauuuuagcuaaguugucaaauuuauguauguagaauaguuuguaauauuccuuuauuauccuuuugaugucuucagggucuguagugacaucccuauuuuauuccugauauagguaauuugugucuuucuuuuuucucucaguuucacuuuaagaacaguaggaaauaacaauauaaugauuuacagaagauauguuccuagcagccaaaauauuaauaaaagcuuauauugcuguauacgugaaagaaaauuuuuacaaauaagagugggcauugcuuuugguuuuuaacuucucaaaggucauucugcuuucuaauucuuguuuuuagagauagggucucacucuaucccccaggcuagaguccagugguaaaaucauaucuuacugcagccucaaucuccugggcucaagcgauccucccaccuuagcccccugaguaguuagcaauacaggcacacaccaccguguccaacuaauuuuuuaaaacucuuuguagauauauggucuggcuauguugccagguuggucucaaauuccuggccucaagugauguuccugucuugaccucccaaaaugcugggauuucaggcaugagccagcacacccagccugcuuucuaauucuuaagucaucucuuuacuauuauaguaauagugcccaugaaauacauucuguuucagguauccuaccuuuuuuucaucuaaauccuacaaaaacuccacagaugggcagacagggaaacugagugucaaagauacucaguaacuauuggacagcuuuagaauccagcucucucaacacuuaaaagccaugaauacacuuuccauuacaucauucugucuuuuugcuauaauuacccaaaaugucuuccuauacaauaaaaauaacagaacuuuuuuagcuuaaugauaguuuaaaagaauauuuuccccagaguaucuguaaaagcauuuaccacgaggguuaucacaaaguaauaaauauguuaguagguagaauaaaguuaagguuuaaaccagaaagaugugacaauauaaguacuucugugaauaaauuuaagauggugugaaguuuuaagaauaagcacauagcacuuccccuggaguaaaauauaaucagggucauaaaaauuugugucauaauaugauagcaauaaguuuuaaagugaagauaaguauuacaauuaauuuuagcuaacaaguucaacuccuuuucugcuauuuuucuaaaacaguuauaaaaaugcccauuaauaaaaguuugucuuuuuuuccugacucauuccuggcaaaggaauauucaaaagguugauaugaagggguauaaguauauaaagcaaguguuaaaaaauacauaaacucaguaauaagcuucuaaauaaucaagaauuguuaugauuuguauguaaauuucauuuggauuucccucaaggaaacaaaaucauuaaguucugaaauagucucuaauucuaaaacuccuuucuucaucuucauaucaaugaaaaaauugguauccucaauuaaaaaguaccuuuauguuucuaacuaauuccuauggguuaaacuuauuaacacauauuugggagacaaaauaggauuugcagcaaaguagaauuggauucagauccuaaugucgguauuuacaguuuaguauuugcauucacaaaaugaggauuauauaagccuccccacagaauuauugucuggauuaauugagauaauguaaaugaaagacuagaauaaggccuaaauuaguaaaggauugauaaguauucaucuucuucucccacuguaauauuuuaguauaaguaggaucuaacugaaagaagacauugaugaguuaaaucauaaggcagcccuccuaauaaauggcagaaucaccaaauuacaugaacaguccagcagaaucucccugacacaauuuacagaggugaagguugaaggaaaagaggaaaucaauagguucggaagaaaauacagcacacagacuuauuuuaucaguguuuaagagagcugcccuggaaauugcaguaagagcucuaaguagaaaccuuccgggggcgucucugaugggaaauaaguggcagagacccugguagaaccucucuaaauagcccaccaucucugauuuggaggagugagggcucauggcaaugagggaccacaaagaagggggaaaaagaagagaagauacacuccaauuaaucacaauaagccuuuuuagaaagcauggcauuaggagguuaaagagccccuguggugacuuguuuacaggagcagaaaguuaagaggcuguuaggagcuugaagaggaaacaucagacuucagcuucugagaaagaaguuagucauuagacauauuuugcuuuagaaacaaacccaagugauauaguuugaauauauguccccaucaaaucucacacugaacuguaauccucaguguuggagguggggcuuggugggaggugacugggucaauggggcaaauccuucaugucuuggugcuguccucguggcaauguuuucacaagaucugguuguuuaaguguguggcaccuccccaccaaccccacucucucucuugcuccugcuuuugccaugugaugugccugcuugcacuucacaacuucugccaugaguaaaugcucccuuaggccuccccagaagccaaguagacgguggagccaugcuugcacagccugcagaaccgugagccaauuaaaucuguuuucuuuauaaauuacccagcaaagcaggcauuucuuuagagcaaugcaagaauguccuaacacaccaagcaaaacauaaagauggauguuaaugugcccuggugcaauggcaucaccaaacacagauaagacagcacaaaauaauucuucuugaugggacugcucauucaugacucugucaucuucuccacuuaccagauuuaagagaaauaaccagcacuauccaauauuaacuaaaagauagaugccauucuuucccucaagcaccucauauuuuagugagaaagcuaugaaagaggaaggugaaaaguccuaugaagaaauagaacuuccuaugaagacauauaaccagggaucuaaccuaauuuggaguguaaagagaagcuucuuuaaggaaguaaucuuucagcugccaccugaaggagauguagaaauuagcuaagugaaagcagugugagcggguuaaaaugaaguguccaagucagaaggaacaugaaaugccguaauccugauguuuacagcaggaaaagauacagacagcacauguaaggaacuaaaaggugguugauguguucgggauacaaaaaggaagaagaagagagagaaugggcacaucuuuccagaaguuugugaaaucgaauaaaauuugcauagcuaugggagauacuauucuaugauggcauugacuugaguacauuaaaaugcugauggaaaugaggugguaaaaagagauauauuaaagagauaagaacaaaaaggaauugagaguaaaaauuuccuacaaaggagguaaggguggaauuuagagaaugugugaaaaguuugauguuuagagaggcagaggaaugccuucaguuuaauaggauggagaaagaaaugaagagguucagaaagguuuuaaacauuuuuuggcaaaguauugagguaauuccuuguugaugacuuccaguuucucuggaaagugaggauuaaauuaucugaguagacuaggaggaaaaucagguaucugugaagaguaaaauucaaaagucauuaggaaaguuggcaugcaagcuaacuggagaaauuuaggucugcugaguaguguuaagggcccagaagagauugagaacuaugaauuuauaacauuaaaauaagauuaugaaaaaauucaacaucacugaucauuagagaaaugcaaaucaaaaccacaaugagauaucaccucacaccagucagaaugacuaauauuacaaacucaaaaaauaacagauguuggcgagguuguggagaaaaaggaacacucauacacuguuggugggaguguaaauuaguuccauuauuguggaagagaguguggcaauuccucaaagaccuaaaaacagaaauaccuuucaacccagcaaucgcauuacuggguauguacccaaaagaauauaaaucuuucuaucauaaagacacaugcacuugcacguucacugcagcacuauucaccauaacaaagacaugggaucaacauaaaugccugucauugguagacuggauuuaaaaagugugguacauauacaccauggaauauuaugcaacagaaaaaaaaaggaaugagaucauguccuuugcaggaacauggauggagcuggaggucauuauccuuagcaaacuaaugcaggaacagaaaaccaaacaccacauguucucacuuauaagugggagcuaaauggugagaacaugugaacacauagaagagaauaacacacacugggaccuauuggaggguggagggugggaggagggagaggaucaggaaaaauagcuaauggguacuaggcuuaaccugggugaugaaauaaucuguauaacccccccaccccgacacaaguuuaccuauauaacaaaccugcacauguaccucugaacuugaggguuaaauuuuuuaaaaagauuaugaauugauuaacuucucgacuuaggcuuuuuucuauuuuaccugaaaauaaaugaaacaauuuauuagucucucacuauuuacucuugcacauauacauauauauccauauauaaaugaguuaaugcuuuugcauuuauuucaguguaauauaauaaguagggaaauacgaugugugauuauuauauaguuauuauggauuauguacuuuaucaauauaaaaauccuauuuauuccuaugcuuuuuaucucaguggaguccaaggauuaggccaugaaggauugaaagauucagagcaauguuccaggcagaagcguauguuuugaaagagcaugcugcuuuugaggaaguaaaauaaaucuagguuuggaauauagacuagaagagaucaagaaguaagaauuaacuccagaaauaaacagaaaccuggucauacaguuugauggcuuuaaguugaccaagcaaugguggucaaaccugugcuuagcuaggcuuaaaagcuaugaaguaaauagacagguuugaaaaaaauagacuaucacuuugagaaacaaucuggauuuuauguguacuauuuuauuuaauuuuuuccuccuguacagguagcagaaacacacacacacacacacacacacauacacacacacacccauaaggaaaauuuuaacuugucuaucuaucuaucugucaucuaucugucugucugucugucugucuaguuaaagcaaacuaaauauggccugagaaggacuccauacuuccauauuugaauccuuguggaugaaccauaaccuagcuuaacaggcagacaagaugaaaaccuaacuuaggaguaugugccuguaacaauagcugagucuuggccaaucacagcagccauaccucaaccacucauagacugcuaaguguucaaacaggguucaauuaaggcaaaagccaaccuguaaccagccguuucugaaccucacuucuaaguucuuuucuguaccucacuuuccuuuuuaugucuauaaauuaguucugaccacgaggcaccccuggagucucugaaucugcugugauucugggggcugcccgguucacaagucauucauugcucaauuaaauuccuuucaauuuaauucggcuaaaguuuuucuuuuaacaauauauaaacacacacccacaguuguacauauuacaaauuugcaaauaaucuguguauauuuauauucaguuuauuuuguaguuaacaguuaacauuuuuauaguuaccauauaauuaaguuauucauaugauuaaauuagcuuucaaauaauuuuuaauauuuuuaauauucuaucuuccauucaaacaaaaauuuuuauucuaauucuuuucuguuauaaauaguaguacaaugaauuauuuuacagaauuguuuccucuuucugggcauuucauugguacagacaagaaaguacuagacgaaaaguaguauguuuuucaagauucuugauucacauuaccaagaaaauguauagaaacauuuccaccauuguucuacaagacuaucagucugugccugcaucaccaugaauuuaccaugcauuugcuaagcacaggauauauuuuuguuuuuaaaaaguuuuaacuacuucuuagguuauguuauaacuuuauugugcauuuccuugauauucagcgccauuaaucauuuuuccuuuuauuuauuauuauucuuuuucuuucuuaaauuggguauuuauauuguuuguccauuuuccucuguggauguguuagucuucuuuguggccuucuaagagcucuuugcauauuaaaauuuuaacaguuucacuguuuauauuuaucucuauagcauuaguuacuuguuuucuauuuuaauaaaguuuuuuugaugcaaggcaacuuaauuucuaugaagucaaggcuauuuaucuuuuccuuugguauuacuuucacaacuuuuguguuaaguaaauguuuguaucuguaagauuauguucgaaauauugacagugugugucucuaucuuuucauacauuuuguuaguuaauagagaaaugacugcugagcuaaucauuuguaacuguugugacagaagaaagugaaguguaaagaugagaagauaagaaaaugugucucucagaguuguuauuaaucaccgucaauauuucauuagagugcauugccuaaugucuguuuauguaauuuaacuuuuuugaaauagucuuuuuccucacauauuuugacuaacuuaaugacccacuuaauuuauuauuucauguauaauugcaauuauuauguagauauccguuuguguugauaucucuguuuuuuuaaauggaaauuaauagaagauauaaaauacuuuuggaucuuucugauauucaaaaaauauuuuugagaaaaauuaucuuaaauaguaauaugauuugguacuugacucaauucaauuuagcauuuauugcuugcugucucauacaacuguucuaagaauucaugucaaauuauaucaguuauuccuguguccauuuagcauauauuuauugucaaguucuuggcuaaagcaagaauccaagaagagaaauuucacagacuaguaagagauuauuugcaauuucugcuuuuuaaauaguaauguaauuaauauacuuuccagaaaauuuuuccaucuucuuugaugcauaaguagacucuuaaaauacacauauaaaauuaugugaaaguacacauaauucuaagaaagcauagcagaagggcuagagacccuuauauuuaacuaucuacauuauaucuagaggguaucuaaaacuuauacaaaccaaacagacauuugauccuugcuccccaguuccagcaacaucaaaacaaacacaaugaaaaucacugauuuuugccuagaucucaccauuucaguaaauggcaucgugauuuuucacagugacucaagccauaaaucuggacaugcuugauucguaaccuguaucuccuaaauucaacucuaugguaaauauuauucauucuacuuugaaaacauguucuaaaaccacucauuucccuauacuucggauuuacccaccaauccaaauaacuguacauguucucuuggacagcuacaaaacguccuaauuguuuccccuauuuuucccuccauaagguauucucuagccagagugaucuuuuaaaaauguagaucaaaucacaucacauucuugcuuaacacccuucaguggcuucuaauugcacuuggaguaaaaucuacacuucuuaccaugaccucauuggcucucugucuucucugguuucaucucacagcacuuugcccucacacugagcuccagucaugcaugccuucugucuguuccucugcuccaaguucaugucuucaucugggucuuuguauugcuauuucauuucccugccuggaacauucuuccucugacucuuuucauggcuaacuguuucuccucauucauguuccagcucgaauaccaccucuucagagaggccuucucugauuccaaguagugacuccuccuccaaauacuguuugacucuguguaguuaauuuacagcccugaucacaaucugaaguuauauucucuauuuauuguucacuugaucauugaauauuuaccuccucuugaauagaggcuccuugaggacagugaacucuuuugucuugcucacuguuauuaccuguacuaugaugaagccugguaaauagagcacacuuagcaaauaugaguaaaacggaugaaugaauaagggcaucucagugaagauggggugagaaaggguuaugcuagcuggugcuuggauccuaccuaaaagaaagaacagaaguuaaccagguagagaaaaagagggaaaugcauucuagacuguaucggaaagggugcaagaacaagucuccuuuggagaguugcaggaauuugggaugauugcauguuggcauugcuggugauaaacaggagcccagugcaagaacauuuauggacuuuuaugccuuaucgaguaagaaguuuagagguugucaugaagguaggaaauccuaaaggauguuauaaaagugaauaacauaaucauguugacaauguaauaagaucacucuccucacaugggaaggagucuggcauugggugaguaggguauccuuguaggguauccuccuacuggcagugugaggagguguccacauguggagggcagccaggguagagucaaggcacuguaaaggugagaaggguauccaucaggggccaaccaggcaugaggaaucagagcauacacaaaguaaggagcaggguggaugugugugugccaugcccugagcaggagguguccauguggagcuuuacuggcaugcgguaucagagcccaagugggaugaggccaguguccacauuuggagaugacccuaaaugagaaucaggaccugauauaauaacaaaauacacuaugaauaaaggaagcuagguuucugacugucagagaauagaacuacaaauauaaaaaugaauuauguguuguuuagaucgaaaucacauuacuucuguaaacucauggcuuucaauauauguugagauggauggacacagaaauauagauguuccugugcauguguauauuuguguauacauacccagacccacgugcauacguauauguacguacuaugcuuauauacaaauauucucuagcccugcccacugagagagucugagaacagugacaucccaguagcaauuaauauacguagugccuaaaucuuggcauuaaacuaccauuuuauacuaagaggaaguaaagcuucuuagagaaauagcugauuccacaucuaggacuggaaaaucauauaugagauaagccuagaaaucccgauguuccagaaaguaaggaaugcucaaagagugauggagauaagucaaaaggacacaggaggacucccuuuggcaaaacucuaaauaauucaaauaucaaaaccaauaauaauaauaauggaguauaacuaacucaauaaaauaggaaacaugggucucugcaaguauaaacaaauacacaaguaaauugaacguuuugugaggaaugggauauucacauaguuuuaaaguaccuccccacaaauguauacacauuucagaagagaaacaaacaaacaaacaaacaaacaaacgaagagaaagaguaaccuuacaauggagaagucugaaagaaaccaccuuaaucaagugaccaaggugaacaucauuugaaaaaucauuaucacaaaucaaaaucaugcaccagcugauaggaugcaauaagaaaaacagagucaucucuggguuuuucugacaaagauacauacccugaaucuaauuauaaggaaauaucagacaauccaaauugaggaacauuacacaaaauagcugaccuguuauauucaaauuugugauugcuuuuaaagucaagaaaagacugaagaauuauuccagaucaaaugagauugaacaggaaugaaaacuagaagaauguaugauucuaaacuagauacuuuuaccauaaaacauauuauuaggacaauuggugaaguuugaauggagucuuaagguuaaaugguaguaauauaucacaauucauuaucugauuuugauguuuguguucugguuauagauaaauauccuuguuuguaagaaauaacauggggccgggcgcgguggcucacgccuguaaucccagcacucugggaggccaaggcggguggaucacgaggucaggagauugagaccauccuggcuaacacggugaaacccugucucuacuaaaaaauacaaaaaauuagccgggcgugguggcaggcgccuguggucccagcuacucgggcagcugaggcaggagaaugacgugaacccgggaggcgaagcuugcagugagccaagaucgugucacugcacuccagccugggcgacagagcaagacuccgucucaaaaaaaauaaaaaauaaaaauaaaaaauaacacaccagugcuaaugaggcauuagaacagcaacuuacucacaaauaguuccaggaaaaaaaaaaaaagaucuuuagaaaaaaaagaucuuugcauuguguuuccaacuucucugcaauuuugugauuguuucaaaauauaaaauaauaaucauuuuaaaauccaugaagaucacucugugauaaauauagaagauaaauuagaaguagaagagaugacaucaaggaagccaugaugggagcuauuucaguaaucaagucaaaagaauuaagacagguacagugggaguagaagagaaaagcuuagaaagauaggaaacagaagugacaugcuuugguggcuaauuugauacagaaagagaaguagaggaggagucuaggugguacaguuaauugauauaaggaaggaagagcagauuuuuggagaaagaugaagauuuugaugucuggcaaguaaguguagugagucuuaucuuccaaacacuguacguuacuugaccaaaugaaauacaaguuauuggcuuauuguuaggaugaacuucuauucucuggcuucauguuuccacaagaagggaauaccauuagaguaacauccuccaccuauucuccgacuccuuauuaauuuauccccuaaggaauuagaguuacugagcuguaaaacgacauuggggaaggaacuaagcaugcuuauuauugccucuuccauguuucuccucuucagagacauaauaaauauguucucugcucuucuguaguaaaaucaccuuguagguuggcuagcugugccagugacuggguuaggaugugugucuaauccaagagugaaguuacagcaagcauauucaguaacauaucuagaaucacauuguccaaucaguucucaugaugauaauaaaaaguauggcauuugguuucaauuugucuaacucuuggauuccauaccucaguugguucugaaucugggagagaaagcaagcagugugguuaauuuguuuccuaaauucaaaacaauuauaaaacucuguuuauuccucccagugucuaauauagugcuuaauacucacuuauugaauugaguucaauuaauguaaaauaaaaugaugcuaaaauaauacugucuuaaaggcgaaaauauagguccuucuaauuauuuguuuuuccauuuuaggcauuuagcaccauugauuuaaaacuuguucuucaacaugacauaaucuaaagauacuuauuuuuccuuuccucacagauaaaacagaaaucauaauggucuuauccaucucacgugguuucucaaaggauuaaaguagacaguguguagauaccacucuguaacaucauaaauaaauggcauauuuauugcugaguuuggguguucccuuucucaacagugugaauuugugcaagaugaguggaaaaucaaaccagaauggaauuguuagggucagcuauaaagaggccuaugaaaugcccuagaucauguuuuucaaauuaaguuuugugcaucacuaguugugaaauauauuaauggguuuacaugggugguagcgaaagaaggcucugaaaaaucauucagugaagaaauuauuuaacccuguauuuccccaauauauuugacaauggaaacuuuuuauauaagaacaucacuuacagaaugaguaauccauagauauuaggacauucugacuaagaggaagguggcagaauaucugguugggacuuccuaauuauuagaaugcccuaaguaaaucagcacagcacuuaaguaaaaagauucuaaaucccuugcuuauccuauucuucucccuggacuauguaucugccugcuacgauauggauauggcuuaguuuguccccaccaaaauucagauugaaauuugauucccaauguggccguguuggcagguggggccuaguagaggguauuugggucaagaggacagaucucucaugaauggcuugguucuguucuagcaauacugacaguuccaagucugccaagacuggauuaauucucauggguauggaguaauucccauaagagguauuuguuauaaagccagacaccacuggaguuuugccucuucacauguuuucacuuucccuuugaccuucugccauguugugauguaucaccagcagcugggcagaugucaacacgaugcuucuuguacuucccagccugcagaagugugaguuaaauaagccucuuuucuuaguucauuuuauguuccauauaauggaacucccaaccucagguguuccauuauagcgacacaaagugaacuaagacuucaccuaucuaaugccuauucaaacauaaaggucacuuugagcauuuccucucuggaauagucuucacugcccuuuccccaacuauucuuaauuaauucaggugguacuuauugacagccaguugugaaccagguacuguucucagugccgaaauugagcacuuuauaaaacaaggaaggaaggagggaggaaaagagagggauggaaggaaggaagguagaaagaaauaaaggaaagaaguucuuauucucauggcauauccauuccaggugggaagaaagacacugaacaaaucaacgcauaauguuaguucgggagugaaaauuguuauaaaggaaaauagcauaacagagacagagaauaaagugguagcuacuuuauauucaauggucaaaaagggcaucucucauaagguaguauuugaauaaugaccugaaggaaggaugauaauuagcaguguuaagucucugggagaagggcuuuccagacaauucaaugauaaguacaaagaaccuaaggcaggagcuguuuggcuaaucuaagguacuguugggaagaugacauggcuaguguaaauuaaacaacguggagaacgguaggagauggguuaagagguuuuagagagucagauuauauuggaugucaugcuucuuuacuuucagugagaugggaagacauuggaagguugagcaggugaauaacgugaucugauuuauauauguggccaaguuacaaaaggacaagagcacaauaaucaaugccaguaacaagauaugaagcuuuuucaaaggucuaggccagagauguuaguggcucauacaauagugacagaugacagaugguaagauucaagauauauuuuuaaagaaaaguuagaggacugauuuuugaacuuuuuggucucaagaucccuugaugcccuuaaaaauuaauaacacugaagauuuuuuguucaugagagucauaucuguuaauauuuauauaaaaacuaaaaauaaaaauucuuuaagcauaauacacaagugcgcauuccauuagccaucagagguaugaugaugucaucacuuaccauauagcuucuggaaaucuccauuuagaacucauguacaaauaaaagcagaacaaggcaaaaugucuuuguauuauuauggaaauauuuuugaccucacagaccuuugaaaagguuuugaagccugcuaagagguccugaaccacacauugagaacugcuggccuagaggauuuuuuugauggaauggaucugaggugugagagaaagaaagaaaucaaggauggggucaaguuuuuaagccugagcugcuauuaacugaaaugcaaacugcagugcuauauaaguuaaguuuaagacaucccauugagauuuaggguagccugcuggacaugagccuggaguucagggaagugggcaggccuggagauacaaauuuaggaauaaucagcacauaaacagcauugaaagcucuggaacuggaugagaacacauggggagugaaaguagacugagaauaggucugaggaugauccuuggggcauuggaucaaugaacuccaucagugaaauuccaaaaguucucuauuuagagcacagucuccuuugguugguuaaaaguuauuuuaggauagaauccauauuuuagucauuuucauacucaaaucaccgcuuaagaugcccagcauaugguaggcacucaacuguguuuauugaauaaauaaauaaauuaauuaaugauguccuuugugguacuuucacagcuaaauuccagaauuuuagaacaggcaagauuaggaaguuggaaugaucagguucagauucauacaguagguauacuauucauuguauagucaaacagauuuccuugaacuuagaggaagauguaauugacugcacccugugcugucaauaauaagugaccuaaagggaaggauagacuauauuucaaauucuagucugccauuuaagauauuuaaagcaauaaugccaacucuacuuucugaucauuuuauuuugcaaggaaauuuuuucccagaauauuuuuucuuucuaugcauucuuuuauuuaauuacacaauaaauuuaaccagcuuuacagaccaauacauauauaucuacaaaggauguauuucauuuuugaugaacauacuauggcuuauuuaacaaguuauccuuacuaauaggcauuaagguuuccaauaaauauuucaauaaugaacauccuugaacauauuuuuauuuauuuauuaccauuuuaauaaccacauuuauuuucauuauucuuauagcacaucuauucuuagccacucaugugauuugaaaauacuuuuauauuaaaugucuauuuaaucaauauuuccucaucuuuauaaugauucauuugcaucucuuccaaaacuucaaguuaaugucuaaacucaauuuucuuuuguuucucuucuucuauuuuuauuuuaggugccagggguacaugugcaucuaugcuuucucauucaggcugucuagacaugcucuaggggaaaaagcugagccaaacaaugacacccacugagaauuuuaugcaugugggagaaaaaccccugaauaacacaaaaggaaaacacaauauuaauacagucuugcuauuacuggcaaugugggcacaaaguauaaaaaauuacauuucauguuuaggaaaaaagaugaaaaaauuuuuuuacuuguagaaagugccaaauaacaaaaauucuccauauuccuguaggauaaacucaccuggaauuucaucaaaugaauagaaaugaggaugaauaauauuccacuggcauauaauuggcaugaccacuauauggauugaaggugauuuuaaucaucaauggaagauacaauguacagugguuguuuucuggauuccggcuuuucccuccccuguauuaggucagccugacccuguacugugccauuuauccucacugacuccucccauaucccaaauuccaggaguuuauacuuccuguggcucacuuaagcagaggcaucuaaagaaugagaugcuugaaggugaguaucaccccauauguagccaacaucuucuuaaguagguuccaaugauuuagggaacuuuaaaagguucccaaauacauuuucuaaaauccacaguugccaugaucagagcuacuuggggaugacacagagaguuagaacauuacuucucagaggucuuauuucaauuguaggcaaacaugaucuaaucaccauuauaauaacaaguugggccacuacagggcuuuacaauguacacagcaccauggcaccuuuuaucugguuugagucugacuacaccccugagaagcaggcaaggcaaauaccauucucacuuugcugaaaaacugagggugagaaggguaauacagagugcaugugacagaagaaagguuggaacuaaauuccuuuuaaagaggcaccuacaagcaaaauuuugcacauaauuccaggaauuguguagaccacccauagccuauccaagaacaccagguuaaaaauauuugcccucagacagacugauuuaauuggucagggguggaacucagguauuuuuuuaaaaagcuucccaggaaauucauauuuguccaaaacuacuucaaaaauucauauuugucaacguugacuguuggguccuguugccuucuuucucauuuuuuuuccuuuccaaaucgcucuuuguuuuacuuaauauuauuuucuauuacgucuaucuuucuguuuuuagccuucucuucucacucagcuuuuguugcaagucuggaaauuacugaauacagucuucuuuggcucuuuccuucagacuacauacuacugccaucuauguuucuguucuuccuccuuuuucaaaacuauuauucucuccugaagcuucacccuucuagaauaucaguauuccaccucgauuauuuucuaccuaaugagcuaauuagcauuaauggaaaaacuacugaaguuaggaaaucagagaucuuccaguaagucaguggccucaggcccaaucaguaaaauaaggaaaaauauaccuaccugauagaauuuuugugagaaacaaaugaaacacauacucaaucaugggaauaaaauacucaauacucaauaauaaaaauauuuuuaaagacuaucuccuugaaguucuuuuuauuccuuaucuauuuuuugcugcaacccaauacaauauucuguacucuuuccaaguuauaugccucuguuuuuuacauacccacucucauuucuaauuuuaaaauuuagcauauguauucuauaaccccacagugcccagaaaaauguuauucuggauuuggcaagaauuuuuuguaaccccaguucuaaacuguuaauaauggcagggagaggugcuauggcuuauuauuaaacugcuuuauuguuagcucauuaaucauacacagguccagaagaauauucaaaauguuucuuucagguugaguagguaccugaucuaaacaugguccauuaugaguagguguucagaaaugacucaucuuuccuccaaucaucuccuuuagugucuugagagcucugagccuuugaccuuucuccuuauuuucuuuaccucuacagccucuuugcuucuuuuugcuauggucccuccuuagcugcaaaagaaugcagccugguguuauuucauucuauugaauuccauuuaggaugagguuuuggguuaguggugagguuuggaugguacuaggaacaucuaaagccaauuggaaugucuuuuccggcugcuauuaacaaauaccaaaaaguuauggggucucucccaguucuggagguugagaaguccaagaucagguuuccaccuugguuggguucuggugaagguccucuuucagauugcagauugccgaguucuugcuguguccucauguguugcaagggugaacaaguucccaugggccucuuuuauaagugaacuaaucccauucaugagagcucugccaucugaccuaauccucuccuaaaggccccacuuuuuaauacuauuacauuggggauuugaauucaacauagaaauuuggggaaaacacaaauauucagaugauaguacagaauuucaaauuuuccagauugacuucuuaggauauucuuaugcucauuaugcuaaaaaucucuguucaauauugagcccauuuagaugacuugucugugguauugugccaaaauagccucuuuuucugcccguggucacuucucaagagcccccuucuauuuuagacuugauuucuaucaugaaacagggaaaggaguguaaaaacccaucuagcuaaaaccaccacccagagcacagaccaggaauccagugcucugucaacugcuaauguuaguuuguuugaacuuuggaauuaauuagauguauacacaccuccuaacaaaauauuuaacaauugagucccuaucauucaugucucuucagucaacuuuuaggcucuucuuucucauucucugcaaccagaaacuguuuccccaccucugcucauccuuuaacaugcugucauacugccuuauuuccuuuuaccaucaaacuacuaaaaagauuagucuacaaucaggguaucuuuucccacucuucaauuccuuucaucuuaagcuucuacauucuucaccugaaggaaauugcauucuugaaggucucugcccucauaauugccaaauaaagugacauuuuggucucucuucuccucuaucuuccuggaaguuuugacaauguugacuaaucacuuuaaaauuuuuuuucuuuauauccacaguaagaguugucuuucuucuuuuauuuuucucaaugauucucucucucuuuuuugcuaaagacuucuuucuaaaguacaugugaggaaaucacuuaaguuccugguucucaacuuccucaccuauaaaaugaaaauauccauuccaaaaagaaucaugaacauuaaauuauauuagguacuccaaaaauauaauuauccuccuuuaguguaaacauuuaucagaauucugucuuugguacuaucucucuucaucauugaauuuuacgaaugagaauaaaaucuuuaccuuaagcccucaacucucuccagaaccccauaccaauauuuccaauuuguauaucaugcuucauguucaguaaaucuacaaaaccaaacuuaucaugucaucuucucccucaucaaaauaaacaucuguucaauucuuuccuauccuuauuaguagcauuccaaagucccaaucaacaaggcucaaaucauuagucaucuuuggcucccuuagaccuaauccaucuaucuacugcuaauucuuuauccaaagugucucuugcaccaaagacuacauaaaauguauaaaacauuauagccaaguguuacuuauauuagcauccaaaguaaaacaauguaaucugccauaucaacagaaccaagaguacacgcaauaaacugauagccuacauuguaguuaauguugaaacacuguaacauugucugcuuuccccaaagauagggaacaaggcaauaauucuugguuuuaccacuucauugcaucauuuuacuauagucacagcaauaagaaaaagaaauaaaaggcacaaauauuagaaaaaaaagucaaacuaucauuauuauaagaugacauaaaagaauccuauggaaguuauuuuuuaaaaaagcaaacaaguacucuagcauuuaaauaaaauuaaaaugguaauauaaaacucaacugcauuucuacaugccaacaacaaacaauuaaaauaugaaagcaauaaauaauacuaaauuauuaacucaguaaauaacaauuuuuuuccuuguagcaaaaauuaaaucuugacccccaccucacaccauacacaaagcaaucugagauggauuaucgaccuaaauauaaaaaccagaacgagaaaacuucuagaaaaaagugggagcauauauuuacaaccugggacaagucacaaaaacacuaaccauagaagaauaaaaugauacaucugacauaaaaauuaaaauauucugcucaucaaaaggcacuugagaaaauguuuaggcaaaucacagaguaggagaaaauauuuagagugcauacaccugagaaaggacccauaucuugugggguuacagaagaauuuauaaagaauuacuacaaauaaacaaucacaaagcugaacaccccuaaaaaaaagaggugagcagauacuucacaaaagaagaucuaagaauuggcaauaaccacagaaaaagguagucaugaucauuagucaccagaaaaaaugcaaauuaaaaccauaaugagaaaucauuucacacccagaagaauggcuaaaauaaaaaaguuuaaaaggcgagaauguggagaaaugaaaauucucacacauugcuacuggugacuauaaaauggaacaacuuuuuuggaaagcuguugggaagcuuuuuauaaaguuagcuauucaucuacccugugauccaacaaugccauucuuauuuaucuauaugaaaacauauguuuauaaaaaacacuuacauguguauauucauagcauauucacucauaaugguaaacaaugggaaacaacgcaaggaucaaucaacaggagaauuaaugaacaaauuguaauauaccauaguauauuaauccaaugguaaaccacuuaccaugaaagaaacaacauggauuaauuuccaaaccauuauguugagugaaagaaacccaaacagugauacgcacacagaaaacauacucaccauaggauuccauuuauauaaaguccaagaauagccaauccuaauacaugaugauaaaaaucugaacauucuugccuccaaggcaggaaggagggcaacuaauuagaaaggggcaagaggaaacuuucuggggugauggcaauguucuauauuuuguuuugagugguguuauaccuauguaaauaauuaaaguucaucaagcuauauacuuaagaucuguguauuugauucuucaauugugaaaaacaagauguuucacgaggaacuauuuuaaaaacaaagccaacacaaguaacauauaacuauucaguaaaaagaagauaacuagaaugucaauagaccuaccuaauauauauuucaaagauuuuuuuuucaaguauuuaaguacaaguaaguagaaaaauucaggcuuguggguuaauauacuggagagaaacaaagagaaaagaguaauaaccauuucagucacucugaauuugaaauagauugcuucacaaucuagaggauuuuaagacgugaaauaacugaaagaaacaaaggugaaaaagaucaaacacaggaugcagaacuaacagcugugacuuaguuaaugcauaugcugaauaaaaacaaacucaacaaagcacugggaagccggcagcuuccaaguaauuaacuaagcagaaacacaugcaauguguuaucagcccuaucucauauugaaagcaaggacuccuucguuacaauggaugcucuccauuuacagguagaguuacaagaaaauaaacuacauaaagguauacaagaggcaaaggaaaaggaaccaauuugcuacaucuaaguaguaucuauuuucagugaaugagauaaaaguucugccguuaccucaccuacucaauaucagucuucccacaauaaaagacugaacacaucagcuaauggucaaagaauuguaaauucaugaauaagggucacauuuacauuuuuauuuucaaaguucaacacaaguuuuaaaagugaaauuaucauuucaaucauauuauuaauuuuuaauaaauaaauuuuuagaacggucuuuaauacccauaaaucaaucuaacuccacacuuucugcauuuucagagagaaaaccagaauuaacaaauauguuagaguauuaaaccugugauuaaaauauaggcuuuuauauaaguucaucaauaauuaucuuuucuuuggaacaguagcucucaaccauuuuccaucccugacacaccugugauuugucagaacacagcaggagucuccuguucuauccauccauccauccucuaugcacauccucuagucuucaaauccuuuccugaaaccucauguccuaccugaauacucucucauaaguauuuccaugugaauauacuacucccuuucuacaaugaaugaggagcccccugaaggucauaacucauauggagaaauaagucaugcaccaaugucuccaggguggaagaaagaguagccuaauugaaguuauauucuuucugcaauuauauauagagaaagaaaauauauagauauauagcuguuauuguucuauuacauaaauacaggcugcauugguucuaauuuaaacaccaucauccugaguuacuuaacuuucucacuuauuuguuuuucuccuuaaagcauuguuauaacauuuaagaaagauggagucaguuacuaagauaaacauuuaaguaacgacagcaccaagaaauugggucaagauggaauuucuggcuuuaauucuaccucuagauuucuucaaagauaaccaggugaaccuaaacucaauuagaauaugcagagaaggauuuaugaaauaaugccucaguuauucagaucauggaucuauagaaaagaaucuguuuuucauucauugaaugaccaagugcauuuacauuagagaaucuacauugguauaaaaacaaauauauuuaauaaugaauuuuauuaacauauauaggacaaugucuuacuuaaauagcuuuaaaaugcuggaaaugcacuagaaacacauuaaccccagaaacaccuucauaugagagaaccagugucaacgaaaaugacagauagcaacuaaaucuggguuuagugagguuuaucuugaagcaaauagaccccaucaaauuuccuugaaaaagaggacauuuuguaaugagaugaaggugucacuauguuacccagacuggucuagaacuccugggcucaaggugauucucugccucagccucccaaguagcuaggauuacaaccgugugccacugugccuggcagaagacgacauuuuugaaaacauuuuucuucuccacauauuggggcacuaugucaaauguuaccugugccuaaaugccccugaaccugcauauuccauacuccuaaagaugugucaaauuauacaaccucaugaggauauuuuuaaccucugagcaggacuggaagaggcaaauauacuaaaguaaaaaaaaagaaacuccaaaucaguuggacaauguagccccuuuggagugccagugauguuaucuauaaacacugaaacacaaauugcacuugaauugaugaaggauauaggaaacaauuuauauuaaaguguucuacaaacugcaguggcuauccaaaauuuaagugccauuuuaucaaugaggaugaagauuauaauaaaaaugaucuaaaauaacuuauguuaaacaaggaaaaauauuaaacaaaucuugcuuauuuagaccuaaauagucuuaaaagacacauuuucccuacaauuuggcucaaaggauuuauucauacucuauaucuaaguagaugaugaauggcauugauugaauccaaaguccuccugucuuggauuuuaugaggcccauucagaacgagccagguugagaacaccaccaauuucguguucuggguccaucuguuggcaaaaauauaaugcaaacagcuuuauaagugcuauuuucaaugaaauaucacagaacagcuugucccaaugauauuucuaaagcuugccugcaaaccgccuacuggaaaauccaacugaaagagaagggagaaaagagagaaauccauagaggaaagagacaggaauggaaaaaagaacaaaggauaaagagagacuagcuagaggacugggaacacuggaggaaaacaaggagcaauauuaaacgcagacaauauucauugaaaccauaagaauagagaagauagagaaauauaaaaaucacuuggguuggaagacagagaaauaaucacaaaccaugcagcauuguccagaagaaugaagacaaaaggaucaggaaacaccagaaaauauguaacagcucaauaauuggagcauaauuauuaaaauguugugagagaaaaaugauguaaaauagcuauuuuucuaagucucacugcuucauguaacaggcacaauucauuuuuccaaaaacuaaugcagauuucaguguuuaucaccaacuugaaaggaagcaaacauccucuucugaguccccucuuuuaauuuagaaauccauugacauaccacauaaaacaguccaggcauugcaauauaagugauguacaugcauugauucaaaucaaaacacauuagagggaaaaugaugccauucugggcacuuaccuggggucgaaugacuuuuacaauauuuuugagggcaguaucaggggauggaggugaacaaucagguguugggccuguugagcuguuucuaugguuacuaguuccuggaguaguaacugcuaccucagaggcauuaucugugaauaaaaauagaacugccaugaaccuaaucacucaguuuaccuuuuaagacuugaaauuaauuuucugaacauaaauugagauuucaacuuuuaaaacugguaucaauuacaagaucauaaugaggaauaugcucaguaguauauuuuaaagauaaugcuuuuugaaugcuuuguuuccuucuaaaaugguaacuaucacccccuggaauguuguucugagacaaguguauuauuauucaauucauaaugauagauuauccagcauagcucuuaagacugcuacuacuauaugaauaacuaaaaccuuaccuuaacuaaaaagaauauaauuuuaugauaugauugggcuaaagcuuucccaauaaucucuuaaaugaguauuaauauuuauuaaagugggaguuuuauaucucccugaugcauaaaauccaaauucaagccuccucaaaugacuuuuccuagaaaucccacaaacuauagaaaagcacccuagugaaugaagcuugaugaaaaacugaaauuugugcaaaaugguuuuaugauguagauaaacacaaaauuaucacuccuagauaaguauagcaaccuauguggucaaagcuaaaugaauaaaauuucagaaucuaaauuaaucuucucuuauguucaguauuuaggaggggggaauaaagaaaagaugacuugaaaaucaacaacauguguaacauuuuuuucuuaaauucauauuaaagcaaaauaacaucaaggaugccauuuuagaauguuuaaaauacuugggaaaggaugaaaauuauucuauaaauaacuucugguagcacauagaaaaguuauuuuaacaacaauuuggcaaacuucaauagcuuuuuaugaaaacugcugcaagcucaaaucugccaaaaaaauaaaaaauaaaaaguuuacuucucuguuguuuuuaauuaguucccaauaauuuucuuuccuagacaguuagcugaacugauugcaaaagagacugagacugaauuuuuuauagaccaggaaguuucucuguuccugaucgcugucuacaauccccagugaaauacaggaauucaucaaggcaucuuuuccucauaaaacacaaagggaugaauuaucauaaaacucuaccuaccauauaaaaauauaacucagucucacugaggaauccagacaaaggcccauaaaacaaaaaauucaaguaugacacauagaauuacuuggaugacucauaaaauaagucuuaaaaguguccagagcacacucuucuaagauuuaacagaaaaggugggauuugaauuggcaucacaaaagagaugggguggucuucugaguagauuagaaaaccaugagucaauacugaaacacacaaaacauuagucagcaagaugcucugauucucuccaaccuaucccuuccuucuuucauucaucuaaaaacuacacauguaagaacacuuauuuggggcaacuaugagucaaauauuauguuauguucuaaagauuaacuaggaagaaucucuggccaaggacuggaggcagguagggaugaauagguuaagcacugaggauuuucagggcaguaaaacuauuauauuuaacaguauaauggugaguauacaucaucauuauauauuuguccaacucauggaauguauaaaucgagaaugaaccuguauaaacuauaaacuuugggugauaaugauguguccauguaguuucaucaauuauaacaaagguaucauuuuggagcagaauguugauaguagaggaggcuuuguguaugagaauauaugaacuuuguaauuucugcucaauuuugcugugagucuaagaaguucuaaaaauaaaaucuaugaauuuuuuuucaaaagaaucccugcccucgagaaguauacuguuggguuuuuuccuuuucuuuuuugagacagggucucacuaccaucacccaggcuggagugcaguagcaugaacacagcucacuacagccucaacuucccaggcucaagugauccucccaccuuagcauccugaguaucugggacuacaggugcacauuaccacaucuggcuaauuuuuuguauuuuuaguagaaaugggguuucgccauauugcucaggcuagucuugaacuccugagcuguagugauccacccaccucaaccuccuagagugcuaggauuauagccaugagccacugcacccagcccaaaaguauacucuuaaaugugucaucagacauguaaacaaauuacaaugcaauauaacuugagaacugauaacagauaaaggaagcaugauaaaaaaaaaacaggguggggugggggaguaaucagacuauggcuuggacagaagauagcugugaaaggcuucaguuuucaggcaagaaagcuggaacaaaacauuagauauuagggcaugaagguaggaagagcacaguugaagcuguuauuucauauacaaaaaaacuggagauaaguuugaaugagugaaaggaaguuuuauuagaauauaaacauacuuaauucuguaggcaaugagaaauauugaagacugagcagggagugacauaauaauagauaacuuuuauugagcauuuauuaugugcagacaagccauguuaaauuauuuuacuuauugaaucucauuuaauacccaaauuaacuuacaaaauacauuccacuaucaccaucccuauuuuacagagaaacucaucucaaaguuauauucucaguuacuggcagaaaaggauucaaauuucagacugaugccauguuacccuucugagaguuagcaugucauagcagguaugcaaaagauaugcauagguaugauuggguucauagaaacauagccugaagaagaucggcauaguugagguaggagcacacucuacuucaaaauauaguugaaccaacuuccagaaacuuaaaaaguagacauagacacuaugaaaaauaaauaauaaaaacaacaaaaaagucaaccauaaaaacaucuuuaggguaugccuuugaguacuauauaguauaauauuuaauauuuggaagcuggaagauauguuaagacuagagacccaagcuagaggucaugacguuagcauuuuggaguugauaagugauuagauucuggacauguguugaaauguccagaacuguugaaauagaccaagaauuuuuuugauggcuccugaauagacaaagcaaccuugaacaaaaagaaaaaacugagcacauuacacuaccugacuucaaaauauacuacaaagcuauaauaaucaaaacaacuugaugcuggcauagaaacagacacaucaaccaauggaaaagaacagaaaucccagaaauaaauacacauauuuuugguuaauuuauuucaaaggugccaacaacacacaauggggaaagggcagccucuucaauaauggcauugggacacuggauauucacaugcagaagaauaaaauuagaccuucaucucacacuauauacaaaaacuaacucaaaauggauuaaagcugggugcaaugguacaugucuguacuuccagcuacuugagaaacugaggcaggaaguuugcuugaacccaggaguuuaaggccagucugggaaacauagggagaccacucucuaaaaaaacauuuucuuaauuaauuaaagacuuaaguguaaaauugaagugguaaaacuauuagaagaaaacacagagaaaaaccuccacaacauugauuugggcaaugauuuuuuggcuaugaccucaaaagcacaggcaagagcaaaaauagacaaaugggauuaugucaaacuaaaaagcucugcacagcaaaggaaccaaugaagagagugaagaaacaauuuaugaaauaggagaaaauauuuguaaacaguaccucugauaaggaguuaacauccaaaauauauggaacucaaacaacucauagugagaaaacaauaaccugauuuaaaaaugggcaaaggaucugaauggacauuucucaaaagaggacauacaaauggccgacagguauaugaaaaaaaucccuaacaacacuaaucaucagagaaaugcaaaucagaacuacaaugaaauaucaucucaccccagggaaaauggcuuuuauaaaaaagacaggcaauaacagaugcuagcaaggguguggagaaaggggaaccacuguacacuguuaaugggaagguaaauuaguacagccauuagagagaauaguauggaguuccucaaaaacaaaauauagaauuaccacauaauccagccaucccacugcuggguauauauccaaaggaaaugaaucauuauguagaagagauaucuccacucccauguuauuguagcauuauucaguagccaagacauggaauuaacuuguguccauuaagagaugaauggauaaauggaaagaaaauguaauauauacauacaguggaauacuaugcugccuuaaaaaagaagggaauuccguuaucaguauagaugaaccuggaggaccuuguguuaagugaaauaagccaggcacagaaagacaaaugacacgugaucucacuuauauaugaaaucuaaacaaagucgaacucacagaagcagagaauagaauggugguuaccagggacuggggagauguuggucaaaggacacaaaauaucaauuagaaggaauaaguucaagagguuuaucauacaauauggugacuauaguuaauaacaauguauuguauucuuuaaaagaguagaucuuaagaguucucaccacaaaaaaaaugcuaaguaugugagguaauacauaugcuaaucaguucaauuuagcuauuccacaauguauacauguuuuaaaacagcuuguuguacacaauaaguauauauaauuuuugucuauuuaaaaauaauuaaauuuuuuaaaauuauugaugugcuggauauagggagagaaagagagaaaucaagaaugacucuaaggcuuuuggccugaggaacuaaaaggauagagcugccaucagcagaaaagggacagacuauaggaggagcauaaauucucuaccauauaacuuccaauauugccuucccauucucucucucccuuuggacucuauugaaguaaugcuagacagacuuuauucuuuuaaccauuuauucucucuuuucauucugucucucuguugcauuuuuaauaguuucuucuauuuauuuucuaguuuauugguucuuucuucagcugugucaaggcugcuaucaaaccauuuucuuaauuuuaguagacuuuucuguucuaaaauuucuauuugguucuuaaucaaguauaugaugucaguaguuuguauuuuuuaguuccuaaaaacauuuucaagcuuacuuuuauauuaaaauggcaaauacaauuggcuuugguuuuuuaaucugauaauuccagcaucuaaagucuuuacggauccauuucuggauuugugguucugacucaugcaauccuguuccgcuguuaguuucaucaucaauucuguguugcuuauuauucaaccuguuguuacaagauacacauuuaaauauaacuaacucuuagucuuuuaauaaauguuaauuuuuaaaagcaucgaaacuuauauccuaauaccagaugcugaagucugugaacaacuugccuguguaacacuagaucauuuauuuaaucuuucuggauuucaaguuucuuaacuguaaaaaugcaaaugauuaacuaccaucuucuaucauuuacgugugcagauaaaagaaaagaaaaauaacuuguauguuuuuaggcacauaauagggguuuucaguauaugaguuuccuuuuccauuaucaaaagaaacaccaucagaauuaaaauaaaauauggaagaucaaagaaacccagagggaaaacaagaaaacaaauaguuauccuuuuuagacaacacaucuagaguacuugcgugauauuugagagcaguaucuuuuagcuauuaacacaaauugguagggacagaauuuaguuccagaaauagcagaugauccuuugagacauuguacuguucaaaguuauccagagaaauaggaccaacaggaucuauccaucuaucuaucuaucuaucuaucuaucuaucuaucuaucuaucuaucuaucuaucuagacaaagauuuacuguaaggcauuagcucauauaauuaauggagccuaagaaguccaaagaucugcaguugguaagcuggaggugcaggacagccuauguguaguuccauuguaaauccaaaggccugagaaccaaggaaguugaugcuguaaauucuaauccaaagguuggcagacucgaagucaagagccaacauuucaguccaagucuggaggccuggaaaaaaacaguguuccagcucaagaggucaggcaggagaaauuccccuuuacucggccuuuuuguucaauucagguccgcaauuuauugaauaaggccaauaacaguaggguggaugauuugcuuuacucagucugccauucaaauauuaaucucauccaaaaacaccuucacagauacaucccaaauaauguuuagccaaaugugugggcaucucacggacuaguuaaguugaacuuauaaaauuaaacacaacaggaaugauucauugcaagggcuggucuuaacugcuuuugcacuaaagccagaagaaaaugcugggaacucccugcaaacuguaagccaacagcuucuugaauguuuuuuuucugaguauuuuaauacauaguauaagacaguggauaauuaaguacuaaauuauuuagaaaagacuaaguaucuucaucuucugaauccaugagcuauaccauuacacugauaauuugauuuuguacuaucuugcauuguucauuaacucuuccagacuagguuauauuuuugcauaaagucauauuucucucuauauagcucuuagcuuaaugcaauccuuuuaaaguaauaaaugaaguaaaguagauaaagcaaaaccugugucaauggaaaccaacacaaauguauuuaauaauaugaagaaagcuggucuggcuuuuauaauaauuccaugauccuuucaaagaaaauccaaaugagaagcauauucuagaagauauaugagucuuaagaagcugguuuauucccaaaauauccuugauaauauaauuuacaaaaaauaccaauuauccaguggacuugguaaaauagcagccuaugaccaagacaguuuuacaugcucaaccuacauuucacauaugcaguuacaaaauauugcugauaaaaaggaaaugaggcacauaaaacugcuuagggaaaacugcaaaauauacuugcaauuucagauugaaauaagaggacuaucuucuugucagauucccuuacuacauauuaauuauucauuaugaaugucaguuuagucuauaauaacaacauuagaaaaaauacuuauaguuuauuuuaucuuuuagaagaaaaauauucuaugacuauaaaauaauucaugugcaacauuacagucuaguauuuuaacaucaauacccagcauguaacaaacaguuuaaguauaccagggaccaugauagaugcuuuucagcugaagaauaggacugagauuacuucuggcugggaauucaagaaagcugucauggaagaggcaggaguuaugaaggccucugacagacuaguaaaauucaggcaugaagaaauggcugggaagggcguuccaugaguuggaagcagguugagcaaaauguagagagaugggaaagaggcacauuuguggaauaaagaagaguucaguuugaauaaaauauaauauucauggaggaaaugcuaagaaauggaggagucauacacaaagacuuugggcuuugaaaucagaaaacccuaagcugaaauucugguauauuuaacuucaguuucaucuucuguaaaacagugccuuucacauaguguuacaaagacaaaugaggcauguacagauacguguguguguguguguauguguaugucugugugugaauacauugccugacacauaguaagugcucaauaaaauuaucuauuacuauuauuaucagauauaugaauauaaucauaauagcaaauaaaacuagauagguggcuugaugccuuauuauggaaaauccuaagugcaucacuugcaucacuaaguaaucaucaaauauaaguauuuaauaaauccuaaucuaacaauucaugaagcacaauuuuuacguuuugguauuaagucaagaguugacaaauuuuuucuguaaagggccagaugguaaauauuguaagcucuguaaggcuacaugaucuuuguuguaacuacucuacucucuuuggguagcgagaaggcagccacaggaaauauauaagcaaauggguguguccguauuccaagaaaauuuuacuuacaaaaacaagcaguagacaagauuaaguuuguuggugauaacuuguagaucccugucuuaaguacuuccuauggaaauguuuucccuuuuauggacagaccuagaagaauguuauauuauacauuuucauuuccauauucauauuauagaugaacauucucacuguguaauuaaaaacuaagguuuucaauauaaagcuagaaauuugucauuuguacaaaaaauggcauuauaucuaacaccagggcaguccuuuguacacagcaacuguucaauauaugcucauuaaauagauaaauaaauaagaccaaugaaaucuuuacauuuuaaaguaacuuuguuguagugauuguacaugacuaccacuucugggagaaacaguacagaaaucauaaguaaaaaagcccaaguauccuguuucaguauuuucagugagaaaguacucacuauguaccacuugaggaagauaauauuuaacaguaauuuaagagaauuaguuaauaauccaaauaauuaacacauuuuacuuucucuagugaagguuuguuaaaaaguaacaauucucuuaaauauaccggguuugaacuuccauuacuaucaccaacaauaguguuaaauauucaagucuuaauuagccagcaacuuuaccagaugaaaugugugguagacagccucuaggauggucccaauugagccccaccucaugguauucacacuuuugugaaauuuuguccccuagggugugaguugaacucguugaauugcuucuaacaaagaagagaugaggccgggcacaguggcucacgccuguaauccuagcacuuugggaggccaaggugggcggaucacaaggucaggagaucgagaccauccuggcuaacauggugaaaccccgucucuacuaaaaauacaaaaaauuagccaggcgugguggugggugccuguagucccagcuacuccggaggcugagccaggagaauggugugaacccgggaagcagagcuuggagugagccgagauugcaccacugcacuccagccugggugacagagcgagaguccgucucaaauaaaaagaauaaaaaagaaaaaaaaagaagagaugaguuguacuucugggaauagguuauaaaaaaagacuguggcuuccgucuuguguguguccuccuucucagaucucuugcacugaggaaagcaaguaaccacauugugaacaaccuuaugcaaaggccuacguggcaugguaaggagcugaggcccucauuucaacagcccaccagaaacugaaccuuguuaacagccacgaguuagcuuggaagcaaauccuucagccccagucaagccuugaaaagacugcaguucuagccaacagcuugcuuacagccucccgggaaaucuugagucagaggcaucccgcuaagucccuccuaguuuccugacccugugagauaauuaauguuuguuauuuucggccacaaauagcaauagauaacuaauauaguaaauguuugguuaacguuuauaacauggccaacauguuugugcuacaauggugcuuagacuuucagccuuguuuugaaggagcugacuacuuaauggaaaacauagaagggcaaauauaauuacaaaauuguguuacuuaugcuacaaauucagcaauaugggaacacagaagaaugagccacuaaccaaaugagggggccagagcagaaaguuagguuauaggcagaaagagaaagugaagaaaaaaaauguaauagccuugaggaaugagugccaucaagaacucaaagagggagaagcauuccaggcaaagaaaacagaauaugcaacagggcagaagcaugaacgagcauuaugccuuugggaagcuauaaauaguucagcuuggcugaagcacaggauauguguggaaaagugaauggagaugauguuggcaagauaaaguauucagaugaaagauggaaagguguauaaaaagaaaacaaaauugccuuuguaaaagauuaaauuuuucuauuuaggaaaaaaagucagccacauugcauuucuaaaauuacuuuccuugaggcuaugaucaaaugcuacuuucaucuauaaaaagaacagaccacaaggcuauagucacuuuaaaauucucugcaugcaagaggccacaucugugugcuaaagaguagaaugauugacuagcagcuucaagccaauaagaacuuuggucuuaucuacaccagagaaguucuagcaaagagucaaaaacucgaagaguuagaggacaucuaaaaguccaagaucucaauucaaacauaaaaagcagugcaaugaacagaugguugggagagugugcucucucccaccuuuccuuuacuuuuguuuccuccucuuucucaacccauggcagggagauggucuuuuagcauaauaauucaccagagguaugcuguaauuggugagcaauauuaguaggagaaauguuuccuugucuuauaaauucucuacucugaagaaucucaaggauuuaugagaaaugcaggagucuuguagaauuuuaccuuccuccucccaggaugaugccaagaaugacaauucccuggccuuggcuagcaagacugaacuagaauccuggagaacugcacaguuaagaaaaugaaagagaaagggaggccauagaagauggguucccucccaaugcuuacuuuuauggacuaaauguuaagcaaugaagaaaguaaaaaagaaagaaaauauuuugcaucacaucaguaauccguggauucucuguuuuacuaaugcacuugugcuucaauucuuauuuuggcucuucaggcucuccugguuuugagucccauuuuagguuguaugcuuucccuuuugucuuaacaaccuauucuuuucuccgguuguacucuuaguggucccuguauucaucuucuauaucuuucuauucauuccaaaauuauguaaacacccaaccugaccaagacacacccuagcacuagcccaccaggccagaaccccuacuaaguagccacugacucucuaugaaaggaaguuagaaaaugaaccugcugagaguaaagggggaaaaagguggauaggaggcaggacuaacuugcagcugccacucagauggacagagcagcauguggagacccacaucaugaacuuuugcuccaagaacuaccauaggaacauaccaggaaagcagagaaaaccacagacccuuugaaggaguagauugccacugcaggcucugugagucagcuugcuuucucagcagggagguuuguagccuggggcaaguucuuaguccugcucauaggcugccuggaaauaaacggugcuguuggcagggcacagugggaaugagacuggccuuuugggcugugggcugugugggaguugggugaggucuguggcugcuggcuuuccaccacuuuccuggugaccugugcgacucagcagaggcagccauaaucccccugggauauaacuccauuggccugggaacugcaaccccacccccaacaguagccacagcaaaccccacccaaggagagucugagcucagacacaccuaacccuguccccacuugaugguuauugucugcuggcccugguagcugaagacuaaggacauaaucucuugggaacucuauggccccacccacggccugauccuuccuauacuacugcagcugaugugcuauugaaagcaccaccuccuggcuugaggacaaccaaaacaaaaccagcgcacuuaacaaaaauacaaccaaggacccucagagaguccacuucacucuccugauaccuccaccagagcaggugcugguaugguauccacagcugagagaccugaagaugggucaaaucacagaacucuuugcagacacucccaguaccagccuggagcccaguagcuccacugggaggcuagauucagaagaaaaauaacagucacuucagcucucaggaagccccaucccuaggggaaagggaagagcaccauaucaagagagcaccccauuagacaaagaaucuuaacagaagcccuugaguccuagaucuucucucugaaauagucuacccaaauaagaaggaaccagaaaaaaacaauucugguaauaugacaaaacaagguucuuuaacaccuccaaaagaacauacuggcuuaccagcaaugggucaagaucaacaggaaaccucugaauugccagaaaaagaauucagaaggucgacuacugagccaaucaaggaggcaccagaggaagguuaagugcaacuuaaagaaaucaaaaaagaugauacaggauaugaauggaaaaaucuccagugaaauagauagcauaaaaaaaaucacaacuucuggaaaugaaggacacacuuagagaauuacaaaaugcacugggaagucucacaauagaaucaaacaaguagaagaaaaaaacuucagagcuugaaaucaaggcuuucaaauuaacccaaucugauaaagacaaagaaaauuuuuuuuuuaaaaugaacaaggccuccaagaaaauuugggauuauauuaaaugaucaaaccuaaaacuaauugauguucccgagggagaauagaaaucuaaaaguuuggaaaacauauuugagggaauaauagagaaaaacuuucccagccuugcuagagaucuagacauccaaauacaaaaagcucaaaaaacaccugggaaauucaucacaaaaagaucaucgccuaggcaccugauagucaucagguuaucuaaagucaagaugaagagcugugaggcaaaagcaucagauaaccuauaaaggaaaacuuaucagauuaacagcagauuucucagcagaaauccuacaagcuagaagggauugggguucucuuuagccuccuuaaauaaaacaauuaucagccaagaauuuuguguccagugaaacuaagcugcauaaaugaaaaaaagaugguguuuuucagaaaaauaaacgcugaauuugccacuaccaagccaucacuaaaagaauggcuaaaaggagcucuaaauuuuuuuuuaaccucuaaaucuugaaacaaauccucgaaauacaccaaaauagaaucuccuuaaagcacaaaucucacaggaccuauaaaacaacaacacuaugaaaaaaaaaccaagguauucaggcaacaaauagcaugauaaacagaacagaacuucaugucuuaauauuaacauugaauguaaauggccuaaaugauccacuuaaaagacacagaaugguagaauggaugagaauucacuagccaaguaucugcugucuucaagagagucacccaacacauaaggacucacauaaacguaagguaaaggggugaaaaaagauacuucaugcaaauagacaccaaaagcaagcaggaguagcuguucuuauauuagacaaaacaaacuuuaaagcagcagcaguuaaaaaagacaaagaaggacauacauaaugauaaaaugacuaguccaauaggaaaacaucacaaaccuaaauauacaugcaccuaacacuggaagucccaaauuuauaaaacaauuucuacuagaccuaagaaaugagauggacagcaacacaauaauagucggggacuucaauauuccacagacagcagucaggucuucaagacagaaagucaacaaagaacuauacccuagaacaaauggacuaaacggauauuuacagaacagauauuuacagaauauucuacccaacaacugcagaauauacauucuacucaucagcacaggggacauucuccaagauagaccauaugauaggccauaaaacaagucucaacaaauuuaagaaacucaaaaucauagcaaguacucucucagagcacaguggaauaaaauuggaacucaacuccaaaagaaacccugaaaaccaugcaaauacauagaaacugaauaaccuacuccugaaugauuacugcauaaacaaugaaaucaauaugaaaauuaaaaaauuuacacugaacaauaauagugacacaaccuaucaaaaccucugggauacagcaaagguggugcuaagagaaaaguucauagcaucaaaugucuacuucaaaacaucugagagcacaaauagacaaucuaaagucauaucucaagaagauagagagacaagaaccaaacccaaaucuagaagaaaaaaagaaauaaccaagaucggagcagaacuaaaugaaauugaaaaaaaaaaaauacaaaagauaaacagaaagcugguucuuugaaaagauaaauaaaauugauagaccauuagcgagacuaacuaagaaaagaagagagaagauccaaauaagugcaauuagaaaugaaacaggagauauuacaaccaaucccacagaaauacaaaagaccauuuaagguuacuaugaacacuuuuaugugcauaaacuagaaaaccuagaggagauggauaaauuccuggaaauauauaacccuccuagauuaaaccaggaagaaauagaaacucugaacagaccaacaacaagcagcaagauugaaaugguaauuaaaaaguuaccgagaaaaaaaggccaggaccagauagauacacagcuaaauucucucagacauucaaagaagaauugguaccaauccuguugauaucuauuccaaaagauauagaaaaagagaauccccccuaaauuauucuaugaagccaguaucaccauaauaccaaaaccaggaaaggacauaacauaaaaagaaaacuacagaccaauaucccugauuaacauagauacaaaaauccuaaacaaaauauuacuuaacugaauccuacagcauaucaaaaagauaauccaccaugaucaacuggguuucauacaaggaaugcagggaugguuuaacauucacaaaucaauaaaugugauacaccacauaaacagaauuaaaaacaaaaauuacaugaucaucugaauagaugcagaaaaagcauuugaugaaauccagcaucccuuuaugauuaaaacccuaaguaaaauuagcauaaaggucauucguuaauguaauaaaagcaucuaugacaaacccacagccgacauuauacugaauggggaaaauuugaaagcauucccccugagaacuggaacaagacaaggaugcccacuuucaccacuucuauuaaacauaguacuggaaguccuagccagagaaaucagauaaaagaaagaaauaaaggccauccaaaucaauaaagaggaaguuaaacugucacuguuugcugaugacaugaucacauaccuaggaaacccuaaaggcuuauacaaaaaguuccuagaacugguaaaugaauucagcaaaguuucaggauacaaaauuaacauacacaaaucaguagccuugcuauacaccaacaguuuucaagcugagaaucaaaucaagaacucaaccccuuuuacaauagcuacaaaaaaaaaaauuaggaauauacucaaccaaagaggugaaagccugcuacaaggaaaacuacaaaacauugcugaaagaaaucauagauugacauaaacaaauagaaacacaucccaaucucaugaaugagcagaaucaauauugugaaaaaugaccauacugccaaaagcaaucuacaaauuaaaugcaauucccaucaaauuaccaccaucauucuucacagaacuagaaaaaacaauccuaaaauucauacggaccccaaaaagagcccacauaaccaaaacaagacuaagcaaaaagaacaaauccagaggcauuacauuacugaacuucaaacuauacuauaaggccacaguugccaaaacagcaugguacugguauaauaacauauggaccaauggaacugaauagagaauccagaacccagaacccauaaauaaagccaaauguuuacugucaaccagucuuugacaaagcaaacaaaaauauaaagugcauaaaggacacccuauuuaacaaauggugcugggauaauuggcaagccacguaaaagaaugaaacuggauccucaucucuccccuuaaacaaaaaucaacucaagauggauuaaagacuuaauucuaagaccugaaaccauaacaauucuaggagauaacauuggaaaaaccuuucuagacauuggcuuaagcaaagacuucaugaccaagaacccaaaaacaaaugcaacaaaaacagagauaaauagaugggacuuaauuaaacuaaaaagcuucugcacagcaaaagaaauaaucagcagaguaaacagacaacccacagagugggagaaaaucuucacaaucuacacauccaacaaaagcuacaaggaacucaaacauaucagcaagaaaaaaacagucucaucaaaaauugaguuaaggacaugaauagacaguuaccaaaagaagauauacaaauggccaacaaacauauaaaaaaaugcucaacaucacuaaugaucagggaaaugcaaaucaaaaccaaaaugagauaccaccuuacuccugcaagaauggccauaauaacaaaaaaaaaaaauggauguuaacauggauguggugaaaagggaacacuuuuacauuguugaugggaauguaaacuaauaaaaccaccacugaaaacaguguggagauuccucaaagaaguaaaaguagaucuaccauuugauccaacaaucccacuccuggguaccuacccagaggaaaauaagucauuauacaaaaaaagauacuugcacacacauguuuauagcagcacaauucacaauugcaaaaauauagaaccagcccaaaugcccaucaaucaacgaguggauaaagaaaaugugguggauauauacauguauauauauauauauauacacauacacacaccauggaauacuacuuagccauaaaaaggaacaaaauaauggcauuugcagcaaccuggauagaacuggugaccauuauucuaagggaaguaacucaggaauggaaaaccaaacauauguucucacucauaagugggagcuaugcuaugaggaugcaaaggcauaagaaugauacaauggacuuuggagacucaggggaaagaguggaagggcagugagggauaaaagucuacacauuggguacaguguacacuguucaggugaugaguacaccaaaaucucagaaaucaccacuaaagaacuuauucauguaaccaaauacgaacuguuuccuaaaaaccuauuaaaauuaaaaaaaaagaagaagaaaaugaacuugcuaaaucccugaauaaaauaucacaguaguuggaggugaaaugacauucauucuuccacaugacaguguaaauuccaguaguauuccuucacacucauuuaaaaaugagucuaaucucaucagaugaugcuauaguccauacuuccucauagcuauaauuuaugaacuucuuuuuacucucuuuuauuuaucagagaauuagcauguaucucccaaucuugcuuuccaccucaagccuaucaucauuuugggaacugucaguuuccucguacauuuucaaucaaucucuugagccugaguguuuugauuucuacuuacguaaucuuugcuuuaauucuauucagauuaccaugucuaaggcuaacccauguauuucauuaugaacagcaacuacuucauauagauauuuaaucucuaguaacucauucuguggauacaauguccaaucacuuccucucucuuccacacuacaucuauuguuuaaucccaucucuauccuuuuauccaucuaguuucauccaaccuaucagucccuuuccaucuucacauuuacuuauuuaguuuagacacaauggcccaucacuuaacaacucucuugccaguaacuacauucacucuuguuauuuuaccacauacacugagcaaaacccuauuccuauuugcaguugacacuuuaauguaccacccagauucaacuucagauauaaaacauuuauucuccuagcuguaugauguguugcuggcagacagucuucagcugucagcuuucuuuuggaauugccucaacugaagagaauggacugacccaaggccaugcccccuuccaggugcaagcugcuuucaaugucaggucaacacaaguguauaauaguccuguccuaucgccaacuuggaaugacuuugaagagucaucccaguuucagaauucccuagggagccuuuggauggcuauauugagacuucaucacagccugaucucuccagcugccauuucuggcuucccuuuaacagguguugccuccgaaaucacucaauaaaucuccuguaugcuaaccuacaucucaaagucagcuuucuggugaauccaucuuggauugaacucaguuguucucaguggccccuucugcaucuuuuuaaccaauuagguacuaaugacugagacagaaaaaucauacaacugcuagaaauuaauguuaucaaaugauuugauauucucugauaugguuuguauacuugucuccuccaaaucucauguugaaauguguuccccacuguuggagaugggcauacugggagguguuugcauuaugggaauggaucccucaugaauggccuggugcccucccuguggaggucaugaguuaccaugagaucuggcuguuaaaaagagucuaggaucuaccucuucucucuugcucacucucucaucaugugauaugccuucucccccuuuaccuuccaccaugaguaaagguuccugaggccucauuguaagcugagcagauguucaugccaugcuugaacauccugcagaacugcaagccaaacaaaccuccuuucuuuauaaauuacucagucucagguauuccuuuacagcaauacaaaauggaauaacacaugcuuucacaaauaauucacacggugaaaaaaauacccuaauagaaaacuggacuaaaaacuaccaacaggcacuucacaaaagaaaaguacaaauaaauguauaagccuuuugccucagcuucugcucaagccuuuguauaggaaugcauggauggaauacagucuucugguuuuguuuugauuaauaugugaagacaagauauucacaagcuuaaacauucaaaugcggcagccaagauggccgaauaggaacagauccggucuacagcucccagcaugagugacgcagaagacgggugauuucugcauuuccaucugagguaccggguucaucucacuagggagugccagacagugggugcaggacagugggugcagcacaccgugcgcgagccgaagcagggcgaggcauugccucacuugggaagugcaagggggcagggaguucccuuuccuagucaaagaaaggggugacagauggcaccuggaaaaucaggucacucccacccuaauacugcgcuuuuccgacaggcuuaaaaaacggugcaccaggagauuauauccugugcauggcucggaggguccuacgcccacggagucucacugauugcuagcacagcagucugagaucaaacugcaagguggcagcgaggcuuggggaggggcgcccgccauugcccaggcuugcuuagguaaacaaagcagcugggaagcucgaacuggguggagcccaccacagcucaaggaggccugccugccucuguaggcuccaccucugggggcagggcacagacgacaaaaagacagcaguaaccucugcagacuuaaaugucccugucugacagcuuugaagagagcagugguucucccagcacgcagcugcagaucugagaagggacagacugccuccccaagugggucccugaccccugacccccaagcagccuaauugggaggcaccccccaguaggggcagacugauaccucacauggccggguacuccucugagacaaaacuuccagaggaacgaucagacagcagcauucgcgguugaugaaaauccacuguucugcagucacugcugcugauacccaggcaaacagggucuggaguggaccucuagcaaacuccaacagaccugcagcugaggguccugucuguuagagggaaaacuaacaaacagaaaggacauccacaccaaaaacccaucuguacaucaccaucaucaaaaaccaaaaguagauaaaacuacaaagauggggaaaaaacagagcagaaaaacuggaaacccuaaaaagcagagcaccucuccuccuccaaaggaaugcaguuccucaccagcaacagaacaaagcuggacggagaaugacuuugacgaguugagagaagaaggcuucagacgaucaaacuacuccaagcuacaggaggaaauucaaagcaaaggcaaagaaguuaaaaacuuugaaaaaaauuuagaugaauguauaacuagaauaaccaauacagagaagugcuuaaaggaguugauggagcugaaagccaaggcucgagaacuacgugaagaaugcagaagccucaggagccgaugcgaucaacuggaacaaaggguaucagugauggaagaugaaaugaaugaaaugaagccagaagggaaguuuagagaaaaaagaauaaaaauaaaugaacaaagccuccaagaaauaugggacuaugugaaaagaccaaaucuacgucugauugguguaccugaaagugacggggagaauggaaccaaguuggaaaacacuaugcaggauauuauguaggagaacuuccccaaucuagcaaggcaggccaacauucagauucaggaaauacagagaacaccacaaagauacuccucgagaagagcaacuccaagacacauaauugucagauucaccaaaguugaaaugaaggaaaaaguguuaagggcagccagagagaaaggucggguuacccacaaagggaagcccaucagacuaacagcugaacucucugcagaaacucuacaagccagaagagagugggggccaauauucaacauucuuaaagaaaagaauuuucaacccagaauuucauauccagccaaacuaagcuucauaagugaaggagaaauaacauaccuuacagacaagcaaaugcugagagauuuugucaccaccaggccugcccuaaaagagcuccugaaggaagcacuaaacauggaaaggaacaaccaguaccagccacugcaaaaucacgccaaauuguaaagaccaucgaggcuaggaagaaacugcaucaacuaacgagcaaaauaaccagcuaacaucauaaugacaggaucaaauucaaacauaacaguauuaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggaagggguugcaauccuagucucugauaaaacagacuuuaaaccaacaaagaucaaaagagacaaagcaggccauuauauaaugguaaagggaucaauucaacaagaagagcuaacuauccuaaauauauaugcacccaauacaggagcacccagauucauaaagcaaguccuaagugaccuacaaagagacuuagacucccacacaauaauaaugggagacuauaacaccccacugucaacauuagacagaucaacgagacagaaaguuaacaagaauacccaggaauugaacccagcucugcaccaagcagaccuaauagacaucuacagaacucuccaccccaaaucaauauacauuuuuuucagcaucagaccacaccuauuccaaaauugaccacauaguuggaaguaaagcucuccucagcaaauguaaaaaaacagaaauuauaacaaacugucucucagaccacagugcaaucaaacuagaacucaggauuaagaaacucacucaaaaccacucaacuacauggaaacugaacaaacugcuccugaaugacuacuggguacauaacgaaaugaagacagaaauaaagaaggucuuugaaaccaacgaaaacaaagacacaacauaccagaaucucugggacacauucaaagcaguguguagagggaaauuuauagcacuaaaugcucacgagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaauuaauaaauccaggagcugguuuuuugaaaggaucaacaaaauugauagaccgcuagcaagacuaauaaagaagaaaagagagaagaaucaaauagaugcaauaaaaaaugauaaaggggauaucaccaccgaucccacagaaauacaaacuaacaucagagaauacuacaaacaccucuaugcaaauaaacuagaaaaucuagaagaaauggauaaauuccuugacacauacacccucccaagacuaaaccaggaagaaguugaaucuaugaauagaccaauaacaggagcugaaauuguggcaauaaucaauagcuuaccaaccaaaaagaguccaggaccagauggauucacagucgaauucuaccagagguacaaggaggaacugguaccauuccuucugaaacuauuccaaucaauagaaaaagagggaauccuuccuaacucauuuuaugaggccagaaucauccugauaccaaagccuggcagagacacaaccaaaaaagagaauuuuagaccaauauccuugaugaacacugaugcaaaaauccucaauuaaauauuggcaaaccuaauccagcagcacaucaaaaaucuuauccaccaugaucaagugggcuucaucccugggaugcaaggcugguucaauauacacaaaucaauaaauguaauccagcauauaaacagaaccaaagacaaaaaccaggugauuaucucaauagaugcagaaaaggccuuugacaaaauucaacaaugcuucauucuaaaaacucucaauaaauuagguauugauggguuguaucgcaaaauaauaagagcuaacuaugacaaacccacagccaauaccauacugaaugggcaaaaacuggaagcauucccuugaaaacuggcacaagacagggaugcccuuucucaccacuccuauucaacauaguguuggaaguucuggccagggcaauuaggcaggagaaggaaauaaaggguauucgauuaggaaaagaggaagucaaauugucccuguucgcagaugacaugauuguauaucuagaaaaccccacugucucagcccaaaaucuccuuaagcugauaagcaacuucagcaaagucucaggaaacaaaaucaauguacaaaaaucacaagcauucuuauacaccaauaacagacaaacagagagccaaaucaugagugaacucccauucacaauugcuucaaagagaauaaaauaccuaggaauccaacuuauaagggacaugaaggaccucuucaaggagaacuacaaaccacugcucaaugaaauaaaagaggauacaaagaaauggaagaacauuccaugcucauggguaggaagaaucaauaucgugaaaauggcauacugcccaagguaauuuauagauucaaugccauccccaucaagcuaccaaugacuuucuucacauaauuggaaaaaacuacuuuaaaguucauauggaagcaaaaaagagcccacaucgccaagucaauccuaagccaaaagaacaaagcuggaggcaucacgguaccugacuucaaacuacacuacaaggcuacaguaaccaaaacagcaugguacugguaccaaaacagagauauagaucaauggaacagaacagagcccucagaaauaaugcugcauaucuacaacuaucugaucuuugacaaaccugagaaaaacaagcaauggggaaaggauucccuauuuaauaaauggugcugggaaaacuggcuagccauauguagaaagcugaaacuggaucucuuccuuacaccuuauacaaaaauuaauucaagauggauuaaagacuuaaacauuaaaccuaaaaccauaaaaacccuagaagaaaaucuaggcauuaccauucaggacauaggcaugggcaaggacuucaugucuaaaacagcaaaagcaauggcaacgaaagccaaaauugacaaaugggaucuaauuaaacuaaagagcuucugcacagcaaaagaaacuaccaucagagugaacaggcaaccuaaaaaauggaagaaaauuuucgcaaccuacucgucugacaaagggcuaauauccagaaucuacaaugaacucaaacaaauuuacaagaacaaaacaaacaaccccaucaaaaagugggcaaaggauaugaacagacacuucucaaaagaacacauuuaugcagccaaaaaacacaugaaaaaaugcucaucaucacuggccaucaaagaaaugcaaaucaaaaccacaaugagauaccaucucacaccaguuagaauggcaaucauuaaaaagucaggaaacaacaggugcuggagaggauguggagaaauaggaacacuuuuacacuguuggugggacugcaaacuaguucaaccauuguggaagucaguguggcgauuccucagggaucuagaacuagaaauaccauuugacccagccaucccauuacuggguauauacccacaggacuauaaaucaugcugcuauaaagacacaugcacacguauguuuauugcagcacuauucacaauagcaaagacuuggaaccaacccaaauguccaacaaugacagacuggauuaagaaaauguggcacauauacaccauggaauacuaugcagacauaaaaaaggaugaguucauguccuuuguagggacauggaugaaauuggaaaucaucauucucaguaaacuaucgcaaggacaaaaaaccaaacaccacauguucucacucauaggugggaacugaacaaugagaacacauggacacaggaaggggaacaucacacucuggggacuguugugggguggggggaggggggagggauagcauugggagauauaccuaaugccaaaugacgaguuggugggugcagcacaccagcauggcacauguauacauauguaacuaaucugcacauugugcacacguacccuaaaacuuaaaguauaauaauaauaaaauuuaaaaaaaaauucaaauguuuccucuuuuaccucauuaugauuucuuucaaggcagacacaaugugucuaauuugucuuuauaucaccauuacacauuacaguagaauucacuuuauuaggagucaggacucaauuuuugaacagucagaguauuacggacaaaacaauauuucauguauuuuuaaacaaaguauuucacaucauuuacuuaauaucuauauuuguuaaauacugaugagaacaaaauuucaaguaucuagaauuuagcaaagaaguuaaauguccaacuaaaauaaguuuaaauuuaaaugauuaaauuguuuguuguauuucagauucuauccauuuuacuuuaauagaaaaauaucauucauaaaaaaguuuggcuggccacagugacugacaccaaaaaucaaagcauuuugggagacugagguaggaggauugcuugaggccaggaguuccagacaagccugggcaacauaggagacccccguaucuucaaaaauaaacaaauuagugggauuuggugguacaggccuacagucccaacuucucaggagacugaggcaggagaaucacuugagcucaggaguuuuaggcggccgugaguuaugauuaucccacugcacuccagccuagguaacagagacucugucucuaauaauaauaauaauaauaauaauaaaguuuucaugaaaaaaagaaauauuaauaaaauuuccuaaauuggagacaugcacucauuauccacauauaucaacauuggucuuauuuucauuaugguauacuguaugagcuauggaaauuauuaaguaucaagcauuaaauuaccugccaauucuuguucauuauacaaucacuggucucagaagaacauaaucauuacaaagacaacuucaaaaguaggagugacuaucuuuaaugcuuuaaugacauuguagagcaucacaucaugauuuguuauggaguuuaguuuuccucuuaauuacuaucacacuucaaucuaaaugaauuuagauuucauguaacauuuugacuuuuuggaaggucaugguuucuucauuaguaggcaaaacuccuacuuaggaaagcuaucaauuccucaauucuccuauuauuuuuauacaugugguuauaguuuaauagauuacuucuuuuauaugcccacugcagcaugugaauuuuaugcuaacaagagugugcacuuaggcacacaugcaauauagcuaugauaugucuaucauauaaauuaaauaugugccaaguauuucauggagcuaauacauuuuacucaaaaugucaguaaauucuagaaaaacuggauggaaauugccaauuauaaaaugagaguuuugauugaaguccacauuagccaggaacccauacuuugguuaccugauauuuuggcauaaaugugaccacauauucaucuuacuauauuauuaccauaugaacauauauuuccuuugaaaugcuaucauguucuucaaguuauaugaauacuaaugauaagagaucuuacauguuauaaaaggaauacauuguauggaauuacaauuuauuuagacauacuuugggaaaaguuugauugcauuucauaugcguucauaaaucaaauugaacuguuucaggauuuucaggaagcaaaaugacaaccaaaaguauaauuuaauccuaaagcaucuuuccucuuuuuuucuuaauacucacagcuaaacuuaacugaaaguaaaguuuucauucuaagcuuuccagguucauuaaauuguuccuauauccucacaaaaucaugauuuuuguuuaaaauuuaaggacauuuuuguuguuguuaacaaaauauugcuuaaauacuuguuauacaucauauauauuuaugaguccaaaaguaccuaguuauuauaacuuuggaagcccagaguccuguuuaaaaaaaaaauuagaugucacaaaaggccucugagcucuugaugaauguguuauaaguuuuguguacaucuuaagggaccucuuucacaagcaaccagaaguccuuuuguaauuacuuaugcucaacaucuauuucuaauuugcagagcuaugaugaggaacauccccaguucacacaccacuuggcaacucugaacucacugaucaaugugucaguagacagguuuguaaugaguagacauaaaacaacauaucacauaugcgugcacacacacacacacacacacauacacacgcucuuuaaagugcuuugaaguguuuacucuuuggucugcuacucauggaccaaauauuauuaaaaaauauguugcugcuacucuuccaaauauacuuaaaacucugacauguaaugcagguuuuccuauaaucugugaaaucccugcugccuuucaaaaaaaucauucuaauaaaaacagagauaaauuuacccagaagaguaaacuagcaugaaaugcccuguuuuugcuguugucacaauucauuguuaaguuauuuaguggucccuuauuaaaugcccuuagaauucguagugcaaaacguuuuuacauagaaugggaguccuauaugacauauuuuaauuuuuacauggaaugacauuccuauauaacaaauuuuaauccuguuaauuuaacuaauuacauaaaccuaaccaccacaguaaauuauagucugaccuaaaagaaaauauggcaugagcugagacaaaauguauccaguucucagaacauaucuaugucuccucuaauuuguaggucuuuuuuccuuuguaugacacuccacuuaaauauccugccggaccuagcucaaaugcuauuuuuucugcagcgucuucucuggcucggucagucaguaacugauguuucuuccaucauuucuucauauaagaucaggcucauuacauuauaauuauuuagguaucccucugucucccuacagagcgugagcuccuugaaggcaagaaccuuuuuacauuuucuuuacacucucagaccuaaguauaguacuggauguuaaauuaauaaauacaugcaagauacuauaucaacuaaauuagauauuucaaaauaguuuuguuguuguaacaaaaauuggauguuuuguagauguuuauaauucuguuuucauuuuaacuaauacauagaguuccacuuuauuaaaacauauccuuugauuaccuuauagcuagacacagaaggaggaaaauaggaggguaaaggauuuuaaaagcauuuggggauuuuuaaaaaaggcuuccagagacuaauaaaucacugaacaguaguaacaaugcugucaucaccaaucucuauacaccgaguuucaugcagcauuuaagaaagccuaugaguuaaacugcgcuuaaaauaagauauauauuugcuuuuaaccaugucaaauugugcaugaaaagaaaguccuugaaggcacuauaccaaauguuauaaagcucaccucuggcuggagagauuauggauuaauuuuuuaaaauauuuuuccuauuucccuaauauucuucuaagagcaugucuuacuuugauuuacuuauauuuguuucaaauauuggcuauuauuuuuuaaagcauuacagauacuuuuaaaaucucuuuuauauccugucacaaaccuauuuccauguugccuucaugaguuaaucaccauccugaaguugguauguauuauccgucugugccuuuauacuuuuacuauuuauguauauagucauuagacauauuaauuaugucacagacauauuguguuuuaaauuuacauuaauaucauaugacaauucugacuccuuuuuuucauuuaacacuuucaauauagauccacauggauguuuauaauccuacuguuuuauuuuaacuaauacauaguguuccauuuuauuaaaauuuaucuuuugauuauuuuaugaauagacauuuuguuuuuucguaauuuuucauucuuacaaacaauauugcagugaauauccgugagagacuuaaaguuuucuuuucaagagccauaccuaguaguacaauuaauugauagauagaagaguaugugcauuucaaacuuuuaaaaauauugaugaauugucauccaauguggaguaccaauuuauaguccuaugagaauuccuguuuuucuauauccuuuacaauacuugauauugucagaacucuuguuuucugucuuucuaguagauggaaauacaacuggcaccucauuggggccuuaauuuaaaugucccuguuaccuguguuaacuauguuuauugguuauucaaaauucauuuucagggaauugucuuugccaauuguuuccauucuuuguuugcuuuuuguuguugucuuuuccuuacuuuguagugcuuauaccuucucaguaugugcauuauaaacaucuuucccaguuuguggcauuuuaaaaguauuuugugacaugucaugcuaagcaugagcuuuaauguaaucaauccuaccaaucuucuuaaugauguguacuuuuugucuuguguaagaaauccuucccuaaacuaagauguccauguggauuacuuuuuuuaauuuguuaaauugaggaauuauauugaaagauuuuugguggcugaaauauccuuagaagagugaguuaaguucuacuuaguaugaucuacguuuuaaugcauuauugaauucaaugugguaauauuuugcuuagacuuaguacaucuguuuucacgcagagauuaauccauauauacuguucuuguacucuccuuguccauuuucguauguaagucaugaaaguacaaaguuggguaguuuacuucuuuguacacucucuucaacaguuuguauagcauugguauuaucuguucauuaagguuugauaaaacuaucuuaucaaaccauuuugcaauucuauucuguuaaaauuuacugaguuaugacuaguaauuaguacuuuucccagaaaauuguacauuuuaugucuuaaaauauaaagaagaaauuaauaaaaucaaguauaucagugguuacauuaaauauaaguagaauuauccccaauaaaaaccaaacauggggcuaaaaaguuagacacauuuuuuuaaaaaaguucuauccugcucauuagaaauacaccuaaaauaaaauaaagcuggaaauaaauagaaaagaagugaaaagcaaaggcaaacaaaauaacagaaaugaaaauauuaaaauauauaaggucauauuuuagaauuaaaauuguuaauagaaauaaagggaauacuauauaaugacaaacaugaagaaauuuauaaagcaauugugguaucauucuaggaguaaaauccuggaaacuauuuuaucugaaacagaaaccagacucaaaugccuuccauugccauuuguucaacauugucuugaagguucuacuaaauauaucaaagugggaaauuaaauaauuacuauaaauauuggggaaaagagugaaaauauuuauuuuuguugauuacaugauuauauauccaaaagccucuauaaaacucaaaagccggcugggugggguggcucaugccuguaauccaagcacacugguaggccgaggugggcagauaauuuuaggucaggaguuugagaucagccuggccaacauggugaaaugccaucuguacuaaaaauacaaaaaaaaaaaauuagcuaggcaugguggcacacaccuguaaucccagcuacuugggaggcugaggcaggagaaucacuugaacccaggaaacagagguuugcagugagccgagaucacaccacugcacuccagccugggugacagagucagacucuguuucaaaaaaaaaagaaaaaaaaaaaaccucaaaagcuuaaguuuuaaaguaaaauauauuaaaauuaaaauaauuuuguaagguagcugaauacaacuaauauauuaaaaauucaauacuuauugugcauucuaacaauaaacaccuauaaauggaaaugggaaaaaaaauucuuucaacagagugauaaaaacuaucaaauagaaacuacuaagaaauucauagaaauuguaucauuuaaaaaacuauauauuuuauuaaaugucauguaaaaucugaauaaaucuaggacaauauaaaauauuaaaagggcaauuccccaaaaguaauauaaacauaaaauuaaauuccauuuuuuuauaauuccauuuuuuuggauguaguucuuuugaaauuggaugaaauuaucuuaaaacucauaugguaaaauaaaugaccaaaauaacaaagaaaguaugaaaaauaauaguuaaaaaaagaaugccuguccaaauagcagaaaagauuauacagcuacuguaauuacauuaaucagucauauaaaaaaugaagagcaauaaaaauauguccaaauauauagaauuuuauaaauaacaaagaguguaugugaguaggaaaaggaaagcuuguuuaauuaauaaucauaacacaaaugaaagaaaguaaauuuaaaccccuauuguaacacaguauuaaaaaauccagauggauuacagaauugauuuuaaacaauaaaacaauaauaaucuuaaaauaaauuauaggaguucauuaguauagccugggauaagggagaauucuuaaucaagacaagaaaccuagaagaaagaaagaaaaagauugauauauuucauuacauaaaaauugaaggccaggugcggcaguucacgccuguaaucccagcacuuugagaggcugaggcaagcggauuacuugaggucaggaguucaaggccacccuggccaacauggugaaaucccaucucuacuaaaaauagaaaaauuagcuacacaugguggcacacgcuuguaaucccagcuacuugggaggcuaaggcgggagaauugcuugaaccugggaggugcagguugcagugagcagagauugccacugcacuccagccuggacaacagagagagacucugucucaaaaauaaaauaauaaaauaaaaauugaaaagauaucacaauuaaucaucagaaaaaugacaaauugagaaagaauaguuguacuacauauaacagauuaaggguuaauaacugugaucuauaaagugauaaaauaguauaaaauugggcaauuuauaugaauagcaauucagagaaaagcaaaucuaaauuaucaacaacuauuugaaaaggagcuugaacuaauaguagcugaggaaguacuaauucaaauaaaaaugugauaucuauuuugcacuaucuucacuggaagaauuaaaauguagaagaauaaagauuauauuagcuaucuauuucuguguaacaaauuaccccaaaacuuaaaaccgcaaauguuuauuaucuugcaguuuucauggcugagggucuagguauggcucugcugacucagggucucgaaggcugcaauuaacgugucaauugggccuauggucucaucugaggcuugacugggagaaauugacuucaaagaccacucacaugguuguuggcagcauucagcucccacaggacuguuggguugagggccucaguuucccacuggcuguuaauccaaggccucccucaguuccuugucccaugggccucuccacggaacacaaagugcuccaucaaaaugagugaaccagacagcaggagagagcuaauaaaacagaagccagaggucuuuguaaccugaucucagaagugacaugcauuauucuuuccauauucuauucauuagaagcaaauuacucaguccagucuauacauaaagggaagagauuaaacaaaggcauaaauaccaggaaagcggaucacuggcaguuaucuuagaggcuucauauggcaguuguggagaaaaagacugcaggcuaacauuguugguggcaauggaaacugauacagcuguuuuggaaagcaauggcauuaagaucagucccuccgcaucucauucagaggucacuuugguuugcuagguuauuucccgauuuuacaacugcaagcccacauccuggaaaucccuucaguccuaggcaaaccagcuugguuugucagccuacucuagagccagacugucuggguuuaaaucauggcuccauacuuaacuagcaaugccaccuugaguaaguuacuuaauuucucuaugucucagcuuccuuauuuguaaaauaagcaugauaauaucauguuugugggaaacugagacaguaccuguaaagugcuuaaagcaaugucuggcacauuaaaaauucucaaugauauccauuguuacuaucauagauauuaaaauauauguauccuuucacuaagguauacaaacauuuaucauccaaacugggaaacuuuugagagugaaaaggagugcuaguaauaauuaugccaggucauaaacaggaauauuccagggagacuuggauguaugauuaacuuacauuugacccacagggaaauuucucucauagaaauaaaggcaccucaguauaagggaaguacacagugauguuuguugcaguuuuguacuuaguggaaaauaaaaaaguaauucaaaauuaagugaaugcucaccaguagacaaagaauaaaucacaauacauaauguuuuuaaauauuaugcaacacuuaaaacaaugaaauacagugacaccaacugacuugaagaaguucuuugaaauaucuuugaguaaggaaaguaauaugcacaaaaguacaaauaguuccauuuguaaaacaaaagguuuacacucagaggcaaauauugcagcuuaagcuucaggguccagcucuuucauaggccccucccaagauguugagaggggucuagaaauguuuccucaugguuacauguuuuuguaaauuaugcaaaaguaaaauauuuuaauugcaauagguuaauaccucuguuucuuucaccuuuaauuucccuaucauauuucucuguauuuuggguaguauuugaauggcugcagacauuuuuggaauccagcuaaaggaaagaugaaucuugggcacauuuaguuuggguuuaguaauauauauuuaugaauucugaagucacucccauguacauacaguucagauguaagaauggcuucuaggaauaccccuaccaccuccugugccaacucaucggguaugcaacagaaaguuuuaaagccauauuuugauaugggugugaccuaugauguucgguaccagaaauauuuguguagugagugagaaagauuugaaauguacagaacuagccaguggaaaauucuuccaaaucuucaagcuuggaagugaaagaaggauuuuaucaaaguugacaacaauccccaaaaucagcgugacaguaccaauaaccgauugugaagcugaaauaaacuuucuaacaaacaaugauaaaacauuaauuuugaucaaucaugcuagaggaaagaccgaauuacccuuuuauuuucucuaucagagcauucuucaacagaaauagcgugagccacauauguaacuuuaaauuuucuaauacccauauuaaaacuuuuuaaauagguaaaauuuaauguuuauuugacccaauuuacuuaaaauauuaguauuucaaaacaaaaauuacuaauaaaauauuuuacauucuuuuuguguacuaugucuucauaaucagaugugcaauuuauacuuuuagcacaugucaauucagacaguaaacuuuaauugaaaauacacaaucuauauuuagacuuuguagaauuacaguugaaaaaguggauucauauaaccaaguuuuucuaaacauaaaguuuucaaauaacugaauugaacaccaaaaaucauuuuccuuuaauauuuggaccuauguugauaaaacugguucauuacuuuuaaaagaauuaaguugacuuugaaauauaaccauuucaacuuuaaaauuaugucugcccaaguuuaaguaaauucucugacucagcaauauuaauagaaaagucaaagggguauugcauaaauuuuaaaacagcucuaaauuuaucaacauuaauaaagcuuucuucaaauuuguuuuguuuuugcaauacauuuccauaaugcuauugaccaucaauggauggauggauacagaaaauguggcauguauauacaauggaauacuguugagccuuaauaaaagaagaaaauucugccauuugugacaguauggaugaaccugggggacauuaugcuaaguuaaacaaaccaggcacaguaagacaaauacugcaugaccucacuuguauguggaaucuagaaaagucaaacucauauaagcagggaguagaauaaugguuaccagacguuggagagguggguggaaggagaaaggcagaauguuagucgaaaggagaauguuagucuaaguugcaguuagaggagaggauuaagcuuuagggaucuauugcacaguauggugacuauaguuaauacauuguauauuucaaaauugcuaaaaaauagauuuuaaauuuuaaauguucucacuacaaauaaauaguagguaugugaggugauggauauguuaauuaguuugauuuauccauuccauuauguauacauauaucaaaacauuacacuguaucccauaaauauauacaccuauuauuugucaauuaaagaucaauuuaaaaaugaaaaauuuaaaaaaauacauagaugacuaggacauagaguauacccuauaagagagagacauaaauaacaugcauguauuuuaaauauucaaaaauuuuuucauauugauucauauuaauguguaaaauaauuauauugauuuguuuuaugaaaagcucuguuucaacacaacucuuuguguccuucucacuaauaagcucuuccuuuccuuggagcuucaaacuuagcuucuucauguguagugugauaucaagaaaauguaggcacauugccauuucuuuacuuacuaagaaaagauauuuuuaauauacuucaaacugugcaauaaaucaauaaaggaauuuuuuuguuuuaaaagucaaaaaaucuggauuuuugaucuaauauaacaggaauaccacauguugugauagauacuaauguuuucacauuuaguagaaauuauuucuuugauguaaauuuuaaaaaucuauuucaugaguuugauuauuuaggcuaugaguugaaaauauuuuuuaauuuagcaaaucugaagguugagagaaagcauacucaaaguguuaauuaggcagugucucaugucacaugacuuaccuauagcuaaugaaaaauaucugcaauuaaacauguucuuaauaaguuacauaugacauuauuuaggaagguuuuuguauucaaugaacaguuguuuggugguuuaauugaagagcuuuugguuguuuuuggcaaaauaucuucauuaguuuuuuccucaaauuuucuagcaaaauuuucauuacugaaauuacuucuuuuaccagaucucacuuaaaauguucuucccuuuguuuggaaccuaauccauuuuauagcuggcaaaaauuacaagcucaaauccuuccaaaaauuguuuuuauauuuuguguuggauauuuaauuuugauucaggcaaauaauuuucacugauuuuuuuuuuuacuguuaagagcaaaugucuuuuuuuaaaaaaaaauucaauagcuuuugagguauaagugguuuuauguuacacgcaugaauuauauaguggugaauucugagauuuuugugcacccaucacccauguagucuacauuguaccuaauguguaguuuguuuuuuuaucccuagcuacccucucacccuccugcuucugaguccauuauaucacucuaugaugccuuugcugacacauggcuuaccucccauuuauaacugagaacauaugguuuuugguuucacacuccuguguuaccucacuuagaauaauggccucuagcuucaugcaaauugaugcaaaauacauuauuuuguuccuuuuaauggcugaguaguauuccauggcauauauauacuacauuuuauauacuacauuuucuuuauccacucauuaguugaugugcacuuagcuugcuuccacaucuuugcaauugugaauugugcugcuauaaacauaugugugccaguaucuuuuucauauaaugacuucuuuuccuuuggguagaccuaguaguaggauugcuguauccauugguagaucuacauuuagcucuuuaaggaaccuccauacuguuuuccacaaagguuguacuaauuuacauucucaccagcagugaauagguguuccccuuuccccacauccacaccaacauuuguuguuugacuuuuuaguaauggccauucuugcaggaguaaggugguuugaauuugcauuucccugauuagugaugcugaacauuuuuuucauauguuuauuagcuauuuguauaucuccuuuugagaaaugucuauucauauuccuugucaaguuuuugaaggaauuauuugcggguuuuuuguuuuuuguuuuuucugauuugaguuccuuguagauucuggauacuaguccuuugucggaugcacaguuugcaaauauuuucucccauucuguggguugacuguuuacucugauaauuauuuauuuugcuaugcuaaaguguuuuaguuuaauuaggucccauuuacuuuuguuuuuguugcauuugcuuuuggggucuuagucaugaauucucugccuuggcugaugucuacauaagauuuuucaacaucgucuuccagaauuuuuacaguuucaugucauauauuuaagucuuugauccaucuugaguugauuuuuauauguggugagagauagggaaccaguuucauucuucuacauguggcuugccaguuuucccagcaccauuuauuaaauaggguguccauucccaaauuuauguauuugucugcuuugucaaaaucacuuggcuguauguauuuggcuuuauuucuggguucucuauucuguuccauuugucuaugugccuacuuuuauaccaguaucaugcuguuuugguaauuauagcauugcaguauaauuugaagucugguaaugugaugccuccagauuuguucuuuuugcuuagggucacuuuggcuauuugggcuccuuuugugguuccauaugaauuuuagaaugguuuuuuauaauucugugaaaaauaauguugguauuuugaugggaauugcauugaaucuaugaauugcuuugggcaguauggucauuuuuccaugagcauggggugaguuuucauuuguuugugucaucuaugauuacuuucagcaguguuuuguaguuuuccuuguagagaucuuucaccuucuugguuaaguauguuccuagguauuuuuauuuuuuugcagcuguuguaaaagggauugaguuauugauuugauucucagugugaucauuguugguguauagcagugcuauggauuuguguacacugauuuuguaaccugagaauuuacugaauuuguuuaucaaauccaggagucuuuuggagaguuuuuagaauauucuaaauauaaaauaucaucugcaaacagcaauaguuugacuucuauuugaaugccuuuuauuucuuuaucuugcuuaauugcucuggcuaggacuuccaggaauaugcugaaaagguaugguggaaguaggcaagcuuguuuuguuccuguucucgguggggggaaugcuuucaacuuuuucccauuccauaugauguuggcuguggguaggucauauauagcuuuuauuauuuugagauaggucccuucuaugccucauuuguugagaguuuuuaucacaaaaguaugcuggauuuugucaaaugcuuuuucugcaucuauugagaugaucauaucauuuuuguuuuuaauucuguuaauguaauguaucacacuuauugacuugcauauguuaaaccaucccugcaucccugggaggaaacccacuugaucaugaugaauuaucuuuuugaugugcuggauuugguuagcuaguauuuuguucaggauuuuugcaucuacguucaucaggguaauuagucuauaguuuucuuuuuuuuguuguguccuuccugguuugggcaucaggcugauacuggcuucauagaaugauuuaggaaggauucccucuuucuuaaccuuuuggaaguuucaguaggauugguaccaauucucuuuuuaaugaaugucugguagaauucagcugugaauccaucugguccugggcuuuuuuguuguuggcaauuuuaaaauuauggauucaauccacugcuuguuuuuggugucuuuaugguuucuauuucuucuugauuuaaucuaugagugguguauguuuccaggaauugacccauuuccucuagguuuucuaguucauguguguauagguguucacaguagcauccaaugaucuuuuguauuuuugugguauugguuguaauguauccaguuucauuucuaauugagcuuauuugaaucuucucucuuccucaccugguuaaucuagcuaaugaucuaucuauuuuguuuauuuuucaaagaaucagcuuuuuauuucauuaaucucuuauauuuauuuguuugaauuucauuuacuuuugcuuugaucuuuguuaucuuuuuucuucugcuagcuuuggguuuaguuuguucuuguuucucuagucccuugagauacaacauaagguuguuaaaauuugugcccuuccaguuuuugaugugggcauugagcacuauaaacuuuccuuuagcacugcuguugcuguaucccagagaauuugauaacuuauuucauuauuaucauucaauucaaauaauuuuuaaaguuccaucuuaauuucauuguuagcucagauaucauugaggagcagguuauuuaauuuccaugcguuuuuauaguuuugaggguuccuuuuugaguugauuucugguuuuauuuugcugugguuugagaagacacuuaugauuucgauuuuuaaaaauuuauugaggcuucuuuucuggccugucauauggucuaucuugaagaauguuacgugcugaugagaagaauguauauucuauuguucuaggguaaaauguucuguaaauaucugcuaaguacauuuguuguauuaugccauuuaaguccaccguuucuuuguugauuuuacgucucaaagaucugucuaguggugucagugguaaauuaaaaucuuccacuauuguuauguugcuaucucauuuuuuaggucuaguaguaauguuucauaaaucugggagcuccaguguuagguguauauauauuuaggaugguaauaucuuuuugcuggguugacccuuuuaucauuauauagugaccgucuuuguguguguguguguguuuuuuuuuuuuuuuuuuuaccauuggugcuuugaagucaguuuuguuugauauaagacuagcuacuccugcuugcuuuuguuuccguuuguguggaauaucuuuuuccacccuuuugcccucaguuuauaugaauccuuccacaaggauucauauaaugaaucuccugaagacagccaauauuuggauugugauauuuuaaaauccauucugccauucuguaccuuuuaaguggagcauuuaggccauuuacauucaacguuaauauugagaugugagauucuguucucuucaucauaguaauuuuuacuuaguuuuuuucauuaugucauuguuuuauaggccuugugaguuuuaagcuuuccaaagguucgauuuugauacauauugggcuuuucuucaacguuuagaacaccuuuuagcacuucuuguagugcugguuugguaaugacaaauucccucaagaucugucugaaaaucacuuuauuucuucuucauuugugaaacuuaguuuugugggauauaaaauucuuggcugacaguuguucuguuuaagaagguugaagauaggaccccacaccucucuggcuugucagguuucugcuguuagucugauagguuuuccuuuguacguuaccugauguuuuugucuuacugcucuuggaauucuuugcuucauguuuacuuuagauaaccugaugacuauaugccuugguaaauaucuuuuugcaauaaauuuaccaagaguuauuugagcuucuugaauuugauaucuagaucucuagcuagaccagggaaguuuuccucaauuauucccucaaauaaguuuuccucaauuauucccucaaauaaguuuuccagacuuaauauuuucucuucucucucagaaaugccaauuauucuuagguuuggucauuuuccauaaucccauauuucuugaagacuguauucauuucuuuugauucuuuuuucuuuauuuugucugacuggguuaauucaaaggcccugucuuugagcucuggaauucuuucuucuauuuguucuagucuauuguuaaaacuuuccacugcauuuuguaacgcccuaaguguaucuuucauuuccagaaguucggauugcuuuuucuggaugauaucuaucucucuagaaaauguuucagucauauccugaacugcuuuaauuucucuaugaggguuuucaucauucucuaauaucucccugaguagcuuaauaaucaaccuucugaauuacuuauguggcauuucaaagauuucaucuugguuuggauccauugcuggagagcuagugugaucuuucagagauguuauagaauccuguuuugucauauuaccagaguuaccuuucugauuccuucucauuuggguagacuauuccuucuaauuauucuuaaauuuauguuugauuugacuguguuuuuuuuuaauauuccuuuuuuccccuaaaagaugugacuuuaaugcuuauaguuaauuauugccuaacuuaguucuugguacuuucaggggugaagacucuguaagauuuccuugguuauagucuuugcaugauggcuuucucauaugcugguuauauuaagaacguucucagugugugagcaaguucacuguuuacuaugggguuggaauggcagaggucucuugaugcuuaucucauucuuccauggcaugugcuuauuuauuuauuuauuuauuuauuuauuuauuuauuuauuuuuccccaguauuuuauuugcugguuugaugguucaggcuucaggccaauaggggaggugucccuugacaggaaccagcuguggcuaaagcaaguagguaaaugcaauacccaaugguggguagaggucccagccuugacagagguggcuggaggagcucacagugauuugcacuaaggucuuaucaaggggaagaguugcaguuaccucagcuccccugucaggucagcaggaaaguuauccaccucucagacacacuccuguccuagugcucuggcuaugcagaucggauaggcaccucuuuucaucuguaggaauguugauacuccauguagaaagcaagugacucugugucuuaugcaacccugacccuguagggugcuccuccuguggggaugcaguaacccugacauguuucagaaaggcugucuauuguuguacccaugcugaguucccaugggagaagccccaacugugccugccaugguggacaaggggggaaugacaucuccuucuccaaggccuaucaaaugcaccagggcugauuguuggguuagagcugaagaauuucccugcugaacccagcacuggaacugugcuucugcugaaggaaacuucauaucagcagaaagaucuggugcucaaggccugccauccagguccuucugaaccacaggguauucccuugauuugguacacucccccuucuccuaggaggugggaauccuggaagcuagacuauuaugaauguuguugaagagugaauuucuuaucaaauuuacuauguauuugugaaauauaccucuuacuauuucccacuuaauuaucuuuaaaguuuuguuagacaacaaacagcuguuucaguuuccucugcauuggcaaauuacaauuaccaucaucaugacauagacaugcuuuucuauguuuguauauuaaaggauauauacugagcuuugagcauugcuuaaaaugaaggugagcugaagagugggaacaauugggucaggcaaaaugugagacuugauuagcauugccuauauaaaguuaggcauuguuuacagguuuuaauucagugcuacaagcauguaugucuuuaguaauuuauaagacauucaauaugggggggggacauuuuucaaauauaaugugauuuauauuuuuuauuguugauucauauuucauuauauuaugauuucagauugugacuuauuucucugauguguugaaauugccacaaugaccuaauaaguggucaauuuuucucaggguuuuaugugugcuugaaaagaauauauauauucuguauugaugggcacaaaguccuagauaugucuauuaaaucaagcuuauuaauucuauuauucaauaguucuaauauuauauuucuucauuugucaauauucugaaugaaacaugacauauuaaaaucuugcaaauauuguagauuucuguuucucaaaauccuaucaguuuuggcuuuuaauguuucaaggcuguguuguguauuguuguauguaaaaaaaauuacggcuaugauaucuucuugguauugugcuuucugugguuugauucuuuuaauauuauaaaguauuccucuuuauccuuuuuaauguuuuuagccuucaauuaaauuuugacuaaugauaguccugcaaugccuuucuuuauguugguuuugcuugaucuuuccuauuuuaacccaauucuuucaaacuuucugugucacuuugauuuagguuuuacucuuauaaaaaagcauauagcaagaauuuuaaaaauugcaugcaauauaaucucuuugucuuucauuaguuaucuucuccuucgcauuuuugguuugccauguuucuucuuugcuucacucuuuuuuccaagaacuagggacauuuuaauuaauaaauuguugcuuuauucuuuuagucuucauuauugguuucgaagauauauuuuccuaauuuuuagugguuucucuuaaaauuuuuaccagaaauguuuuuuaacaaaaauaaaaauuauuaaguaccuuuguuucucuaguucuuuagcaaaccucuaucuugcuuguuuuuauugucuggaaauuuaauaugcccagcugcucauucucagcagaggggcagacuuucuggcccuagcuccagugaagcucuuuuagacuccauuaccauuaagaaugcaaucuccccacugcucugcccacugcuggaccaagucacgagcugggcugcuauucaagucccacuuucuauuuugugcuucugauccaguugagcaucaagauauuuucuuugcuuuucagcacaaguaacguuuauaauuuucuguuuuucuauuuuuucuuucauuauuguuuggaacacugggcaggagaaaauaggggaaggauugcuuuaacaaaaacuugacagaucuugccaugaugacagagccauuauacuucuauaauaagaaaaauguuuaaauuaauuaaaaaaugaauacaguacaaacgcaaucccagaacuuugggaggcgaggugggcaaaucauaacaucaggaguuugagaccagucugaccaacauggugaaaccccaacucuacuaaaaauacaaaaauuagcuaggcaugguggcacgcaccuauaaucccagcuacucaggaggcugaggcaggagaaucacuugaacccgggaggcggagguggcagugagcggagaugacgccauugcacuccagccugggugauagagcaagacuccaucucagaaaaaaaaaaaaaaaaaaguacccacaaauguauauacaccaaauguucacauugauauaaaaacuaugcacagcaaagaaagaaaauacaucagaauauuaaauuaguugcugcaauaaguaugauacggggaaaguacuuuuauucuuuuuacuuucuauauauugaacaaaauuuaguaaaacuuuauucuauuuuauaaugagaauacauauuuuugagcuacuagaagagaaaagaagcauuauauuaguagcuaugcuaaaaauuuuaaaguaauacaauccaacagcaauuaaaagguaggcauuuuaagucagcucauaccuucagaaagguaugccaccguaucucaagauuuacacaaaucacuuuuacacacgugguuauaguaaccaaaguaugcuucaguugaaaugauaauccagcauccucauagaugccugugacuaaaggucaguuaguuucaaaaggaauggagugcuuagcugauucaaugcucucgacuuguuuacggcauagcuuuuagcauuccauuauucucuuuuuauugccuuuaugcacaggugaaaaacacagaaaacacuagaugauuauuugguaauaaauugaaugguucuauggaaaugaaaagcauagaaaaccuaugugauuaaauggcaacugcaguuuuucucuggauucugcauauaaauagaauagguucucccacagagaaugagccuggcuaaaucugauaguuaaauauacagcucuggauguaauaauagucuuugaaccuucuugaaucccaguaucuagagugcuuuaagcuauuauuuugccaaguacuguagauaaagccucucuguuacccuauguuuaauaugucuuuguugucuuugugucuuacacaccuaguugaccuggaaaauaguauguccucaacaaacguuuguggaacaaaugaauugguggauagauggauuaaugaaugaaugauuuuaugaaaagagaugguucugaacaguaaaaggaaacacugaauuauuugaauaaugcacugagaacuacagugauuucucaaugccagauuugcuucugaauucuuaucuccuucaacaaacuauuccccuauucuguuuuaguuuccacaacugcaauaugacaucugaugauaaaugugaugaaaucacagaucuggauauauuuuguacauuauuuauugacugagauuaaauaacaaaauuauuuuuaauucucuauuuuucuaaauuauucaaaccucaucuguuaauacccaaaaauaacaccuaagaauaaccuaguuuucucuuuucccuuuuuguauaaauugccucugaaaggccaauugaagaacuauuaugagcuucuugaauuuguguguucuaauauaaacauaaaauguaaucuauuagauaaaaucuagaauacaauauaaucaagguaaaauuguuacuuuuuaaacauacagugugacuguauuguaugucaguuaguuguguuaauguuacuuagagucuaggacuauguaaagacagaacuaguagucuucauauaauacuaaaugaaaagaaaaugaauuaguaagucugcaguagauauaucugacaagucuagaaaaugcagguaaggugaauaguuaaauaugagacuacaagcauuacguaagauuguaagauuucuacaagauuauauuuucaguauaaaacuauuucccaauuaauguuguaugcagcagcugcuaaauagagcaaaguuacugagugauuccaugaaguaagagcuuaaggcugggcguaguggcucacgccuguaaacccagcacuuugggaggccgaggcaggcggaucaugagaucaggagauggagaccauagugaaaccccaucucuauuaaaaauacaaaaaauuagcugggcgcaguggugggugccuguagucccagcuacuggggaggcugaagcaggagaauggcgugaaccugggaggcggagcuugcagugagcugacauaacgccacugcacuccagccugggcgacagagcaaggcuccaucucagaaaaaaaaaaaagcuuaauuguuaguaugugcugaaauuacacaauugugaguuccaagagcuauaaugauauugccucuuuuuuaauuuuuauuuuaguuucaaggcuacauuuucagauuuguuauauagguaaacucgugucacaaggguuuguuguacagauuuuuuaaucacucaaguacuaaaccuaguauccaauacuuauuuauucugauccucacccucuucccacccuccacccacaaguaggccccagggucuguuguucccuuccugguguccaucauuuagcacccaauuuuaagugagaacuucucacuuaaaugaugaugagcacuucucaucauuuagcacccaauuuuaagugagaacaugcaguauuugguuuucuguuccuguguuaguuugcuaaggauuacagccucuagcuccaaggcucaaaaaauaaacucaaaaucaugcaauuacauggaaauuaaacaaccugcuccugaacgacuuuuggguaacuaauaaaauuaaggcagaaaucaagauguucuuugaaacuaaugagagcaaagauacaacauaccagaaucucuggaacacagcuaaggcaguguuaagagggaaauuuauagcauuaaaugcccacaucaaaaauuuagaaagaucucaaauuaacaaccuaacaucacaacuaaaagaacuagagaaccaagggcacccccaaagcuagcagaagacaagaaauaacugaaaucagagcugaaaugaaggauaucaagacaugaaaaaccguucaaaagagcaacaaauccaggagcugauuuguuaaaaaaauuaauaagauaggccacuaguuaaacuaauaaagaagaaaagagagaaggucuaaauaaacacaaucagacaugacaaagaggauguuaccacugaccccacagaaaugcaaauaaccaugagaggcaacuaugaacaucucuaugcacauaaacgagaaaaccuagaagagauggaugaauuucuggacacauacacucuuccaagacuaacccaggaaggaacugauucccuaaacagcccaauaacaagcuccaaaauugaauuaggaauaaauagccuaacaaccaaaaaaagccuaugacuagacugauucacagccaauuucuacccaauauacaaagaagagcugguaccauuucuacugaaacuauuucaaaaaauugauaagggacuccuugcgaccucauccuaugaggccagcaucauccugauacuaaaaccugccagaagcacaauaaaaacaagaaacuucaggccaauauacuugauuaacauugaugcaaaaauccucaacaaaauacuugcaaacuuaauccaguaacagaccaaaaagcuaauccaccacaaucaauuaagcuucaucccugggaugcaagguagguucaacauacacaaaucaauaaaugugauucaucacauaaacagaacuaaagacaaaaaacacaugauuaucucaauagaugcagaaaaggcuuucaauaaaauucaacauaaaaccucucaauaaacuagguauugaaggcacagaccucaaaauaauaagagccauauaugacaaacccacagccaacaucauacugaaugagcaaaagcuggaagcauuccccuugaaaacuggcacaagauaggaugccuucucucaccacuccuauuucacguaguauuggaaguccuggccagaucaaucaagcgagagacagaaauaaagggcauccaaacagaaauagaggaagucacacuaucccuguuugcagacaauauugccucuuucaggagcauugaaaauaacucuugucaggguuucaacugcacacuagccaggauaaucuaaauuuaaauauuacaauguauaagcaaaaauaguaguuaaaaaucuguaucuuuagcagaugcaagguuauugcagaaguuuaaggagggugaugcaaucagauuugugguuuuaagauuacuuugacugcaaugugaauaauaaauucacauuucuacaaagaagauacaaucuacagaaucucugggacacaccuagggaaguguuacaagggaaacaggacuuuaggaaacuauuauaauaguccaaggaaguguuacaagggaaacaggacuuuaggagacuauuauaauaguccaggacaguuauugguggugacggagauuaagagaggcagauggauuugagagauauuuagggauagaaauguacauaauuacccucauccuacuguuuauuccagcuaaaagucacaagaccuggcgcuuauuugaauaugaggaauugauagggagguugcaauaaugaccuucaggcuggaugaauaauuaaaucauuuacugagaugagaaauucagcaugaagaaaagguuuggggggaaagaugugggaguuuaguucuagauaugcuaagguugaggugcccuuggagauauauaaguaaauaaguagaugauauuaaguagauauacaaguaaagauauuagauggauuaauagaugggccuggaguuaagagaaguggucuagccuggagauaaguaugucggagucuucagcauguugauuguaacagaagccguacuauagaugagauaauuuauagagagaaaaaaguaaaaagaauaaagaggacuguuuacgagccuugaggaacucucaacuuuuagagucaugcagaaaaaugucagccaucacaauagagaaggagcaccauaauaagaugaaaaucuaccuuagacgacaaagggaagaaagggucuccagauggaggugucgccaaccugugcuucugagagguuaagaaaaagugaggaucgagaaaugcccuuuuugauuuugugacaucaaggucauuaguaacuuuagaaagcacauuuccacagaguaauggggaauagacaccugacuaaagugggcugagaagugaaaacaaagaaggaaaaugaacauauugagagcacgggaauaaagagagaacacuagcugagucgucaggugggaucaaggaaguuuucauuuauuguuuaguuguuuuugcuguuaguuguucuugugguuugcuacugcuuuucaaacgauaaagacccgagcagauuuaauuguugaugugcacaaugcaguaaaaaaggacaauucacuuugggaggccgaggugggcggguuacgaggucaggagauugagaccauccuggcuaacacggagaaaccccaucucuacuaaaaauacaaaaaauuagccgggcgugguggcgggcgccuguagucccagcuacucgggaggcugaggcaggaggauggggugaaccugggaggcggagcuuguagugagccgagaucgugccccugcacuccagccuaggugacagagggacacucugucucaaaaaaaaaaaaaaaaaaaaaaaggacaauuaaaauuauagaggagagaaagacugaaugcaggggucaaauuccugaggaggaaaagaccuggcgcauagaagauggagccaaccuugggcaggaggaggaaaacccccuguaucuuaacaggagcagggagcaagaggaagguuacagggcaguugcauuuaaucaccuaaugaaggaaguuaacaaaguuccaucugguaaauucuauuuucuuuaugaauuaaaauaugagaccaucugcugagagugagagacaagggaggaaaaguaucucaggauugaggaaagcaauacagaacaagaguggaaugugaagcagugugguaaguccacucuacuuucaugagcaugaacuuaugaauuaaugaauguuuaccuuguuauuauacauacacugacauuauaggagaaauucuguugcauaggauagcauacacgacaucauaaagagccuauauucccacaucaucaaaucaucaaccuagcaggaguucauuguauuuuuagaaaucuuacuagucuacaauucauguuauucacacacaguggaaacaaaauugauuucaggggagaaaaaguguguguguguguguguguguguguguguguguguguaguuuauaauauuguuuuccaacuacaacacauuuccacuaaguugaacaaauugagaugauuauauuuuuuaauugguaaacuguccauauggaugaaggaggcagguaauucccuucagguacugcuuuccuugauuucucucuuugcccauccaugaacuagcacugguuuacaaauuuaucauguagauaucugcuuuaauaaauggcuaagacagcacugagcacagagcaaaugccaaguaaauaauuacuguuugauaaaagugcuucuuaucagcaaggccaguauuuguguguaaaauaaugcuuccauggggcucaaaaauaguuugcucucuuaaaugaguuaaauauacccacagaaaucauguugacacuacccacuugcucagcagagauaaacauuuguucuaguccagucugaauucauuuaauuucaaaauuuuggcaauagaauuaaggaaguuucaccauucaaaaaauauuuagguauaaacaaguuacagaaucacccucacacuccuaccuauuucagauguugcagaagguauaguagaguguggauuauucaccagauggcauuuucauuucagguugaccacaguccaguaagcacauuagcaaauugaacagagguaacuaagacccacacuaucuuggcaugcagcugcugaauguguccuuuuuuuaucagagaucaucuauucucuuucaacaugauuggaagcagucuuugcuggugguuuuguaaauugcucauuaaucaaaauggauuuaucgggcauccauaguauacaaagccuguacuaagugauucaaaauaacgguugccuaguuaccuuaaaauggaaaaauuccccuaggaagguuaaaaucaaaggaaaaggagacaagaaaacauuauauuugaugacaccuggcuauuucauaagggauuuuacugccauuacagccauuuucuuuuaaacauaauauccauccauucauucguucauucaauuauucauucauuuaugcaagugagucaccacuauaauuaaacaaggucuuuagcuugaugcuauaaaggaaacaaacaggauucaauaguggucgcauaaacaugagucuuagcaaauucaccaagcaagugcuagacuacuguuggucuuuauuuaauaaguccaguacuagaacaaucuuauucuuuacuucaugugaaaucuguagucaugaggcauuaguaaaaugcuccuuggaaagaguauccuucauuuucugguugaauuguaaaaucuugcugaauacagaucuacuaauaaguugcuuuuauuuaaauuaaacuaguacaucugauaauuuuuuuuuuccuguggucaggauuagauuuauuuuguacuagcccuucuaguuuuuaauacaagagaccacagaaaggaaaguuaacuuugauuuucugagcaaaugcauacuuauaccaugaauacacaauguugccagucacaaccaacccucagcugcucagccccugagaaaugaaagccaggcagguugugugcuguacuguggcccaagcauccucaauugccucucccuauuauguauugaauuugugugcucaguuuuaaucccuauauuuguuaccuaggggugcuucaacaaacuacagccaucccucaguguccaaggggaauugguucccagacucccuguugaggaggauuggguauuugaggauacccaaaucuacggaugcuuaagucucuucuauaaaaugguguaguguuuacauauaaccuauucacauccuccuggauacuuuagaucaucuuuagauuacuuguaauaccuacugcuacauaaauaguuguuauacaguauuuucuuuagacaaugaugacaagaaaacaagucuguacauguucagcacagacccacccauccauuuuugcuucugacauauuuuuaauuuguaguugguugaauccauggauguggaacucacagauacagagggccaacuauacuaguaacuggguggcuuaaacaauagaaauguauugugucacagcuuucaaggauagaaguccaaacucaagguggcagggaugguuccuucugugggcugugagggaaggaucugucccaggccuccuugguuugcgaauggcugccuuuuccuguuauaucuucacauugucuucccucuaugggugccugucucugggucuaaauuucccuuaaauaaggauacuggucauauuggauuaggguccacuuaauggcuuuauuuuaacuugauuaucuuuacaaugauucuauauccaaauuccccaaauaagaucauauucuaaaguacuauagguuaggauuccaaccuuucuuuucgggggcauaauaugggggggacacaauucaaucuauaacagucccucuuaagacuugaucaccccucagucuuucucuuucucucucucucucucuccacccccaccuccaccacccugucucuccaggaaaucuucaugcaguucuuguauagaguaguaaugcccauuuugucuguaagccuaagccauguuaccuaacacaguuaaccuaaagcauugaaugcauucccugaaguacaauucucaaauuuccuugaccccuuauuguccaagugucagcauucucaagaugagaaggaugagcuuuacuccuacaugcuucucagcuuuguuuccccuugccuuucucugcugcaauugucuuuguucuggccacugucauuucuugcugaguguaugcacugauuugcuaaugaaucuucccgcuuucaacuucaucuuucuccaaucuauacucuauacuccacauugcuucuagagggaucauucuaaaacagaaaccugaucaugccauguucacuucugcugucagaugaaauccaaacuucugccuguuacuccuuguucuuuaugcauucuacccuaguaucauucuaugcucuaaccaugccaagugggcauagucucugaauguacucuguucuuucacccucucugcaucucugcacacacugccccuugccuggagugccauaccuuauucaucuaucuaacuccuccuucuuugaggcuagcaaaucauguagcacuuccucccacaagccuuccuucauucacauuccuccccuucuacucucccagagcacccuaugcuuaucuuguucauugcccuuauuauccuuaauuuuaacacauucuaagcuccuaaaggucaacacuuauaccuuuugcucuguuccuuaugcaauauuuagcacaaugccuagaacaucagagguacucaauaagugcuuauugaauggaucagaacuauaggguauuuacccaccaagaucaauuugagggucucuaaaagacucgugugcaucaagaaaugucuccacguuugcaaauucuaccuuuacucacuaaagaauuuaguaacaaagggaauacaucaguaacuccaagagaggucaguaacuucccugaguucuccagaucaguuaguuggcccuaagggggaaaugcauagcuagguaugagucacaagggacuagucauagcaguugagagacuuggaaguaauaggauugaugcaaaaccuaaacuauggguuaauggaaucaacagaggaaaaaaugcaaacuauuuccuuaccuaaccagaaaagaaguaacaguuauguugaugcucuccucuaccugcuauggcgcuuauugggggcaauucuguggggcugaguggauaaggucucauauaaaauuacauagaaacuguuuugaucuauauucaucccaauucuaaucauuuuuuaaaaaccacaaaauuucccuuuaaauucuggacuccuuuaccuuagaauucaugaucacagcccaaagacuaucaauuauuaugaauuaagccugggucaacugagcaaacuggcuucuucuauacuaaacccaagugaucaaacacaauuggggaaaauuauguagccaugcaaacuaagucuuuacccaauuuuaacaacaacaacaacaaacucaggcauuguaggaguuuauauuuucugaaaguggcugcaagaauaucuucuuauaaugugacuuuaguuaacacuccuucaucaaggggaggcaagaauuaaauucccuccacuuaaauguaggcaggcuuuugacuacaauggaagugauguugccuucugaugucucauuuucuuagaauguuugcuuagaaucccaacacagaccacgagaaaguccaaguaggccauggcagcgauaugaguauggaucuugagaauaaaaccuccagaccccaguuaagcuucccccguugacaccacauggaacagagacaagcuaucccugccaagcccuccccaaauugcagauuuaaaagcaaaacaaaugacuguuguuuucacucacuaagcuuuggagugguuuguuaugcagugacaauaaccagaagagauuuugauaguuggauauggggugcugccaaaacaaaaacuuaaaauacguggcauuagcaccgagauugggcagcagacagaagcuggaagagccccaaagccagugccugucaagccaaaagggccaaggaaggauggauuuguggaagccuuaaaagcuauaagaaagguguugaugaaagcuuaaaggaaagaaaacguaacuguaagcugaaagaaaguuucuucucucucugcaguguuuuaccuagaccuguggcaaaaaucuaagacucacucccucucucugugcauguacaaagaagagguuugguaagcagggugaugacagccuucaacaagccaggaagagagcucucaccagaaccugaccaugccaguacccugcagauuuccagccuccagaacaaggacguaauacaaaugaugcagcuuccucuuaguucuuuggggaugcuugcucucagaauccaggcaguagucaggaggaaacccaagcagugccuggagagcaaaaaaggccuccaguccauugccuuagccaaguuacugguacauagccaacacuaacuuucagccauaugagcuggccaucuuaaaaguguuccucuauuccccaguugaacagcccgagaucauaagaugugacacagauaaucagucccugacaagcccugucaaacuugcagauuugugagcaaaauaaaugacugaugucaguuuguuuugggguggccuguuaauaacaauagauaacugauacaggcaucaucuccuuuaugucuuccucaagcuccagguaagguuaaguacucccccauuuuugcucccaaagaacucuuugugaaacacuaucuuagcaauuauugugcucuguugaauuuaacucuucacuugucuaccucuucgagcucaaggguaauaucaugcuuuuugaaaaauuaccuccucaaauauauuauauuugucacauucucucuuucuucuccucuggaacuuugauuagacgagaaaacuuugcaguauaucuuucaagucucucagcuucucuuucauauuuuccacauuuuugucucugugcaacauucugaaaaauuucuuguggcuuaauuuccaguucacuauaucucccuucagcugaaucucaucugcuguuccacucauucauugaguuuuaaauugcauguguguauguguaaguaauuggaauuuuuuucauuucuaaaaguuuuuuuuuuccucuccaauaugcuaggucauuuucuuuuaguuucuauucccaaaaaauaucuucaggcucacuuuuucuuuauaauggcacagucauuguauagucuacaucuacuaauuccaguauuugaaagcacuuaagguguggaucggcucuuccuuguuuuuguugguuccuguuggguuuucuuucccuauaggcuuaauuauuagaaacuguuaauuuuaauaauaggaaaauuauucauagaaauuauuuggggcccuggaggagaguauauuucucuccagagggauuacauuugcuuccacuugauaccugaggguauuaguuuaaaugcaugaacugacauuuuuuggaccaccaaggugauaugaauuuuguguggcaaucugugagggcuaguuaguaguaauaauucuucaggaauuucccacccccugaccugccuuguucugcucacaaaaaaucaucuuuccuuggaguccccuugggguggggaauacaggauuaccucugauuccucuaaggcuguagcccuuggaauccuaguucuauggaggaaggauuuccuauuacagucccugagcuggacaggcuguguagauauuuguuuucaguauccaaagccacagaagucuugagcacugaaguucauuagcagguucaguaagcucccccaggacaaaugugacuuuagugcagcauuuauuuccuacccucgccaauguuuuggcuugauuauuucuuacuaaccaacuaauaaaaagaaauuccuaauuuagaugugauucgauuucuguaauuuucauaucagcuuuuugauacuuuuaagaaguuuuuuucuuuucuauaucguauccagcauuuuuauuuguuuucagcaagaguugaccugagccugaucagccuuguuaucuguguccaugucauuuucauccuuguauccucagcauucaaaauugugccccagcaugcauaagaacucaauuaguuuuugacuacuuaaucaauacauagcugugucuucaauuuugcauuccuuccucuaucacaccugauauuccccuacccucugugccccaauuaaagcucuuucacauuuugcauaucuauuuccugcauuuuccuauuuuaaugaagcuucccccccugaauaugcuauuucccucauuaucucucuuacggaaaaggaaaaguucucauucuugucaacuuccauagccuggggucagcauuguuuucauucuccaugaccgcugugggucacuuucuauuauuuggccuucauccaaacucugaugcucaucugaaguuuacacuauucuauuauaacauucuuuuuguaauuuuauuguuaucauauguggaccuccagucauaucucuacauuucuugaggguuucaguauuugauuccuaauaucuaccccaccucauccccuaguaaaaugcagcacuacagcauaguguuuaagagcacaaguuagacaacucaaggucaaguaccaaaucuaccccucauuaacauguaaccuugggaggccagcuaauguuucaaugccucaguuuccuuaucucuaaaaugagaauaaugauauuaauaccucacagcauuguaagaaucauauggaauaaugcauauaaagcacuuagaacaguaucugccacauaauaaaugcucaauaaauuuacuauuuucauuacugcacuauuaccuuaaaagucuuccuucuguauguuuaugauucauuaacacccuagccucaguacugcucaaaaauccauuuuuuucacuuguacaaaauucccuagacuauuacguauaauggcuuuucugaauuuuauuuacuuauuuauuuagagacaggguaucacugugucacccaggcugcagugcaguggugugaccacgguuuacuguagccuugaccucccaaacucaggcaauccucccaccucagccuccugaauagcugggacuacaggcaugggccaucacguccagcuaauuuuuuaauuguuuguagcaaugggguuucaccagguugcccaggcuaguuuugaacuccugagcucaagugauccacccaccuugucuaggauuacaggcaugagguagugucuguaauaggcuagugcuaagaauauaggcaugagccaucgcuccuggacugaauuuuaauuuaacccuucuuaagaucuagcucuuacuuucggccaauaaccuuuuaucuuacccagaaauugaauccauuugaaaauaaauauuucagaauuucucuauauucauaaccaugcugucuucucgcuacucuguggggaagcaaggucuguguuucccuaaacuagcugagucuuaacuucuacccauucuguucuuuuuauucuuuaucuucaauaccuugcucuaccagaaaauuccucuaaacuugaucaagucuuauuuauccuaacauaaaccagcuauuucccucuugcaccugcuuucuucuuauguuacuaucauaccucuucuucuaaucuccuugaaagagucauccguacucucuacuccauuucccagugucuuauuucccauuucccaaugucucacuauuaacuuccagacaucuacuuguaccacaucacuucuaaaauuuacuauucaaaaguaaguugcgacugcauuaccaaaccaaaaaaaaaagccucucuucagaauuuuucuuacaacuccuucacagcauuaaauauauugaccauccacuugaaaauuuccuccuucauuagcuuucauauaaucacucuguauucuuucuuaaaguaauagaaagaaacuauaaugguagucaaaaauccauguucaagcauaggccccacuauugcucuuaaaacucuaauuucuuuaucagcaaaauagggauaauauuugucuugcuuuguucacuaguuuguaaugcaaaaaauaaaacaaaauaaugaaucugauaaugccauaaaagacaugaaauauauaaagcagcuaaguaagauuugauaacuugguaacagauaggcuacagaaaaugauacaaaaauugcuaccaauuggcugugaacuccugaaggaaccaaagcuguguaucuuaccuagaagguuuuuucaguauuaaaagguuucaaagcaucuucaucaaagcauuaccauguccauuauggcuuuuaccaggaaguuaggagacuucaaauaaaaaaccuucugaccuaccuggacucacuucaaaaugaaaaaauaauuauuggaacuacauugggggaacuuucauuuugauaacauaguaggaaaccaaaauguuaaugaugcaucuucauaugaauaagcaaguaaauugaaucaggccaauugugaguaagagauauuaccaguucuuggggaaggugcccuugcaauuucuaaggagcaagguuucuuuguaacagcuguguccaugagaucacacagaaaguucucauuuucugaaggaaauguauccagagaagcagaugguacaauuuccauaguguaauuucucuucuuuggauaggacuccugaaaagaagaaaaaauaaaaacagcuuugugaugaagaaacagccuuguuuaauuuauaaaaacuagaaaagauaaucagguucauuaguucuuuccaaagugauugacagcugaugauucaucuguuugaauaaauuauagaaucauguaaacccaauaucagugauauuuuuaagaguccucauaauuuaaaaggacugaauuuauuacugaauuaguaaagguauugcccuuuuuuguaauauauaucuauuaucuaguuguggcauaaacugcugguuaacuaaucaacagucauccccaagacucuacuccuuugccggccuccuggagacacccauauaacucggagacacccauauaacucaacuuuggcccauuagauguaagaugaaguuugcuaaaaggcuggugggaaaaaauuuuuccccaaggaagaagcauauaaggaggcucuuucagagccaaggccauccccaggcuccucucuuuggaugcaguuuugauaucuggagcuagggcaagcauuuugugaccaaaaggcaagaaucuucagaucaaaaagguaacaagccaagaauggcaacagaaggauaaaaagagccugggacauugaucauaucauugagcugcucaaauagacccagggccaguuucuccagucuucuuacauaaauaauaacauucuuacaguuugagccauugcuaauuggguuuucugucauuuagaguuaaaugucuugccauccagcacacuaguaucuuuccuuguaaauaccauuaacuaauauacuaagguacucuuuucagguuaggauaaaauauagguccaguucuauaugauugauucuuugauauauucuaaaaauuagaauuuauuucauuuuauaagauuuugauuuccuguacauaaggcauuaauuggucaacaaauacuuauugggcaucuacuauauauauguagaauauauauagcauauuuauauauuauauauauauguauauauauauaaugugcuaaaugcuggacuguuuuuaaacuaaugagacauaauccuugcucugaagaaguucacagucugcuggagaagacugugaaauucugcaugaugaaauucacaauuaaucauauuuuauuuuugcuacagauccuccucagcuuuacaaaaaaacccaaaguaaguugaaaauauuguaaguagaaacugcauuuaauacacuuaaccuaccaaacagcauagcuuagccuagccuaccuuaaaugugcucagaacacuuacauuagcguauaguugggcaaaaucaucugguaacacaguacauuguagaauauuaguuacuuacccuugugguuuuguggcugacugggaguuguggcuugcuaccacugcucagcaucaugagagaguuaucuaucauaggguauauugcuagcccaggaaaauauucaaaaucugauguacgguuucuacugaacauacacugcuuucacaccauugcaaagucaaaaacucguaaguugaaccaucaugaguugcagaccaucuguaugugcuacuuuuauaaaguaugccucacaaucaagaaaaagacaaauaagaaaauagacuaauauuuuugaaaaaucucccuaaguauauucuagggcugauaaagauuuaguacgaauuccuaguuuuucuacaguacagcagaauucaaggucaggguaauugcuuucagacaauaccagacccucacacaucagagagucaauuauggucaugauacuccauugaaagcaggaaauugggaguaauuuauuuuuaacaacaaagggugacaaaguagaaggcauccagaggaaaguaaucaggauggcauauaauucugaaaccaugucagagaagaaaugaugaaaggaacugcaguguucuauccagagaagccuuauagccacauaauaguuuucucaaugauuugaaaggcuaucccucaucaacuaucccacaaaggggggauggagaaaaguugaugugguagauuuauucuaaggcccauaaagacaagacaaagacuaauguuuauaagucaagaagggcaaauuuggcucaauacaaaaaauaauuuucuaugaauuaaugauauuguuuaccuuuuaaaauaaaaaggcacuauaaaaugaguuaacaaauagcauuauaaagcaacagaaggaaguccucauuacugaaaaucuuccagcagaauuaucugcugauaaaauuguggaugaaacacauuguacaaugaguccaacagguuacuauaagcuccaugaaggcuggaauuugucuuguccacuacucugucccuagaaucuaauacagguccugccaauaguugaugaguugaugcucaauaaauauguauugaucaacugaacagucucuaguguccuuuaaacaaagcuaacuacaaguuauggaaaugauuuuuuuucaaauguaaauuauuuugccuuucaguucaguuaauauuguucaccaguuugcauauaaaaagugaaaaacugagauuacaacgauaagauuguaaagauucuauggaaaaaaagagucuccaguuaaacuccuaguuccauccugaaauuaaauuaaucaaaacaacccauggauuuaguuaaguuggaauuuuacaguguguaugaacacuucugaggauuuuuaaagccucgaaaaccacuuugaaauuuaaucacaaagcauggguuaauuugcuuucuuccuuaaaaaugaaguauauagguuuauuagagaauaauuugaaaacauaaagaaagaggaaaauaaucacaugaaaaucaagcaugcugagauaacugaggguaauauuuuggugaccauccucccagacuguuucacucugugaauguguguggacaugugaguaugugcaaaggaaagaaaaaauauuuuaaacaauaaugaaguacucccucuucugcuuccuaauggagggccauaauuucuucuuagaauguaagucuuuguagaaccuggcuuccuuagggaaggugaggcccccgcgggaaggaguugguaaaaacgaagauagugaaacaaugcuuuuguaaccaaauauuucaaugucaagaaagagagauaguugaacaaaauaucugacaagugaccgucaaaagaggauaugcaagauaauuuuuuuaaaaaaauggauccauguguccacuacucaguuuaagagguagaauauuaccauuguaucauugaaaccugucccccaacccaccccauguucaucuuuccaauuuuacccuuuuuccuccucuaccagggcuaaaugcuuucugagcuuuguguuuuuaauugcuuggacuguguuaaauuuuaacuauacauguaaguaucaauaaaaaauaaauuuuuaguacuguaugcuuucaaacuuuauauauauaguaucaaaugcucuaguucuucugugauuuuucucaaucaagauuauguuucugaauuucaucuauuuucagugugguacaggagcucauuguuuaagauuaccacaauucauuuacacauucuccugacaauggacuuuuaaauguuuccuagguguuuuguuauuuaggauaauguuauuauaaauuuucccauaugaagucucuuggagcaaguaaccaggguuaugcugccuauucuaguagugauggggaagagucaagaacagacagcagacgagaaaaauaaaugaaaucaagagaugauaaugagaauggaaauuguaugcccuguagauucuauagaaucuuaaggauagcauuugcaguuuucuacccaaaguggcaggaggguucaaaggauauucuguaaaucuuauuaaaauauuauauauaaguauaguauuauauaaaauauuuccuaaucuguuauuuaccucuaaugauauauuuuauacccuuuucaaugacaauuauaugucuacaugaugaacuugggucccaauauauaccuggucauaauuuauuuggccaauccuaucauauugaaauuuuaauguuuugcuuugaaggaaacauuuuuguucauauauuuuguuuacauauucaacuauuuugaaauagaauuccugugauaauacauauaugacuuauguuuacauauaauugaaucuguaucuggacuuucuaauugguuccauauauaugucuauucuaguacaggcauaccucaagguguaucguguuuuacagauauugcauuuuuaaaaaaauaaagauuuauggcaaccgggcauugagcaagucuaucagcaccauuuuuccaacauguucuuauuuugugucacauuuugguaauucuccuaauaugucaaauuuuucauuauuauuauaucuguuauggccaucugugaucagugagcuuugauguuacuguuguaauuguuuuggaaugccacaagccacaaucauauaaaacagugaacuuaaugcauaaguguaguauguguucugacugcuccaccgaccagccauuccccugucucaucuucuccuugggccucccuauuuccugagacacaacaauauugaaauuaggccaauuaguaacccuucaauggccucuaagaguucaaauucaagaagagucacaugucucucacuuuaaauaaaaagcuaacaaugauuaagguuagugaagaagacaugucaaaaagcuaggccucuugugccaaacagcuaccaagcugugaaugcaaaggaaaaguucuugaaggaaauuaaaagugcuacuccagugaacacacaaaugauaagaaagggaaacagucuuauugcugauauggagaaaguuucaguggucuggauagaagaucacaccagccacaacauucacacaagccaaauccuaauccagagcaagacucuaauucucuuuaauucaaugaaggcugccagaggugaagaagcugcagaaguuugaagcuggcugugguuaguucauaaggcuuaaggaaagaaacuaucuccauaacauaaaagugcaaggugaagcaucaaaugcuaauggagaagcugcaacaaguuauccagaagaucccgcuaagacaauugaugaaggugacuacacuaaacaauagauuugcaauguagaugaaacagccucauaccagaagaugucauuuaggacuuucacagcuagagaagagaagucaaugcuuggcuucaaacuuuaaaaggacaguccaacucuuuuguuaggggcuagugcaguugaugacuuuaaguugaagccaaugcucauuuaccacuccaaaaauccuagauuccuuaaaaaugaugcuaaaucaacuuuuccuaugcucuauaaaugaaacaacaaaucuggaugacagcaugucuguuggcagcaugucuguuuacagcauaauuuacugaauauuuuaagcccacuauugagaccuacuauucacaagaaaagauuccuuucaaaauauuacuauucauugacaaagccacagaucacccaagagcucugauagagcuguacgaagagauuaacguuguuuucaugacuguuaacacagcauguauucuccagcccauagaucaaggauuaauuuagagucucaagucuuauuauuuaagaaauacauuauauaaggcuauagcugucauagaaagugauuccucugaugaaacugagcaaaguaaauugaaaaccuagacaagauuuuccauucuagaugccauucagaacauuugugauucaucagaugaagucaacaucaaugagucuagaugaaguugacuccaacccucagggaggacuuugauagguuugacuuugguggaggaaguaacugcagaugugacggauaaauagcaagagaacuggaaguggagccugaauauaggacugaauugcuguaaucccaugauaaaacuugaauggaugaggaguugcuucuuacaggcgaacaaagugguuuaagaugaaauacacuccuggugaagaugcugugaacauuguagaaaugauaacaaaggauuuagaauauuacauaaacuucauugauaaagcaguggcaggguuugagaggauugacuccaauuuugaaagaaguucuagugugaguaaaaugcuaucaaacagcuuugcaugcuacaaagaaaucuuucaugaaaggaagacucaaauaauucagcaaaacuacauuguucccuuauuuuaagaaacugcccacugauuuuguauccugagaguuugcugaaauugcuuaucagcuuaagaagcuuuugggcugagaugauggggcuuucuagauacaggaucaugugaucugcaaacaaauauuguuugacuucuucucuuccuauuugaauaccccuuauuucuuucucuugccugauugcccuggccaggacuuccaauacuauguugaauaggagugguggagacagcauccuugucaugugcugguuuucaaggggaaugcuuccagcuuuugcccauucaguaugauguuggcuguggguuugucauauauggcuguuauuauuugagguauguuccuucaaaaccuaguuuauucagaauuuuuaccaugaagggauguugaauuuuaucaauggccuuuucugcaggcaaaucaugaaugaacugccacaucaugaaugaacugccauucacaacugcuacuaagagagcaaaauggcuaggaauacagcuaauaagugaggcaaaggaccucuuuaaggagaacuacaaaccacuguucaaggaaaucagagaugacacaaacaaauggaaaaacauuccaugcucacagauaggaagaaucaauaucgugaaaauggccauacuguccaaaguaauuuauagacaaugcuauucccauuaaacuaccauugacauucuucacagaauuagaaaaaaacuaauuuaaaauucauauggaaccaaaaggagcccgaauagccaagacaaucccaagcaaaaugaaaaaaguuggaggcaucacgcuaccugacuucaaacuauacucaaggcuauaguaaugaaaaaagcauggaacuggugacaaaaacagacacauagaccaauggaacagaauagagaacucagaaauaauaucacacaucuacaacaaucugaucuucgacaaaccugacaaaaacaagcaauggagagaggauucucuauuuuaaaaauggugcugggagaacugacuagccauaugcaggaaauugaaacuggaccccuucccuacaccuuauacaaaaauuaacuaaagauggauucaugauuucaauauaaaauguaaaacuauaaaaacccuagaagaaaaucuaggcaauaccauucaggacauaggcaugggcaaagacuucaugcugaaaaugccagaagugauugcaacaaaaacaaaaauugacaaaugggaucuaauuaaauuaaaaagcuucuacacagcaaaagaaacuaucaacagagugaacagacaaccuacagagugggauaaaauuuuugcaaucuauccaucugacaaaagucuaauauccagaaucuauaaggaaguuaaauauauaagaaaaaagcaauuccauuaagaagcgggcaaaggacauaaacagacgcuucucaaaaaaagacauucauuguccaacgaacaugaaaaaaagcucaacaacacugaucauuagagaauuucaaaucaaaaccacaaugagaucaccucaugcagucagaaugaugauuauuaaaaagucaagaaacaacagaugcuggcuuguugcagaaaaaaaaaggaaugcuuucauacuguuggugggaguguaaauuaguucaaccauuguggaagaugguguggugauuccucaaagaucuagaaggagaaaaagcauuugacccagcaaucccauuauuggguauauacccaaaguauuauaaaucauucuauuauaaagauacaugcacauauaaguucauuacagcacuguucacaauagcaaagacauggggucaacccaaauggccaccaaugauagacuggauaaagaaaaugugguacauauacaccauggaauacuaugcagccauaaaagggaaugagaucauguccuuugcagggacauggauggagcuggaagccauuuuccucagcaaacuaaugcaggaacagacaaccaaauaccacauguucucacuuauaagugggagcugaacaaugagaacacauggacacauggggggaaaaacacacacuggggccugucagggaggcagggagaggagaccgucagaaagaauagcuaauagaugcuaggcuuaauaccuaggugauaggcugaucugugcagcaaaccaccauggcacacguuuaccuaacaaacuugcacauccugcacauguacccuggaacuuaaaaguugaaagaaaaaaaaaaaacugucacagucaccuaagcuccagcaaccauuacucugaucagucaguggccauucaaaucaaggcaagacccuccaccagcaaaaaauuaugacucacugaaggcucauaugaucguuggcauguuuuaguaauaaaguauuuuuaauuagguauguacucuuuuuuagacauaaugcuauugcacacuucauaaacuacaguauaguguaaacauuacuuuaauaugcauugggaaaccaaaaaaaucaugugacuggcuuugcuguaauagucacuguauuguggugguugaaaccaaacucacaacauuugugaaguaugucuguaccagaauuacacugucuugauuaguggagcguuuaaauugauuuuacuaucugguaggauaaaucuuucaucauguuaaucuuucccaaggcauuaauuauuaacuucauguuuauuuuucaaaaagaaaaaauuugaaacauuuuguuaaguuuuccucaaaucauuccuucucauuuguucccuaucaguaaucaauacuuccauauauccaggcacuaaaagaaccugggauaugguucacuuuucauucuuucucugucauucccaauaaauccucaaguccuauacuuugccauugaauuauaccucaaacacauuuauuucucuccaccccagcuaccgcaugcuaguccagaccaccauuauauuucaccugaacugcuggaacaacuuccaaaguaucuucuuugucuccaguccugccucucuucuaaucaauucauuuucaaaacuagcuugaagcuucuaagaguaaguaaggucaaagcaaacucauuuauuuucaucauaacuuuauuugaugagagaaucauaaaaugcuagucauagaacacguugauucuuuuuaaacauuuaacacggucucucauaauaucucagaauuuccuugcugaaugauuucauuaaauacauuaaugaucuaaauaguaaauucauuuaauuaacaagauaggaaagaagaaacaaaguuccuugaguaauaaguuuaaacguaaucccauuaguugauaagauaaaugggauuaauuucuaaagacauacuuaucuagcaccuagcaaaauuccauguucauaguaggacucuaugaauauaugaugaaaaaauaaaugcauaaauuaccauaucaguuagaauuucauggcuugcaaccucugcuagaauuaaagcaccauaggggcaagaaccaugauaaucuucauauaguacguauuuaauaaacauuugucaaagucugaaacaaugucauccaaaaacaaucacagauucaaacuaucacaaauccaaaacuaccacaaauuccccacugugggaagaauuacaacuuauauuuaugcaguguuuuaucaucugcaaagugaauacuauuuuauuugcccagaugauucucauuuagcccucacaacaauccagccaaugcuacuaucaccgccauccagaaacuaggacugaaauuauuaagugacuuguccaauauuaagcaucuuguuaauggaaauguuagggauccaaccuuggucuucuggcaccagaucuaguguucaugugauugugucaaagauaaaaaugacuaugaccagauauuuauugccagaacuaagggaaagaggacacucugcacaucguuagguaguaucuagcucugccaauuuucaagccuuuguauguccccuucccugcacugggaaacguugaccucaauacacagauuaacugccaacauauccuugaugguuaauccugguaauaggcaagagggauuaaaaggacugcaaugcaacaauuucugacuccuucaagacucaauuuucuccagucuagcaauauugggcucaaaauagauuaguaguuuuugcuuuuuucuugacauuuggccucuaucauuuaaaaaaaaaaaaacuuuuaaauaugcaacuuuuguggguguauagcagguauauguauuuaugugguacauuugauauuuugauaaaggcaagcaauauguaauaauuacaucauggaaaaugggguauccaucccuucaagcauuuauccuuguguuacguaaguccaauuauacccuuuuaguuaucuuaaaauauacaauuaaauuguuauugacuauagcgccccuguugugauaucaaauacuccauuuuauuuauucuuucuaacuauguuuugaaccaauaaccauccacaacucccacccucagacccccacuauucuucccagccucuggaaaccaucauccuacuuuaugucuccaugaguacaauuauuuugacauuuagauuccacaaauaagugagaacaugugauauuugucuuuccaugccugguuuauuucacuuaacguaaugaccuccaguucuauccauguuguugcaaauaaaaggaucucucuuuuacgguugaauagguacucugcuguguauaaguaccacaguuucuguauccauucuucucuugauggacacuuagauugcuuccaaauuuuucuauuguaaacagugcugcaacaaauaugggaguagagccaucucuuccauauaguguuuuccuuugggggugggggguguauauaaccagcaaugggauugcugaauuacaugauagcucccuuuuuaguuuuuugaggaaccuccaaacuguucuccucacauucccaccaacaguguaccaugguucccuuuucuccacauccucaccagcauuuguuauugccugucuuuuggauaaaagucauuuaacuggggugaaaugauaucucauuguaguuuugauuugcaugucucugacgaucagugaugcugagcaccuuuucauaugccuguuugccauuuguaugucuucuuuuaagaaaugucuauucaaaucuguugcccauuuucuaaguggguuauucgauuuuuuccuauagaguuguuuggacugcuuuuauauucuaguuaucaccugucagauuauuaguuugcauuuucucccauuuuguggguugcuucuucacuguguuguuucccuugcugugcagaagcuuuugaacuugaugugcucccauuuguccauuuuuguuguguuugccugugcuugagggguauuacucaaaaacuuuuugcccagaccaaaugcccuggagaguuuccccaaacuuuucuuauggcaguuucauaguuugacaucuuggauuuaagucuuuaaucuauuuucauuugauauuuguauauggggagagauaagguucuaguuucauuauuccgcauauagguaucaaguuuugccagcacagaauacuaugcacccauaaaaaggaacaagaucauguccuuugccgggacauagaugaagcuggaagccauuauccucagcaaacuaacacaggaagagaaaaccaaacaccucauguugucacucauaagugggagcuaaaaaaugagaacacauggacccagggaggggaacaacacacccaggacccugucagggaggcagggggagggaaagcaacaggauaaauagcuaaugcauguggggcuuaacaccuaggugauggguggauaggugcagcaaaccaccauggcacauauuuaccuauguaacaaaccugcauguucuccauguguauccuggaauuuaaaauaaaauuaauuuaaaaaaaaaagacuguuuuuuucccaauguauguucuuggcaccuuuguaaaaaaugaguucacuguagauguguggauuuguuucuguguucucuauucuauuccauuggucaauaugccuguucuuaugcaguacuaugcuguuuugguuaccauagcucuguaguauaauuugaauccagguaacgugauuccuccagugugguucuuuucuucucaggauagcuuuguuucuucugggucuuuuguaguuccauauaaauuuuagaauugcauuuucuauuucugugaaaaauaucauugguauuugaguagggauugcauuaaaucuguacauugcuuuggguaguauggauauuucaacaauacugauuuuaccaaucuauauauaugaaauaucuuuucauuuucuuguaugaucuuuaauuucauucaucaguauuuuauaguuuucauuguagagaucuuucacuucuuuagguaauuccuaguuauuuaauuuuaguuguggcuauuguaagugcaauaacucuuuugauuucuuuuucagguuguucacuguuggcauauagaaaugcuacugauuuuuguauguugauuuuguauccugacacuacuaaauuuaucaauucucauucuuuuugguggagucuuuagguuuuuccaaauauaagaucaugcuaggugugguggcucacaccuguaaucccaacacuuugggaggccaagaugggcggaucaucugagguaaggaguucgagacuagccugaccaauguggugaaacccugucucuaguaaaaauacaaaaaaaaaaaaaaaauuagcugggugugguggugggcgccuguaaucucagcuacucaagaggcugaggcaggagaaucgcuugaauauauauagccaacaagaauacuuugacuucuaccuuuccaauuuggaugcccuuuauaucuuucucuuguuggauugcucuaucuaggacuuccaguacuaugcugacuaacgguggcaaaagugauaauccuuguuguguuccagaucuuggaggaaaggcuuucaguuuuuccccagucaguaugauacuagcugugggucugucauauauagcucuuauuauguuaagauauguuccuucuauacucaguuuuuugaagguuuucugugaugaaaggauguugaauuucaucaaaugcuuuuucagcaucaauugaaaugaucauaugguuuuuauccuuuauucuguugauaugauguauuauauugguugauuugcauauguugaaccauccuugccuccuagggauaaaucccacuuggucaugauaaaacaucuuuuuaauauauuguugaauucaguuugcuaacauuuuguugaggauuuuugcauuaauauuagucagagauacugaccaguauuuuuuuuuaugggucuuugucugguuuugguaucaggguaaugcuggucuuguagaaugaguuuggaaguauucucuccuccucuacuuuuuggaauaguuucaguaggauuaguauuaguucuuuaaauguuugguagaauucagcagugaagccaucagguccuaggcuuuuauuugcugggagacuuuuuauuacaccuucaaucucauuacuuguuauuagucuguucagguuuugaauuucuuuauggcucaauuuugauagguugucugugucuaguaauuuauccauuucuucuggguuuuccaauuuaucggccuauaguuacucauagaacccauuaaugauccucugaauuucugcuuuauagguuguaaugucuccuuuuucaucucugaauuuauuuggaucuucucucuuuuuuucuuagucuagauaaaggucugucaaucugagucuggcuaaagguuugccaauguuuaucuuuucaaaaaaacaacuuuuuguuuuacugauaucuuguauggauuucuucaucucaauuucauuuaucucugcuuugauuuuuaauauuucuuuucuacuaauuuuaaauuugguuugcucuagcuuuucuaauucuuuaagaugcaccaauugguuguuuauuugaaguguuucuuccuuuugauguagacacuuauaggauaaacuuuccucuuaguacugcuuucacuauauccuauacauuuugguauguuguguuuccauuaugguuuguuuugagaaauuuuucaauuuccuucuuaauuucuucauugaccccuggucauuucagggcauauuguuuaauuuucaugugucuguauaguuuccaaaauuccucuuguuauugauuauauuuauuccauuuuggccagagaaaaugcuuaauauuaucuaaauuugguugaauguuuucaaauuuguuuugugagcuaacauauggccuauccuugagaaugauccaugugcuaaggaacagaauguguauucuucagucacugagugagauguuuuguaaguaucuauuaagugaauuugauguauaguauagauuaaguucaauguuucuuuguagauuuucuguuugaagaucuguccaauccugaaagugggauguugaagaccuagcuauuauuguauuaaggccuaucugucucuuuagcucuaauaauguuuccauuauauaugugggugccccaugguugggugcacacauauuuauaaguguuauauccucuugcugaauugacccuuuuaucauuauauaacgaccuucuuugucugacuugucuuauaguuuuugucuugaaaucuacuuugucugauauaaauauagcuauuccuauucuuuuuugguuuccaguggcuuggaauaucuuuuuccauccuuuuauuuucagucuauuuguaucuuuauagaugauguguguuucuugcaggcacagaucauuggcucuuguuuuuucaccuauucggccacucuauuugaagucagucuucucauucagacucucauucaguauucucuucccucuuuccuucugucuuuucucccuuuuagugaaagugauuuucucuggugcuaugauuuaauuucuuccuuuuuauuuuuuguauauccauuguauguauuuugauuugagguuaccaugagccuugcaaauaccaucuaauaauccauuauuuuaacuggugacaauuuaacaaugauugcuuaaacaaacaugcaaaaaguaaacuaaugaaggcucuacacuuuaacuuugucugccugcuuuuuaacuucuuguugcuucucuuuauguauuauuguauuguguaugucuucaaacguuguuguaguuguuauuuuugauuggcucauuguauaaucuuucuacuuaagauaugaguaguuuacaugccacaauuacagugcuauaauauucucuguuuuuuucugugugcuuauuauugccaguaacuuuuguaccuauagaugauuucuucuugcucauuaacaugcucuucuuucagauuuaagaacucccuuuaacauuucuuguaggacaggucuguuguugaugaaaucccuuagcuuugguuugucugggaagaucuuuauuuaucuuucaugcuuaaagcauauuuucaccagauauacuauuccuggguaaaaguuuuuuuccuucagccguuuaaauaugucaugccauucucuccuggccugccagguuucuacuaaaaagucugcugccaaacauauuggagcuguuauuuguuauuuguuucuuuucuuuugcuacuuuuaggauccuuccuuuauccuugaccuuugggacuuugauuauuaaauaccuugaaguaaucuucuuugguuuaaaucugcuugcauucuauaaucuucuuguacuugaauguugauaucuuucucuagauuugggaaguucuccaguauuaucccuuugaauaaacuuucuacccccaccuccucuuuaaggccaauaacucuuagauuugaccuuuugaggcuauuuuccagagccuguaguugcgcuuuauuguuuuuuguuguuuuuucuuuugcuuccucugacuguguuuuuuguuuuguuuaguuuuuuguuuucuugagauggaguuucgcucuuguugcccaggcugaagugcaauggcaugaucucagcucacugcaaccuucacuuccuugguucaaacgauucuccugcuucagccuuuaaguagcugggauuacaggugcccaccaccaugcccagcuaauuuuguauuuuuaguagaaaugggguuucuccauguuggucaggcuggucucgaacucccaaccucaggugaucugccugccucagccucccaaagugcugggauuacagacaugagccacuguuccuggucugacuguguauuuuuaaacagccugucuugaagcucacuuucuucugcugcuugaucaauucuaccauuaaaagacucugaugcauucuucaguguguugauugcguuuuuucagcuccagaauuucuacuugauucuuuuuaauuauuucauucucuuuguuaaauuuauguaauagaauucugaauuccuucuguaucuuaucuugaauuucuuuugaguuuccucaacacagcuauuuugaauuaucugucugaauggucauguaccucuguuucuccaggauuaguccuuagugccuuacugaguuuauuuggugaggucauauuuuccaggauggucuugaugcuuguagauguucaucaaugucuggacacugaagaguuaggccuuuauuguagucuucgcaguacaggcuuguuugugccuguccuucuuggcaaggcuuuccagauacucaaagggaccuagguucuaagcccccuaaugcugugguuuuugcagacucauagaaguaucauuuuggugaucuuggauaagaucugaaaugauucucuugauuaccaggcagagacucuuguucucuuuccuuacuuucuccuaaacaaauagagucagugucucucucucaaucucucgcucucucucucucucugcugagccaccuggaacuugggguauggugaugcaagcaccccuguggccacagccauugaaacugugcucugucagacuugaagccagcacagcacugggucuugccccacacacacuguaaacacuuucuggcuaccaccucuguugacucaaggcacuagggcucagugaucagcagguagcaaagccagccaggucuguguccuucccuuuagggcgggaaguuccccuagguccuggguggguccagaaaugcuguuugagaagcagagauuggagucgaaaaccuuuuaaguuuaccugauguucuauucuacugcagguaagcuggcucucaaaccacaauacaaaguccuuccuagucuucuccuuacuguuuuucuaaugccugauuauggauccuagacuuguuuuuguacuugaauuuuuacaauaguagcaggccuaggacuguguucucugccuuggucuuugacaguucucuuccaagagauugauguccagucccugaaucccaaacagguccuuuaggcccugugccaccuaaauuuacagcuccaaugggaaugaauagcuuugaugcuuugccuuacuuagauuccuuuauccuaccugcuacugucaauugugcaaugugcagaccaaauaguacugcuucaaagugacuaaucaugcauacugacagcacuuaauaaguaaagagaacauuaugccccccaagaaaaauaaauauuggcaauaagaaaucuauauaauaagcguucauacguuguuuacacuguguuuucuauaacauuuaaaacuaucaguggugggcagaauauaacaagucaaacuuuauuagugacucaguaaaagguucuaugcuucaguagagaaaagaguuauaaaaaauucaucauggagcuauguggauuagcaauacuaugaaaaaaauauuaggaguuacagcugacaguaugagucagacuguaacaugccaguuaaagaaauuaaugugacauuagcugauuuaauacaaguaugauauuucaccuagaaagagugacaggccuccacucuucagugcuaauuaguauugggaaugaucuggcuucacaauuucauaaaaggcgggcuaacuggauugugcugaauuuccuuuaguaaggcugugcaaggucuuauucaucaaagagacugggggagacuuggccuucugacuuacgaaagaucuuagcaacaaucaggaacccagagguagacacaguaguugcccaaaaguaccaauaauguaguuuuucaaaucagaaauuagguggccuagaggcuuuucuagacuacuuugauagggcaucucacugaauuugcuuccuagcacagcucuauucuuagccacaugggaaaacuaaagcaucuuaauugacacuacaggggaaucacacaugaugcacuuggcuuggugcuggggcugacacuugaggagaggcaaagaccaaauggaccguuuucugugaacauaagugaggaaaauggugaguauuaaaccccugucaugugagaaaagauuaaauaagaaaaggugcugaggaacguguaugacaaacauuuaaaagguaaaauagugauuagaauuguuaucuaucucuaaggaaguagaaauaaugcagauggggagaugguaacagggacagauauugcagcugaugauaagauuucuaauaauuagagcuuugcaguauaaaacuggcugcuuacuaaguagcaaacucucugucccuggagucuucaaggcuagccugaucuauacaaggcaucuucuuuuuuuuuuuuuuuuuuuugagacggagucucacucuguugcccaggcuggagugcaggggcgcgaucuuggcucacugcaagcuccgccuccuggguuuacacaauucuccugccucagccucccaauagcugggaccacaggcgcccgccaccacgcccggcuaauuuuuuguauuuuuaguaaagacagggucucacccuguuagccaggauggucucaaucuccuaaccuugugauccaccugccucagccucccaaagugcugggacuacaggcgugagccaccacacccagccuauacaagguaucuucugaguguagaagauagcaguuugaauuagacgaguuuuaagaugcuaaguaaaugagagaaucagaauagaaguuuuguauuaguacuaugguacaaguuaccugaauauauucacugcuuccugaauuuuuucugauaaugggggaaguaacacuaauacaagaguguggguuuauggcuuuuuuaaaguuagaaaugacucacaguuccaaaugacucaagguaggugaaaguuuuuggaaguggucugacuacucugacaucuucccacaauaucaagaaaaaguauccccugaagauuuacaaugacauucaaauaagaaaaacuacaacaugaauaugaaaucagaagaaaaauaacuuuuuuuuaaaacgaagauacuuuaggugggagcaaagaaugaaugacagaaaggcagccaugggggaaggagcaucacguaacagugguaggcagaauaauggcucugaaagauguccaugucugaaucccuggaaacuaggaauacauuacguaacacauagcaaaaggaacuuugcagauguaagucaaggaucuugcuaugaggagaucauacugcauuauccagguggcccacuauacucagaaaggacauuauaaguagaagagggagaaaggagagccagugucagugaugcaacacgagguaucugacuggcugucacugguuuuggagcuugaaguuagccauauguauuagucuguuuucaugccgcucauaaagacauacccaagacuggguaauuuauaaagaaaaagaaguuuaauggacucacagucccauguugcuggggaggccucacaaucauggcagaagagcaagggacgucuuacauggcagcaggcaagagagaacgagagccaagcaaaaggggaaaccccuuauaaaaccaucagaucucaugagauuuauucccuaccaugagaacaguauuggggaacugcccccauaauucaauuaucucccacaggaucccucccacagcauaggaaucacgggaauucugggagcuacaguccaagaugagauuuggguggggacacagccaaaucauaucaccaugaaucaaggacugugagcagcucauagaagcuggaaaaggcaggaaaacagauucuucccuagagccuccagaaaggaaagcagcccuuucuauauuuucgacugguagggcccauucuggaccuccagaacugaagaauaauacauuuguguuguuuuuuuaugccacuaaaugugugguaauuuguuacagcagcguuaggaaacaaaugcaauaauauaccagcagaaggcaucacacagggaggcaugggcuaagagaaggacauaaaauuggacaccagugggaaaauacaccuuaucauuuuguacugacucaguauuuuaaagauggugauucuuucucguuuuuaaauguaauacaauaccauugcaauacaguuucccuccaacuccaacuuaguucuugacaaguaagccuaaagugcauuuggaaaaauaaaugugugacaauagacagguuaucaauuugaaaagagaaagguaauggagggaguggagaucaaccuuuaucagauauuuauguaaacuacaaaugguucugguacaauaauugaaaggcaagauaacagaaaaaauacuuuaaaagaagguucugaugcuugcagaaacuuauuacauuauaaaggugguauuucaaaucaguaagaaaaccacggguuauauaauaauugucagugagguaaccaacuagucauuuagagagaaauaauaaacuugaauuacuacugcauuccuuauaucaaauuaauuccugauaaagauuuaaacaauuagcaaauauauuuguuauaauaaucuugaaauaagaauaacuuuugaccagaagcuacaaccagacacauaaccaagguuguacagaaaaagauugauaaauuugaauauauacuacuauuaaauuuguauaaagaaacuaaaauaucauaaagaucaagagacaaaaaauuugggaaaauucuuugacaaauauaacaaaggguuaaucucuuuaauauauauaaagauaauaauaaauugagaugaaagagaccaucaaccuaagagaaaaaaaugagcaaagauuacaggcaguuguaaaaauagcuagaaauuucuuacaugaaaagaugcucaacuucauuuauaauuaaauauauguacaugaaagcaagauaacacaccauucuugaucaaauugcuguagauaauacacaguguuagugaggguuugaaaaaaaugggcacuuuauauaaaaguuaaaagacuaaccaucuguuagucaaagugugaauugauguaaaccucuuucuggcuaauuugucauuuguuacaggagaucguuagaaagcagaucuuuagacagcauggacuuuagaacuuuugccauguuaaaauuuuucccucaccucggaacaggugggauugauaaacuaccauuacuauuucuaaaacaugguacuguaaagcaccauuuacaggcauugcauaauuauuacucuaucuaaaaaaugcuaaaugcuggauaugcuguauguuucuauuaaauaauaaaaugggaguguggguggagggaagccugccucuuggugucaugcaugagaaaaacuaaucagaucucaccaauaucaaucgucugagcugugaaugggugucgggauagcaucccucuuuagaaguuacugaugaaaccccaugaagcuugauucuuagauaagccuugcuuggucagccacuucaaaauuggagguaccaauuuaacauuugaaaacaaaaaaucucaacaacaaaguucugagaaaccaguguggguacuaccuaagaauguuacuuuggguaugauauggguuaaacuauguccucccaaaauucacgugucaaaguccuaaccccaguacauaagaaugugacauuauuuagaaauagggucacugcagaugcaauuaguuaaauggagaugagguuauuaggguggaccccaauccaaugacaagugucguuauaaaaagaagaaaucuggagacagacuuguacacagguauaacaucauaugaagauuggaguuaugcugccacaagccaagaaaugcuaaacauugucagaaaaccaacaggaauggaacaaauucucucucacagaccucagaaggaaccaguccugcugacaccuuaauuuugaacuucuagccuuuagaacugugagacaauaaauuucuguuaagguaugcaguuuguaguacuuucuuauggaaacccuagcaagccaauauagaguuaaaaaaaacaguaaaagguacucguugaaaaacuuuugauuaaucucuuagcauuuuaacauauuuacuccuugggaaaaaaauaacaauuagggacuaucaaaaaaggggauuaucuuucuucuugauaaaauucccaaaaguguaauagguaucaaaauuuuaaaaucacguacccuuuaauaaaauaaauaaguauuguugcuguaaacaggcaauauaguacaauauagaggucuacagacuuuagacugcacaaaguccaccuggaucacuuguuaguaauccggauuuguggcucuccccggaauucuuacuaaaucggaaucucuggugguagccauggagaguuauaucuuacaauuaucccaggucauguugaugcaaauuguuggugaaauauacuuggaaaauacaggaagaguaguucaagagcaugagcccuuuaacuggagucagaaucccaacucugccuuuuuuaacaaaguugccuuggcaaagucuuacaguuuccucaucugcaaaauuagaauaguaauaguaucugcuucaagguuuuguugguaguugugaaugaaauaauaaaaucaauaaauaacuuugauuaaaauguaucaaaccaccaaugacauucuuaacauaaugagaaaaaaacuauuuuaaaauucauaugggaccaaaaaaaaaaaaauggcccaaauagccaaggcaauucuaagcauaaagaacaaaguuggaagcaucacauuaccugacuucaagcuauauacuacaaggcuacaguaaccaaaacagcaugguacuggugcuacaguagacacauagacaagcagaacagaguagagagcucagaaauaaagccacaugucuacaaccauuugaucuucgccaaaccugacaaaaacaagcaacgggaaaaguacucccuauucaauaaauggugcugggauaacuggcuagccauaugcagaaaauugaaacuggaccccuuccuuacaccauauacaaaaaaucaacucaagaaggauuaaagacuuaaauauaaaaccuaaauccauaaaaacccuggaagaaaaccuaggaaauaccacucuggacauagaacuagacaaagauuuccugaugaagaugccaaaaacaauugcaacaaaaccaaaaauugacaaacgggaccuaauuaaacuaaagagcuucugcacagccaaaaaacagaacaaaaacaaaaacaaaaaaaaaaacaaaaaaaaaaccaucaacagaguaaacagacaaccuacagaaugggagaaaauauuugcaaaguaugcaucugacaaaggucuaaucccaaaucuauaaaaaacuuuuaaaaaauuacaagcaaaaaaaccaaacaaccccauuaaaaaugaggaacauaacaugaauaaaaugauucauuucaaaaagaugauucauuucauaaagcacuuagucuagugucuaaaagccuaagugaucaaucaauguagccauuauuacuacucaguaauuuuuaaaaugagauaaaugugcaaguacugauauguuaagcuaaaacaauaaacaaagggaagaauaauaugugauguauguucauaucugugugaaaaaaguaugcacucaaauuauauauuccuggaauauuucuagaagauauuauuagaaacauuugguguuuaacacugggaaaugagaucauauucucuuuugcuuugcuugauuuaaaaaaauuauauguacaugugauuuucagggaaaaaauauaguuugugaaucuaccaccugaggaaagagaugauaccauuucaaauacaaaugagcuuugauuuuuauuucuggcacuacuguguagaaauuugcauaccccaggugaaauuggaaauggugaaaucccaagaauaaucucuguaaugaaucauacaaaugcaacugaaaacaugccaaaugucagguaaaacuaaauaggaaccaccuuuguacaaauccucaaaaaaagaccuagaugaucuagaucagaagucaacaagaagucaaaagaaguggaauguaguucaccaauaagaagaugacaaagaggagaauguucaccuagacucgaacccuugaaccauuuaucuuucucuuguucuaucaugcuuacuguuucuguaaagaagccaucaacaaguugggcguauuagcucacaccuguaaucccagcacuuugggaggcugagaugggccgaucagcugaggucuggaguucaagaccagccuggccaacauggugaaaugcugucucuacuaaaaauacaaaaaugagcagggcaugguggcgugugccuguaauaccagcuacuugggaggcugagggaggagaaucacuugaaccugggaggcagagguugcagugagcaaagauugcaccacugcacaccagccuggugacacagcaagacucuguuuccaggaaaaaaauaaaagaagaaguagucaucaacuucuguaagcuuuucacuuccuaauuacccuuaaauccacacuauuuuucuacguccauaaucacuaagcuaguucaagcuucaucagcucauaccuauguuacauauuuaaauaaucuccaaacucccaucuaauuuagcuccauuuuaaccaggaguucccaucauucugaauacuaaaacauuuuuuucgaaguaaaaauuuuuacagauucucuaagugauaauauuaggauuaauuuaggaauguagacaguauaauaaaugacuuucuuauuuacucucuaaauuauagauaagaguccaggguucaagaaaccaaccagagauuuuaaacauuuaggcuuugcaggccacauggucucuguuguaacuacucaguauugguguuguagcacagaagcagccacguacaauauguaaauagaaaagcuuguccagauuuggccugcagugagucagaacuguccuagugaccacagauugccagacuguggcaaagaggucaugcaaaagaguuuaaaacaucaguaaggcuagugaugaagcagauacugguuuaggcccuuggcaguguaggcuuccuacuccuacacucuagaacuacauagacuggcaucaggucucccaagcgaguucuuuauugcuaggcuuaccuuacauacuuucugcaggugagaagaucacaaagagaauaagugacacaagcucaguuucugcucccaaguuuaggagucaguuaacuucccugagaaaagaacaggaacagagagaagcccagucacacuuauccauaacucuccacgugaaaauacaaagucaggggaaagaaucucacuuuccuugcccaacugcaacagguaaguuguaccacuguauuaaaaaaaucagcaaaaagcaaaagugauuuuccauuuuuauuaaucacaacaaaacuuaugcaaauuuuaaaauaauaaauauggacauggauauguaaaaccuaccauuuauuuaaucuacagacagagguuaguaucuguauggauuuucaagcccuuuucagcaaccccauaguggcccacuugagauccacagcuucauaccacuucuaaaagguagggacuauuauaacccucacaguauaguacugucagaggacaaucaugaucauccaauaaauauuuguugaauaaaaauaugaauuuuauacuaauuuauucuuuaaagcuuucaaagccucuccaaggauaccuuuuaauacaaacccucucuucccauaugccugauauacucaguagccuccauccugaaugacauauuccugccucugucuucuugcuuauguucuccuuauucccucugaguagcagggcccucccaggccuauagaaauucucccuuuccuucauaggcaaucauaaauucuacuuaguccaguaagaauuuuguggcuacacuugacuacauagcuugcuuucuucucugaaccuaaaaacaacaguaauauucuguuugauauuaaaucaguaucucaugacacauuagcuuuucaggacugcauuuauaaucaauauuuuuauuguuagcuacuuuuguuguuguuguaguauacauuuuuauuuuuacuuuuuauuucaauagcuuuaggaauacaaguguuuuuugguuacauggauaaauuauaggaaccucccaacucuccccccuucugagucuccagugucaacuacaccacacaguacaccuuuguguaccuauaacuuagcuuccaauuauaaguaggaauaugugguauuugguuuucuauuuccaaguuacuucacuuaggauaauggcuuccaguuccauacaaggugcugcaaaagacauaauuucauucuuucuuauggcugaguagcauuccaugguauauauaccacauuuucuuuauccggucaucaguugaugggcacugagauugauuccguaucuuugcaauugugaauuguguugcaauuaacauaugaguacaauugucuuucuaauaacuuccuuuucuuugaggaaauacccaguaguuggauuguucaauagaugguagaugugcuuuuaguucucugaaaaguugccacacuguuuuccauagagguuuuacuaauucacauucccaccaacaguuuauaagcauucucuuuucuccgcaucugaaccaacaucuauuguuuuuugacuuuuugaaaauggccauucugacuagggugaucuuguagcucacugugguuuuaauuugcauuucucugaugauuagugauaucgagcauguguuuguuggccauuuguaugucuucuuuugaaaaauaucuguucauauugcuugucuacuuuguaacgggauuguuuuuuuuuuucuugcugauuuguuugaguuccuuauagauucugcauauuagugcuuugucagauauacaguuuguggauauuuucucccauucuguagguugucuguuuacuuuguggauuauuucuuuugcagugcagaagcuuuuucauuuaauucaaucacauuuauuuuuguuuuguuggauuugcuuuuggggucugugcccuaaauuauuugccgaaggcaauauccagaagaguuuuccuaaguuuucuucuacaauuuuuaugguuucaggucuuacauuuaagguuuuuuuguuguuguuguuguuugcuuguuuguuuguuuuugagacggagucucgcucugucgccaggcuggagugcaguggcccgaucucggcucccugcaagcuccgccucccagguucacgccauucuccugccucagccucccgaauagcugggacuacaggcgccugccacccaaccuggcuaauuuuuugcauuuuuaguacagacgggguuucaucguguuagccaggauggucucaaucuccugaccucgugagccacccaccucggccucccaaagugcugggauuacaggcgugagccaccacgccuggucacauuuaaguuuuuaauuaaucuugaguuaauuuuuauacauggugagagauaggaauccaguuuucauucuucuauacguggcuauuccauuuucucagcaccauuuauuaaauaggauguccuuuccccagugcauguuuuugucugcuuagucaaagaucaguugguuguagguauuuugcuuuguuucuggguucucaauucuguuacauuugucucugugccuauuuuauaccaguaccauguuauuuugguuacuauuauagcccuguaguauaacaugaagucaggucaugugaugcaucuagauuuguucuuuuuccuuaggacugcuuuugcuaguuaggcuuuuuugguugguuccuugugaauuuuuggauuguuucuucuaauucugugaagaaugacauugguauuuugauaggaauuguauugaaucuguagauugcuuugagcaguauggucauuuucacaauauugauucuuccaauccauaagaauaggauguuuuuccauuuguuugugucaucuaugacuucuuucauugguguuuuguaguucuccuuggagagaccuuucacauccuugguuaaguguauuagguauuuuauuaauauuauauuauuuugcagcuauuguaaaugggauugaguucuucauuucauuuucagcuuggucauuguugguguauagcagugcuacugauuaguguuuauguugauuuuguaaucugagacuuuagugaauucaucuaucagaucuaggagucuuuuggaggagucuuugggguuuucaagguauaagaucauaucaucagcaaaagaagauaguuuggcuuccucuuuuccaauuuggauguucuuucuuucucuugccugauugcucuggcuaagacuuccaguacugugcugaauagaagugaugaaagugggcauccuugucuuguuccagccuucagggagaaugcuuucaacuuuuccccauucaguaugauguuggcuguggguuuaucauauauggcucuuaucauuuugagguauuuuagcuacuuuuuagauucuacccucccagugagcuagugcuccauuugguguuucauuugugugugugugcacgcuucuauuuuaugcuucacagaaauccauacaauuccuacacagaguagacuuucaaaauauugaauuauuuauguuaaaugacucaauuaauuaacaaaagaauggauaaauaaauaacauaaaugaccaauauuaauaaaaauuaagucuuaaaaauauggagaaaaacuugaauggccucccaaaaccuuccaaucccugugcuauuuuaacagaaacauuaauuauuuuuaaaaaacccucuuuguagucauuuacuucacagagacaagaaauaugguaacauaaagguaaauaauauaaaucugugacuugaauccuugaaaaaucuggaacaacaaaaauauugacaaauaauaucauuguuuaaaauacugaagaagaauauauugcaaugacaauaugaaaauauguuuugguaucuccagucucagucuuguuagaaguauguucagaagugaacaacugaaugagaagugaagugcucauaggggaaggauaaguccagaaaucugaauuuagucccacauagcaaugaauguuucucaauuauacaaauuacagucaccacuucagugauaaucaugucauuugccauuuauuguuuucacucaucaagggauaaagaaaaauaaaagaugaaaguuacuugaaaaauaaugaugaauccauaugcugagagaaaagcauuguguucuaaaugacaaccaacaccugaacccaggacucacuuauuugguuaauuaauauacauucgaggcugugaaauugucauuucuacacauaauaauuaaacaccauuaauggaaacaccuaaaauaacuacauuugcuuucucagagaauuacacauuaggaaaguaaguuaaugugauaaacauuuuacaauauauuuagacuuuuaggaaacuuuuuuuuucuuuuuucuuuucuuuuuuuuuuuuuuuuugagauggagucucacucucucacccaggcuggggugcaguggcauuauuucggcucacugcaagcuccaccucccggguuuaccccauucuccugccucagccucccgaguagcugggacuacaggcaccugccaccacacccggcugauuuuuucuauuuuuaguagagacgggguuucaccauguuagccaggauggucucgaucuccugaccucgugaucugaccaccucggccucccaaagugcugggauuacaggcaugagccaccgcgcccggcccuuuuuaaaaaauuaacgugauuuaggaggccacuugaagauauucagcuuuugauggcauaaaauucuggcuuuaauaaccaaccacuaguuauuuaauaugauuguguaccugcaaaaagcuuaagaaacuuuuagcuaaaugaaggaauucuuuaagaagacaaaauaagaauuagucacauaucugcuuuuccacuauucuuguuaccauuacucuaccagcaucccugcaaagcagaucagcaauauuuguguguuuugaaacuccucugguuuccuggcuucuaagauccaguccaucaccaagucccaugauugguccacucuuguugucccacguccauguuaaacuagguuucagcaucacacaugcagauuaaugucacugucucugaacucaucucccuucuuggacagcuucacuucauccuauauaccaccauuagaagaaucuuugaacacaauuauucucaaauuauuccuagcccaaaaacucaaauacuuucuaaauaaauuuuauucaaaucaaaacucucuagcauagcgcuguauaucccaacaugccaauuucaccuucuuuauuucauuuuccauucaacuguaugccaaggcucuacuuugagcucaucugcuuguuagaucagcuuaacacugaauuugaacaugccuuaccucacaauucuacuucuucaaguucuucaccuauuuuaaaagccagugaagaagcacuuacagagguagaauaagaaucuccagaacuccacuccuucauaaaaggcacaggaacacucaaaaaguugucaaaauaaacuuuagcacuuaaccaaagguuugcaauaauccaucaaggauuuauucaagaaaaucaucagaauuuuugugaaaacaguuaacauuguguauuuaaauuugcucuaaucccauuuccaucuccccagcuccacaacagucucacaaucacucuuaaaaccaacauauacuagagggcguuaaauggguuuggagcucuacaaacugucuugcacucacagagaauucauauuugauguaugcagcagcucccuggaaaagcuccauuuauaggacaugucuuuauuugaccugauacagaacucacucagugggaaaggcucuguucuuaagauguuagucaaaaucaauccugacccauagaauguacaucaagaaugaacccuaaugcaaacuaugaacugagggugaugaugaugugucaauguagguucaucaauuguaacaaauguagcacucugguggggauguugauaaugggggaagcuacacauauguaugggggcaagggagauaugggaaaucucuguacuuuccucuuaauuuugcuaugaaccuaaaacugcucuaaaaaauuagucuuuauuauaaacaaaacuauguauuuuucuacaaucaaauuucuucacagcuauauguucuuagcuccuuucaugcuuuuauguguuuguauaccuuuuguguuccagugguugggaauaguuuugugaaaauaaaaaauauuuccauaaagaaaaaaagcuagaaaaguuguugcuauuagaccuacucuauaagaaauaugaaauuuuuauuuuaauuuaaauuuuguguagguacacaguagguguauguauuuauaggguacaugggauguuuugauacaggcaugcaauaugaaauaagcacauuaugaagaacgggguauccaaucccucaagcauuuacccauugaguuucaaacacuccaaucacacucuuuauuuuuaaauguagaguuaaguuauaauuuauuauagucacccuguugugcuaucaaauaggucuuacucauuuuuucuaaguacuuuuguacccauuaacccuccccaccuuaaccacaaaccccacacuaccauucccagccucugguaaccauccuccaacucucuaucuccaugaguuuguuuugcuuuuuagaucccacaaauaaacaaaaacauuugaaguuugucuuucugugccuggccaauuucacuuaacauaaagaucuccaguuccauccauguuguugcaaaugacuugucuagaucucauuauuuuuauggcuggauaguacuccauugcguauaaguaccacauuuucuuuauccauucaucuguugauggacgcuuugguugcuuccaaaucuuagcuauuguaaacagugcuacaauaaacauaggagugcagauaucucuucaacauacugauuuccuuuucuuuggguauauauccagcagugggaucgcuggaccauaugguaguucuauuuuuaguuuuuugaggaaccuccauauuauccuccauaaugguuguacuaauuuacauucccacuaacaguguauaagguuuuccuuuuucucuacauccucaccagcacuuguuauugccugucuucugaauuaagccauuuuaacuggguaagaugauagcucauugcaguuuucauuuauauuucuccaaugaucaaugauguugaacaccuuuucauacgccuguuuuccaguuguguaugucuucuugugagaaauguauauucaaaucuuuugcucaucuuuuggcaaaguuauuuuccuauagaguuguucgcacacucuauauauucugguuauuaaucccuugucaaaugaguaguuugcaaauauuuucuuccauucuguggguuguccuuucacuuuauugauuguauccucugcugugcagaagcuuuuuaacuugauguaaucccauuuuuccauuuuugcugugguugucugugcuuaugguauauugcucaagaaauuuuugcccagaccaauguccuggagaauuuccccaaaguuuucuuauaguaguuucaugguuugagggauuugauuuaagucuuaauucauuuuuauuugauuuuuguaauuaaugacaaauaggggucuuguuucauuauucugcauauagauauccaguuuucccaguaccauuuauugaagagacugucuuuuccccaguguauguucuuggcacuuuugucaaaaaugaguucacucuagguguguuuauuuguuucuguguucucuauucuuuuccauuggucuauguauauauuuuuaugacagugucauacuguuuugguuauuguagcuuuguaguauaauuugaagucagguaaugugauuccuccaguuuuguucuuuuugcuuaggauagcuuuggcuauucugguuuuuuugugguuccauauacauuuuuggauuaucuuuuccuauuucugugaagaauguuauugguauuuugauagggauuucauugaaucuguacauuucuuuggguaguacaaacauuuuaauaauauugagucuuccaauccaugaacacggaaugucuuuccauuuuucuguguccucuucaauuucugugucaaugguuuauaguuuucaucauagagaucauucacuucuuuucuuaauucauuuguuuuuaaucuuauguguggcuauuguaaaugggauauuuuuauuucuuugucacauuguucacuauuggcacacagaaaugcuacugauuuuuguauguuaauuuuguauccugcuacuuuaccaaauuuacuaguucuaauaguuuucuuguggagccuuuagguuuuucuaaaaucauaucaccugcaaacaaggauaauuugacuuacaccuuuccaauauggaggcccuuuauaucuuucuguugucugauugcucuugcuaggacuuccaguacuacguugaauaauaguggugacagugggcauccuugucauguuccagauuuuagagaaaaggcuuucaguuuuucuccauucaaugugcuacuagcuaugggucuuucauauauggcuuuaauuauguugagguauguuccuucuauucucaguuuuugaggguauuuuaucacgaagagauguugaauuuuaucaaaugcuuuuucagcaucaaucgaaauggucauaugguuuuuauccuucauucuguugauaugauauaucacauugauuuguguacguugaaucauccuugcaucccagggauaaauuucacuugaucaugaugaaugauagaaauacuaaauuauuaaagggaggcuuucuggcugaaaagacaguaaacaguaaugcaaauucacacuaaaaaacguaaaaaguguggguaaagguaaauauaagauaguauaaauguacuuuuauuuauacucuuuucaccacccuuaugccuuaaaaaaucaacugcauaaagcaauaauuacaaaucucuguugaugugcuuauaugaagauguaauuuguacaaaagcaacaauacaaauaagggaggaggaaauauuggggcaaaguuuuuuuguauauuauugaaacaaacuguugauauuaauucaaaauagauuauuuuaaguuaaaaaaucaauuauaaccucuagaauaccaacuaaaaaauaacucuuaaaaauauguaugaaaaacauaaaggaaauuaaaagaauaaacuagaaaauaucuauuuaauacaaaggaaggcaguaauggagguauagagggacaauaaugauauaagaaauauuagaaacaaauagcaagauggcaggcauaaauacuaccuuaucaacaauuacauuaaauguaaguagauucaacacuccaaacaaagagaugagcagaauggacucuucuguuuuuguuuguuuuagguuuugcuuuuuuguuuucuuauagacagggccuugcuguguugcccaggcugguuucaaauuccuggccucaagggauccuucugccucacucugccugccacaaaaugcugagauuacagacaagccacugagccaagccagauaaauuuuguucaaaaaaugauccacauguuguccauaaaagauacacuuaauauucaaagacauuaauagguugaaaguaaaaauaugaaaaaaagauacaucaugcaaauaacaaccaaaagauaacuucagugacuauacuaauauugaacaaauagacuuugagacaaaacuugucacuagagacaaaaaaaaagacauuuuauaaagauaaaacagucagucaggaagacacaacaagcauaaacauauauacaccuaaaaauagggccuccaaaacaugaaacaaaaaguaacagaauugaagggagaaauagacaauuaaaaaauaauaguuggagacuucaauaucacauuuucaauaaugaauagaacaauuaggcagaacaucaaccagcaaacagaagacuuaaauaauaccauaagccaaguagaccuaacagacaucuauagacuacucuaccaaacaacagcagaaugugcguucuucuuaaguacacgugaaacauccugcagaauagaccaugcaauaugagacuugccauaaacaagucucaauacauuuuaaauguuuuaugucauacaagguauguucucugaccauaauagaaaaaaauuagaaaacaauaaaaaugaaaauugagaaauucaugaauauguggaaauagucaacaugcuccuuaauuagcaaugugccaaagaagaauucugaagggauauuaaaaauaauuucaaaugaaugaagacaaaaacacaacauaccaaagcuuauggaaugccgcagugcuuagagagaaauuuauagcuguaagccuauuuuuaaaaagacauaagucaauuauaaccuuuaguauuaagaaacuagaaagaaauauaaauugaaagcaagcagaaaagaggaaauaauaagagcaaaaauaaaugcaaauaaagaauagaaaaacaauaaagaaauucaaagaaauguaaguugguucuuugaaaaaaaauacaauugacaaaauuucagguagacugaacaaaaaaaaagagagagaagacucaaauuacuaaaaucaggaaugaaagagaagcuaucacuaccaacuuuacagaaauaaaaaaguuuauaaggaauacuaugaauaacuccaugccaacaaaacagauaggcuagcugaaauaaacaaaauccuaccaaaacugacuuaagaaaaaauaaaaauaucugcguagaccuauaacaaguaagagauugaauuuguaauuucaaaacuuuccauauauuacggccaggcucagauggcuucaaaggugaauuaaaccaaacauuuaaagaagacaauaacaaucccucacaaaugcuucuuuaaaaaaaacaaacaaacaaaaaacacaaaaaaggaaacacuuucaaauucauuuuaggaaucuuguauuacacuaauaucaaaaccauauaaacacaucacaagaaaaguagacaucaacaucccuuauaaauguagacacaacaaccuuccacaaaaugcuggcaaacuaaaugcaacaacauacaaaauaauuauauaucaugaccaagugccucaggaauacuuggcugguucaauauaugaaaaaucaaccaauaucauacacuauauuaauagaauaaaggacaaaauccacaaaaucaucucaacagacacagagagugcauuugacaaaauguaacaugcuucuggucgggcaugguggcucacaucuauaaucccagcacuuugggaggugagugaaucaccugaggucaggagcucgagaccagccuggccaacauggugaaaccccaucucuacuaaaaauacaaaaauuaucugggugugguggcagacaccuguaaucacagcuacuugggaggcugaggcagaagaaccacuugaaccugcggagcggagguugcagugagccgagaucaugccacugcacuccagccuggcaacagagcgagacuccgucuaaaaaaaaaaaagaguaacaugcuuccaugauaaaagcacucaacaaacuagaaagaaugagaauucucuaaaucugauaaaggcgucuaugaaaaaccuacagcuaagauucuauuuaauggugaaaaacugaauauuucccccuaagaucagaaacaagaaauggaugucacucacuauuuccauucaacauuguacugaagguucuagucagggcaauagauaggaaaaacaaacagcauccagauuggaaagaaagaaguaaaacuaucuuaauuuguagaugacaugaacuuacauauguagaacaauccuaaagaagccacaaacuuuauuugaaauaauggacaaguucagcaaguuugcagauacaaggacaauacuaaaaaaaccaauuguauuucuauaugguaguaaugggaaaugcaaaauuaaauuuaaauaaaauuucauuuacaauagaauaaaauaaauuacuuagacaugaacuucacaaaaaaaaucuaagauuuguacacuaaaaauuuaaaaacauaguugaaauaaauuaaagaaggcauaaauaagugguaagacauugcauggucauggguuagaagacacaauauuuuuuaaauggcaauaaucuccaccaaauugaucaacagguucaucaaaaucccuauaaaaaaaauccguggugcuuuuuuucacagaaauugaaaagcugguucuaacauuuauuuauauggaaacagaaggaacucagaauagccaaaaaauuuugaaaacuuugaacaaagugggaggagucacucuucccaauuucaaagacuacuaaaaagcuacaauaauaaagacagugugguacagcauaagaauagucauauagaucaauagaaaaaauaguuuuuucaacaaauggugcugggauaacuggauaucuauccacaugcaaaagaaugaaguugaauaccuaccucauauaauguacaaaaaugaacucaaaaugaaucaaacgccuaaacgaaaggguaaacucuacaaaacucuuggggaagaaguauagauaaaucuucaugaccuuggauaggguaaugguuucuuagauauaacaccaaaauaacaaguaacaaaagaaauaaauaaacugaauuuugucaaaauuuaaaacuuuuaugcuucaaaggacaucaagaaaguaaaaagacauucacagacuaggagaacguauuuaaaaaucauauauuugauaugggacuuguauucagaccauaugaagaacucauaauuaacaauaaaaagacaaauuauccaauuuaaaagugggcaaaggaauaaguauuucucuaaagaagaucuacaaauggccaauaagcacauaaaaauacuaaacaucauuagucauuagagaaaugcaaaucaaaaccacaauaagaaaccacuucucaccacuaaggugauuaaaauaaaaaagacuaacaauagcaaaaguuggcaaggauauggaaaaauuggaaccuucauacauugcuggugguauuguaaaauaguguaaccacuuuggaaaauaguucggcaguuccuuaaacuguuaaauauagaguuaccauaugacuccaauauucuaccucuaguuauauauaacaaagaaauuugaaaacaaauguucauacaaaaacuugcacauaaaugcucauagcagcauugcucaaaauagucaaaaagggugaacaacccaaaugccuaccaauugaugaauggagaaacacagaauugaauauuauuuuguaauaaaaaggaaugaaguacugauauauuuuacuauauggauaaauuuugaaaacauuaugcugugauacauucuacaacauaaauaaacuuuaaaaacauuaugcuaagugagaaaaaaacagauagaaaaggccacauauuacacgauuucauuuauauggcauaugcagaauagacaaauugauaaagguguaugccaacuuagugguagaaaaaaggaaggccaauaugggacaccgaagcuaauaagacaugaguaggauuaaauuuucagucuaguaacacaugaggaaugccuguggcaaagcaagaccaagauaaaugacauaagaagacaaauaaaauugcaacuucacugggaaugagauaugguaguugaauuugaagauucugccacuauguuucacaaaauauauagagagaaacauauauaaauacauagacauaugaaccccugugaaauuguguguuguaagaaaaagaaaaauaauaaaauucuuuaaaaaaaaacuaccuuguguuuggauugugccaaccaccacaugguaauaucugaauaagucuggguaauaugugaaugagcauacaguuuguuggcaugaacaaauauugaaaucaauaaguuauaccaguuaugaaguauuucaauucucacuccugauucugauaucagugacagucaauguaguagguuuuuaaauuccaaucugccuuagguguucagauccauuuucuggagcagguuugaagucugacagucccuacccggacucugguuccuaugcuuuauuaugugcagcaagucacugaaacugcgagauuucuucauguauaaaaucagaaugauaauauguuucucaaaaguuuguuucaagaacgaaacaaaauguccuguguaaaagaucuaauaccacuuccagaacacaguaugagcuuucuuuuaggacagcuucauugccacugccuaugagcugaacuaagcauuucaugacaagagacccuggaauauaaggagucuacaaacaccuacauuauuuagucauucaggaugacagaacaagugacaagagcaauuguucccaaccuuagcugugcauguggaacaucugugaagcuuuuuaaaugcauauaggucugagacucaccucccaacaacccuccagcaccuggucccaugcugauaaccuuucuucuguauaaagucuuacauaguuuucacaaauacuauuuauaaaacccucaguguuuucuucuucuggcuaaaagugccugcuguuuuaacucuuccacugcaaaacacugucuaauuauuggauuauucuuaaaacucaucugugagcccuggcuacauuaucugacugucucuuugguuauguggcuucauuuaucauuggucgaacuuacuggaagugaaaaggaagguuaccuuaauugauagagcuauugauauaauucuaagauaugauuaauugcacaggacauuuuaauuauaugauccguucuucaugagacaacaaaaaccaaggcauucuagacacccaugagggagcucuauuucuaugucugaaaacgaaauuagacuucuugcuuuuauuuuucccuucccaaaugacauuuauauaacacacuuaaguucugauggaguauggcaaauguauuuaacuuucgaccaauauuuauagaauccuuuauuucauaagggauaaaagcaagcccagaauuuuuccugucuuuuaacucuugaaauuguccccuaagaauauaaacaaacuaaaaggcgaagcaaaacauagacaauauccccuugaaugauucauaauaaccacauuuaagccucucuggguuuuguuuguuuguuuaggucacagcacuauugggaggcaaagggguuauuggcuauugaaguguuugcuguugaugaagaacuaaauuuaaggcauguauucuuuucuugacuagaguuugauuagcuucgucauacuuuugcuuuagggaaagaaugguauagaagaaauaaaagaacuaacggaagcccuuccauuucaaucacuguaaagaauuuaucaucauaagaucaacaaagcaccauuuccauguaccuuuugcaauauauauauacacacacauauauauauauuuuacacauauauaaauuauauauauauauauauaaaauuauugcaucggggcuucuuuguugcuuuucuuuuuccucaaugacauugagacuuuaccuauauccaauaacauuugccuuccuuucuauuuucuugcauguuuuaaucucauagugucacauggguucacuuuaccuaaagauggaauauucuccuccguuggagaagaaccccaaauuaggccagaagaauacugaaaaauguauggacuuuguagucagaaccugggaagaaaaauccuaacucugccagaugaaaugguccaagucaaguugaauggaaggauuaaaauagaagauuaauaaaaugcagcuguagacagcuggcacauagugacagucaauaagugacaauuuauaauucauucauuuauucuaccugccuggagaagugaaaucuaagagaaauagacaauagaaauaaaauacaaaucuaucaaauaaaacaaagugaauuaaucaguaagcauucuugaacacuaauauauauaaggaagggcuaacuuaagaaagacaugcuuuucaagaguuuauaaacuggcuuaccauuuuaagacauuuuccauaaaaauuaugccacaucauauaaauuaguaaaacucuauuccaaucuuaaccuacuuguacucuauguucuagucacucuagaaguccuaaucacaugccaaaccaugccacaaguuuccagggacacauuucacauaucugcugcucucaguagagggaucaauaauucuucccuacugggcugcagagcgaagaaaaugggaucucugauaaguacaggcaaucaauccaugcugguguccacugcagaauuuaggaacuccaugaaaucaggaguaagggaaggcuagaccacccucugaaaacugaacguuaaggguucuacuuuaugcaugauaaauacauagagcaaagugaaagaaaucagauggagucuggucagaacgaauggaagggaaaaauaguuaacuauaacaggauugugagauggucuaguucuaguaaggggaaaggagcucaguaagguuggagaaguaggcaucaauuaguuccaggguacaugcaguguagcagguugggauaaacuccaacaacaaggagaacugauuauuuuagcaagaggaaacaagacaucucugacaggggcagggggaggaugaauaaacaagaggaugagugucuggauuaggcugagaucccuacagcagugggacacuggguggacucuggggggaaaucugugguaaaauucccaguaaguguggccuuggggagaaaaagagagggaaauuccaagaacaaaguacuuggguuuuggagucagaccaggguuugcaucugaguuugccccuuuacuuucuagaucuuagacuugaagcaagucaccuaaccaguaaauaauuucuuaaucacacaacuuuguacaauaaugccuacaucaaaggacucuucugaggauuaggagauaacaugugggaaaugccugguauuguucagauauacuuuguuuuuauuuucuuuuauuuugguauaaaauauaaguucuuacuauaagaaguuuaucuuucugaucaggagagaugauccaaccccuaauucauaaaaaagaaacaggaggaauauaggaacuuaaacacccagggguguuaugaggcaccagcccuagaaagaaguuggaggcugaaauuuuagccccaacucuaaagcaaagcaauaauauugucugggagcugaauccacccaaagugaggugcccuuuucuaauccuuucaaaggcucuauaugggauaaugggugauccugaaagugucucccuaggagguagaauacaaacuacucaacugaguggcaaaaccuuucauguucaacauauguaacauuucagucuuaaauguuuucugaauugaaccgagcauuauucaggaagugaaacacucccaugucuugggaauacauuguucaaauagucuaaaacaucagguauguuuuauuuucuuuuucacauuauaacucccugaauuauauuccaaagguagaagaguuuaugcuagauuuuuacagaggaugucuucaugcaaaauuaagggauugcagacuacaaaacuguuggcagaagauucggguuguuuuugaggaauaaauguaugcccuucccugaugcugucuuauauggcaauaaacuaaauaaaaauuguaguugauugacaguaauuauaaaccugcaacagcaauaaaauuuguguuaauuaucaaaaauaucagaccaguugugcugcccauuacagaacaauauugaauuuucuguuaaggaaauugguccaccuuucccuaauuuuuguuuugccuuccuaaagguaagccugaaauauauaauagcauaucaucagaauucauuccacugacuccacuaaaugacuuccagaaauuuugcuauagguugcuaacuaaagacagcagcaucuccuugcauggaauaucagauucaaauuucuuugccugauucuggguggcucucuaccaaauggcccuuucccuuuuccuguuaacuguuuugcuuucuaauccccaacaguuuagcacauuaggugcucaauaaguaucuguggaaagaaagaaggaagaaauagagagaugggcaggacuaugaauguuuuuuuaaagacaauagaaauccccccaccaccauucuacaaaauaccuuuugcaucugacaaauauagguaauguuauuauuaauaauauauuauuucagauauuaacuucuuuaaaaauguaaaucuucuuggagaaucaacauuuaguaauguaauuuacucauccaugccacacuaagaagaaauuuugaagccagaaaaagagaggguaguagaaauuugaaaaagaaaaacaauaagaaaaggagaacucuggaaaagauagugcucuuugccuuuguuuuugcuaaauauauucauuccuuugaugaaccauuaaaaaauuauuagcuccuauauaucuuagggauacagacauucagucauuagaaguugcgaagaucaucauuccacaaauauuacuggguuccugcuauaugccaggugcauaaguguagggaacaagauugccuacccagaauuaugaaaccaaaauagauaauuacaacuaugauuaaugcaauaauggagaacugccauggggacauaacauauaacaaaaaggcauacuaguggggaacuggaggugggggugacuagcaauuuaccuauaucuuuuuuccaaaaugaucuucaaacuagaaauauaagaucaguuaacauaaagaagaaaccgaaacucuagauaggucauacaauaguuagagagcaucaacccaugugaacagucaagucuccaguccagguauacuauaccucagggcacuaaaggaacauacauauugauuacuguaaauaacuucuguaauucuuuagaaaucacaguaagcgugauggcagaagacuggagauggguaaaucuuuaauccaauuuucaaaauagaaguugaggcaaaagacuaggaaguuuaagaucagucccugccaaaauucuuagaguuaagcagaugguuuuugaagucuuaguaaauaaacugguauucaugaaaaccaacagaauuugcuaaauuaaguuaugcuaagaugaauuuauuuuauucuucuucauucucuuucuuccuucuucucucccucacucuuuucuuucuaucuuucauaauuucuguuauucaacaagugcuuguccaacacuuucaugaaugcuuuacauggaaugcuugacaagcaagcuguuaaccaaaccagugguuugcuuaguaauagcaauuagauauugcuuaguaauagcaauuagauaaaaacuaauuugccuaaggaacaugcauucuauagucaaugcaugaacuaaccuaguucagugaauguaagauaaagaagauccuguuagcccaacauuuuguaaacucccgccauuccacagacccuggucacaguggaaaauuccacuaaggcuugggcugugaaaaacauccugcuggauaagucccaggccuaacugccuaacugcagaaaauuccucccuuuucagcagcuaaccucacuguccaccccauuucacaacaagcccagaccccucccgcucggaccuauaauuacuccagcaugcaaauggcagcgggcuccagcgcuagcugguauccccuucugcaggucuuuuguccaauaaaccuguguuguuguugagccagcaacucucucucucuuuuacccucgccuucccuucaaagccuaacagaucccuagugguuucauggugcucucuaucuaucuugagugcucucuaucuugaguuuccaguguaacauuucucucagugucuugauaaaguccuaagaaucacagacauguuguuuacauaaagcauagaaacauaacuagcacuugugucaaaaucauaagggcugcuugcucaaaauucaaauuccuaccuaucccacagauauauuuagucaaaauuuccaaucaagcgcgguggcuuaggccuguaaucccaacacucugggaggcugaggcaggcagaucaauugaggucaggaguucaagaccagcuuggccaacauggugaaacuccgucucuacuaaaaauauacaaguuagcugggcaugguggcuggcaccuguaaucccagguacuugggagacugaggcaggagaaucgcuugaacccgggagguggagguugcaguuagccauguuugggccacugcacuccagccugggugacagagugaaacucuaucucaaaaaaaaaaaaaaauugaaguuugaaguuauguagaaauuuuuauuuuuaacaaucaccacaguuauuuauuuugcacacuuaggucuaagaacccucacugaaauguuuaagacacauuaccuacccacaaucacuaacuaaccccauguguauagggggccuaauuaaaauacaacaacaacuauaaagcuucuguagauaaaugcuaaaagaucucaaagauuugagggaucuuccuuauccugcaaucccuuuuggucuugcugcuuauccuugauuaucuuccucugcugcauucuuuucuuugaucauuaauuuaaguguuaugcucuaauuuguuuuuaauuuggaugaccccucuguccuaaggauguguuuugguaaaacccuggcauccuacuaccagcucuacuuagacuccauaauuaacccuacacaaucccugaccucuaugucccagccuccuggaagcaccugacaacaaauauggaaucaagaaauugugauagcacuuucaguaguguaaacaaaacaccuaaaacacagagucucugaugaauuaucuaauuuuauuucucaccguuucuacucccacuucuaucaucaauuccagccacauaaaauaauuuuuagcuccucaaauacaucaucauacucagcaauaucauaucauacaauaaaucuuuucugaaaacugccccaagucccuuccccacaccuccaucuaauuucuagcuaugucucuuuagggcuuucuaacugucuccaucaaagcacuuuucacauugaacuauggaacuaugaucuccacuaaaagguaagccgcuuuauggcaggaaccauaaccuaacagugucagauucuuaggauauguuuacuaugaguuggaaggaaaggagaggagaggggaggggaggggaggggaggggaggggaggggaggggagaggaagaauacucuggagcacacaggugggaauaucugggaggagcagaaaagacuucagaaaagagaugacauuugagcuaugucuuagaguggcagagaaacuaaagugagaaggcagacauuucucuucaucacaauggccaauaaucuuuuuugagacacaaaaaucucuggcaugaauuaguguaacaguucccuacuaggugucacuauauccaauauuuacugucuccuagccauuuuccacaguucagccuaguggucucacuaaaaugaaaaucugaguauguccugacucuuaauguagguugcaagauuguuuauaaucugacuccugcuugccucuccagauuuaagggccaccuccccccaccacacacacacaucugaaacacuguuccaaucauauauguacaguuccuagcaugugccaagcuuguccuuuuaccucugggccuauguaccaagaacacuguuccuuuuauuucugccuggaugaucccuagugcuccuuuaggacucaguuucuacaucaguuccuguaggacucaguuuuuuuuaucuuuccuugugaaugacuaggucaaaucaccuaucacacauucuugcagaauccuacacugaucacaauuauaaugaaaugauugugaaauacuugucuuccaaaaaagauuacgaguuccaagaaaacaggcaguuggucuuuuucuuauugucuccucaaugucuaucauggugucuggcacaaagaaaauguucaauaaauauuuguuggcuuaaugaccaaacugaaguaaaugaauagacaaauguuuuuauuuccaauuagauuuuaagcaaaaugagggcaaguuucaugucugucuuguucaucauuguauucccacugucuagcacagugucugacacauaaaacucucacuaaauaguuguaaaauaaugaauaaaugacagaucaaaugaacauggcauccugccacauugcauuacuaaaugcucuaugauaaacacauuuuaucuuucuaaaguuauauuauggcugggaauuaaauuauaaaacaaugauuaucaaaaaucauagauauaaacaauaacauggcugucccucaguauccaugggggauugauuccaagacaccacugccccagucccacgaauaccaaaauucacaaaugugcaagucccuauagaaaaugguguuguauuuacauauaaccuaugaacaugcucacguauacuuuaaaucaucucuagauuaucuauaauaacuaauacaauguaaaugccauguaacuaguuguuauacuauauuguuuagggaauaauuaugagaaaaaagucuguacauguucaggacagacacaaccaucuauuuuuuuccaaauguuuuccacccaugguugaugaauccaugaaugcagaacccacggacacagagagcugacuuuauaucacaaaaaagcuucaacagcuguaaacauuugucaucauuuaaaguuauaaaaauuaggcucuauauccaauaaaacauucaugcauauauuuuucacaauaguuggagcuucaauguaaaauaaagccucuguaggccacauaaauuuuuacuagcuaaacgaaguauacuagguauaaaaauaaucaacaaaaauuuagcaaggcuuucuagaauuuagaaguucuuuuaaggaaaauuaggauagcccucaucauuaaacccgguugggguuuguuaauauuuuccuuaaaugaaaguugauauuauucaaugcaguaaccaaauaucugaacaucucauuuaagguccuuagaugagaggauuuggaagacuggaaucaucauuauuaauacuguugcuauggaugcuuuuuuccuaagcucuuugacuuuauuugaaguagaccaagaauauuagaucaaggggccagaugguaaauaucuuaggcuuugcuggccauaugcugucuguuucuacuacucaacucuacugauucagcaugaaagcagucauagacaauauauaacagaauuaauguggcuguauuccaauaaaacuuuacuuacacaaacaagcagcagcaguuuguucugcaggccaguuugcagauuacucuuaaguaaacaauugcuguuuuaacugccuagcauucauugacaauucauuugcuaaaggcaccuugauuuuuauuugcgggaucaucucuccuccucuccaaacccuuguaguugcaguggaauugacccgaggccuuuagggccagaauuagucagguggccgaagacuguccaauuagaaugucuuuacguuagcuucagugacugguucaagguugaacaaaugaaccacgauggucuacugugucucaauccugggacuuuuuggacaauugagaaacauuuuuuaugguggggucacaauguaagucuucagcugcuaguagaaaccauguagagaaaaacugccugugggugaugccaacacagaagaaagcaaagcccagauaugaagagaaagagagagaccaaauccagaagggcucaucuaagcaauacaaccuagcugugccuaaagacacaucucagccuacagccaaaagagauccaaauucaacugcauggauaacaucaagaaaacucuuaaagaagaaaaguaacccaauugagaagucuaugagauacuguggaagguacaguuauauaucucugagccagugcagaagagugagaggaauaaggaaggauagauagccauggaauggauaugagucagggauuuuuuaaaccaugaaaugcugaaacagucuuucucucccacguuaguaucuaaagagucuguaauuacagaaccuacaaauugcuccacaaacuuggggguaaagguggaagguggaaaggagagucauuagcuaaaucauccugaauaagaagauaauauacaaaaucucccaaagcaguauuucccuguaaucuacuaaaggcuuaaaauuaagggauaggguccccacucaaacagagcuugauguuuucuacugcacuaaccauaauccaugaagaaaagaagcucagaacuuuaaagagggaagcauuucaggucacuuugguccaauauuggaauuauuuguuuuuguuaacuuuuauuuuagguucaagguuacaugugcaguuuuguuauauagauaauuugugugucacagggguuuggaguacaaauuauuuugucauccagguagugaacuuaauauccaauugguaguuuuucaguucuccuccuccuccuacacuccauccucaaguaugacccaguaucuguuguucccuucuuuguguccacguguccucaauguuuagcagccacauauaaguaagaauaugugguaauugguuuucuguuccuguguuaguuugcuuaggagaauggccuccagcuccaucuauguugcugcaaaagacaugaucucaccacauuuucuuuauccagucuaccauugauaggcauuuauauugguuccaugucuuugcuauugugaguagugcugcagugaacauacacacgcauaggucuuuaugguagaacaauuuauauuccuuuggauauauacccaauaauggaauuacugcgugaaaugguagcuccauuuuaaguucugggagaaauugcccaacuaccguccacaaugguugaacuaauuuacauucccacaagcaguauacaagcauucucuguucucuguuugcugaaguuguuuaucaguucuaggagcuuuuggguggagacuauaugguuuucuagauauggaaucacacaccuucaaacagaaauaguuuuacuuuuucucuuuuuauuuggaugccuuuuauuuauuucucuugccugauuccuuggcuaggacuuccaguacgauauugaauacaaguggugagacugggcauccuugucuuguuucaguucucaaggguuaugcuucuagcuuuugugcauucaguaugauguugguuguggguuugucauagaugucuguuauuauuuugagguauauuccuucaauccuacauuguugaggguuuuuaacaugaaaggagguugaauuuuaucaaaagccuuuucuacaucuauugagaugaucaugugguuuuuguuuuuaguucuguuuauauggcaaaucauauuuauuugcguauguugagccaaccuuguauuccagggguaacaucuacuugaucaugguagauuagcuuuuugaugugcugcugaauuugguuuucuaguauuuuguuaaggauuuuugcaucuauguucaucaaggauauuggccugaagauuuguuuuuuguuguaucucugccagguuuugguaucaggaugaugcuggacucacagaaugagcuggagagaagucucuccucuugaauuuuuuugaauauuuucuguaggaaugguagcagcucuuccuuauacagcugauagaaugugacagugaauccaucugauccagggcuuuuccugguugguaggcuuuugguuacugauucaauuucagaacucauagaauuguucaggauuucaguuucuuccugguucaaucuugggaaguugcauguuuccaggaauuuauccauuucuuccagguguucucgauuguguaugcagagguguugauaauaguuccugaggguuuuguguauuucugugggggucaguaguaauguucccuuugucuuuucugguuguguuuauuuggaucuucucucuuuuuuucuuuaguauuccggcuagugggucuaucaaacuuauuuauucuuucaaauaagaaacuccuggauucagugauuuuuuuugggggggagcauggcuuuucaugucucaauuucauucaguucagcuuugauuuugguuauuucuugucuucugcuaacauuggaauuaguuugcuuuuguuuuucuaguuccucuaggugugauguuagguuauuaauuugaaaucuuucuaacguuuugaugugggcauuuagugcuauaaucuuuccucuuaacacugcuuuagcuaugucccagagauucugauauguuuuauuuuuguucuccuuaguaucaaauaauuuccugauuuaugauuuaauuucacuguuuacccaaaugucauugaggagcagguuguuuaauuuccauguaauuguacaguuuugagugauauucuuaguauugguuucuauuuuuauugugcuguggucagagaguaugguugguaagauuucuguuuucuugaauuuguugagaauuguuuucuggccgauugugugguugcuuuuagaauaugcgccaugugcagaucagaagaauguauauuacauuguuuuggaguggagaguucuguagaugucuauuaaguccauuuagucaagugucaaguuuaggucccaaauaucuuuguuaguuuucugucucaaugguacaacacuguaagugagauguucaacucucucaccucacuuuuguaggugaccugucccuuuucucuagcugccuuuaacauuuuuucuuuuauucaaccuugaagaaucugaucaaugugugucuuggggaugguugucuuacauaguaucucacaggguuucucugcauuuccugaauuugaaugucgaccucucuagugauguuggaaacauuuucaugaaugauauccucaaauauauuuuccagguuucuugcuuucucucccucucuuucagagaugccaaugggucauagauuuggucucccauauuucuugaagguuuuguucauuuuuuuaauucuuuuuucuuuauuuuuguuugaauuaguuaauucagaguaccaguauuugagcucugagagucuuuccucagugugaucuauuugugcuauuaauacuugaaauuguaucauaaaacuucuguagugaguuuuucaccucuaucagaugauugugacuccuucuuaaaauggccauuuccucucuuucagcuccuguauuauuuuauuguauuucuuagauuccuuggacuagguuuugacuuucuccugaaucuugaugauuuuugcuccuauucauauucugaauucuaugucugucauuucagccauuucagccugguuaacaaccauugcuagagaacuaguguggucauucugaauacaaagacaaucuggcuuuucaaguugccagaguucuugcacugauuuucuuaucuaggcaggcugauguucccuuaaucuuugaagaagccgucuuuuagaugagguuuuuugcuuuuaucucucugaugcccuugaagguuuguaguauaagguggguucagucaacaggcuuuguuucuggaagacuuuagggggccaaggcucagcucagcacugcugggcugugugcucuaacucuuaugggcguuuaccaugcccccagcuuuguucucugaccccuugcaguuaagaaccugcugugguggaggggccgagguauucuuagacugcuagccacaacgcuacaauggagaguguaagcccaagugcuucaucagagcaauggcagagaucugugcucacucauucaugccagcagugcaguggggaugcacacacaugauggggucagugggaguggaguggcgguauucguaugcaugcucacauuggugaccguagcgguggggcaggggcaaggcauuggcagagaugggguugucagaguccaugugcacauccacgccagcagcagugcagcaggaugcccaagcaucaggaggagcaggauagcauagugugcucacacuggcagcaguggggcagcgggguacacacacgcaugccagcaugggaugggaggcaaggucuacucacacaugcaccaguaaagcaaugugugugugucaaggggggaggggagguagugguccaugccugaguaagugccagcaaagcagcaguggggaggcuguagugggugagguuguagguggguuggugugugucaacaagagcuggucugcuggagcucuccaguagucaugcacagacugccagugaaggagcuaugaugagaucccugaggaagcaccuugguugggcuugccaggcugcacugcaaguguguggccaggcuggagccccaggagaggccaccagacagaggggcacucagauuggacuggacccaucacaugggaaagaccacccugcucuauccaggucuaacaguugcccaaaagcuaaagccuccuggaggagcauggcaagccuugguguauggguaucccuggccaugcuccacuucagccauucccaugccaaaccuucugcuccuacaaccuaucuaggcagcucucccugccagcucaagugucuguggggauugugggguguccugcugcuaggauucucaaaguccauggcaagagcuggucacuccuucccuguucaacucaccccuuccuuaggaguugcuggggaccaguaaugaaucuuggugcuccgaaacccugcgcaccguucccagcuuccucccgcuucagcccagcaacugaauccucucuccauccacucucaaugccuucucucugaagaucugcuuagaguguaccagucuucccaauguucuuguuucucagugaaagauguuccuccuaguugcaucuaguuggccauuuuggcucagaucagaaauugccauuuuaaaaaucagaucuucauugagacuucuaucaagucaggcucaaaggcuuagauuuuuaaaucaguguugauuuugcacaauauuuuagaagcuucuuucugcacauuaaaucaauguuuaugucaaauacuuguucuagaccuccccacaucucucaaucagugaugaccauuaguuuucacauaaauucaaguauuuauguacuugacaaauuaacaaauaauuuguuaagaugaucacauagaauuaauauuacucguuccaguugcaugguggggaaaagaaagcagaaucaauauuuucugaaaaccuauuuuguugcaggcauuauauuaacuugaugauuuauagcuauauccuuguauaacccucacauaauucaaugagguagguuuuauuuucccuguucucagaaaaagaaacagguucagcaaaauuagguaaccuguacaaauaacauaguuaauaacaaaagucagauauuucugcaauacucuagugccuaacaucccuggaaacaaagagaaaaaucucuguggauggugaagauaaguauugcugcuuaaguuuugauauaaaaaucauauagaggaugcuuacaugcaacagauaauauccaaaaaaugcauaagaaaaaaauuuccuccugagaggauuuaaaucuaaucuuugaauuaaaaguaagaccuaaaauaauuguagaagacaacauacaaugaggccucggucaaguguuucaguacuucagaaaaugaagaauuuuacgugauauagaaauauuuacuugaagcaaacauuuuauaaaacaguaugaagcauucaguaauacagcugagguacaccugggguacuaauuugguuauuucuaggcuagaaagugguuucauguuuaauucacugcuuucugaagaggaauugaucucuaauugacuguaaaguuauggugaguucuaguugcuuauuuucuuuguuccuguaauauuaauuucuuauaaucuccaagcaaaauauaacauuaucuaauguucacuugagugucugaauaccacacguuaccucaauagauauguuguuuuuuuucacauagcccaacacauuuuucuucaaaguacaauacaguuuucuaugauuuuuuuuaagaaaaaaaaaauccaaauucaguugcagauccucuaaaaccuuauccguauccauuucuuucucuuguucccuagcugugaucuuuaaaauaaaguugauaugcaggcauaccuuggagauugugauuuugauccauaucaaugaagcuaauaucacaauaaaauaagucacacaacuuuuuucauuucacccgggcauauaaacauuauacuuacacuauacuauauucuacuuagugugcaauagcauuauaucuauaaaagcaauguacauaccuuaauuuaaaaacauucuauugcuaacaugcuaacaaucaucugagccuucaauuaguuauaaucuuuuugcugguggagggucuugccucaguauugauggcugcugacuauucuggguggugguugcugaagauugggguugcaauggcaauuucuuucuuuuuucuuuuuuuuuuuuuuuuuuuuuuuugagacggagucucacacucuccuucaggcuguaguacaguggugccaucucaacucacugcaagcuccgccuccuggguucacgccauucuccugccucagccuccugaguagcugggacuacaggcgccugccaccaugcccagcuaauuuuuuguauuuuuaguagagacggguuuucaccguguuagccaggauggucucaaucuccugaccuugugauccacccgccucggccucccaaagugcuaggauuacagguguaagccagugcgcccggccggcaauuucuuaaaauaagacaacaaugaacuuugccacauuaauugaaucuuucuuucaugaacaauucuucuauagcaugugaugcuguuugacagcauuuuacccagagcagaacuucuuucaaaaucggagucaauccucucaaacccugccacuacuuuaucaacuaaguuucuguaauauuuuaaauccuuuguugucauuucaacaacauucacaggauugcugagggauuguucacaggauugaugaggccucauuguauguugucuuuucuucuacaauuauuuuaguucuuacuuuuaauucaaagauuagauuuaaauccucucgggaggaaauuuuuuucuuaugcauuuuuuggauauuaucuguugcauguaagcauccucuauaugauuuuuauaucaaaacuuaagcagcaacguuccucaggaguugauuuugucucaagaaaccacuuuuuuuuuugcucauccacgagaaacaauuccucaucuguucaaguuuuaucaugauauugcagccaaucagucccaucuacaggcuccauuucuaauucacucacuauuucuaccacaucuucaguuccuucuuccacugaagucuugaaccucucaaugucauccaugaggguuggaauuaacuuggucuaaacuccuguuaauguuaauguugauauguugaccuccucccaugaaucacaaauguucuuaauagcaaguagaaugguaaauccuuucuagaagguuuucaauuuaccuuucccagauccaucaaaggaaucauuaucuauggcagcuauagucuuacauuauauauuucauaaaaaagacuuaacagucuaaguuaauccuugauccacgggcuugcagaauagaugcuguguucgcacacauaaaaacaacacuaauauccuuguacauuuccaucagcaaucuugggugacuaagugcauugucaaugaguaguaauaccuugaaauaaaucuuuugagcaguaguucuuaacagugagcuuaaaauacucaguaaacuaugccauaaacugaugugcuuucauccacccaggcuugauuguuccauuuuuagaguacaagcaaaaucaauuuugcauaguucuuaagggcccuaugauuuucagaauggucuaugagcauuggcuucaacuuagaaucaccagcugcauucaccccugacaaaagagucagccuguccuuuguagauuugaagccaggcauuaacuucacaccucucuagcuaugaaaguccuacauggcaucuuuuuccaauacaagacuguuuaaucuacauugaaaaucuguuguuaauguggccacguuacuaaucugcucucaugcugcuacaaagaacugccugaggcugaguaauuuauaaaggaaagagguuuaauugacuuacaguuccacauggcuggagagaccucaggaaacuuacaaucaugguggaaggggaagcaaauauguccuucuucacaugguggcaggagagugaagugcugagcaaagugggaaaagccucuuauaaaaccaucagaucuugugaaaacucacucacuaucaugagaagaguagcauggagguaacugcucucaugauucaauuacuucccaugaggucccucccucaauacguggguauuacaauuuggauuacaauucaagaugagauuuggguggggacacagagccagaccauaucagccaccuuuaucaauuaccuuagcuagaucuucucaauaacuuucugcagcuucuccaucaauacuugcugcuucuccuuacaguuuuguacuauggagacaguuuuuuucuuuuaaccucaugaaccaaccugcuaguuucaaacuuuucuuccgaagcuucuucaccuuucucagccuucauaaaauugaagagaguuaagccuuguucuuuauuagcuuuuggcuuaagagaauauuguggcugauuuggucuucuaaccaggagaccaaaacuuuauucacaucagcaguaagguuuuuugccuugcuuaucuuuuguguguucacuguaauagcacuuuuaauuuucuucaagaacuuuuccuuugcguuuacaauuuggauaacuguuuggcauaagaugccuagcuuuggccuauuuuggcuuucaauaugccuuccucacuaagcugaauuauuucuagcuuugauuuuaaagugggagauguggaacucuuccucucacuugaacacuuaagagcccauugcagggcuauuaauuggcuuaauuucuauauuguugugucucagggaguagggaggccugaggagaggaagagaaauaggggaauagcuagucgguggagcagucagaaaacacacaacacuuacuaaguuaacuauccuauaaugggcacaguugugucaccccaaaacaauuacaauaguaguaucuaagcucauugaucacagauaaccauaacagauauaauaaaaugaaaaaguuugaaauaggaugaaaauuaacaaaauggaacacagagcaaaugcuguuggaaauaugucaccaauagauuuaaucaaugcagcauugccacaaaccuucaauuuguaaaaagacugucauuaccuaugaagugcaauaagguaaauaaagugcaauaaaaugagguaugccuggauaucuuucccacccacuuuaaaacauuuuuacuguguauuuucucauagacaauauauuguacuauugcaugcacuuuaaaauuacauuaauagccaaauaauguacuuacccucugccacuuuugucagucaagaucauguuugcaagauuucuagauauaguuaaugauauguuuucuacauuuuauaguuuucuagauauggauauuucaucacuuauucacucgguucucuagagaugaaaauuuggauuguacuuguuuuguuuuggucuugcaccauuacaaacaggauugcaaucaaaacuucuauguacauugaaugaaaacuucucuagaguucauaccuacaugugaaauuguugagcucacagaaauuugccaaaagguucauacaaaaauauuuacuacagcacuguuuacaaagcuaaaaacuggauacacugaaauuauaccaaccaauagcagaacagguauauaauuuuuaauauauuuaugcaaugcaauuaaagagaauuguauagacgcauacgugcugauacagaaagacgcccaaaauugauugcucagugaaaaaaaaauuaaguuauaauacucuauauaaaauuaucccauuuuuuauaaaaauaaaugauaaaauuaauaauauauguacauauuuagagaaaaaauagagaccaauuuaagaaauucauguuaauaacuauguaugauauauaagauaaacuuguauuuucucuauuuuaaauuucaauaguaccagauacacauuacuucaaucuacacuuauaaccugaaugaauacauaauuucuucuuauccuaauaaugacacauuuugcuuuucugaccacuaacaucccuuacaagacuaacuuuuuccauuaauuccuaaccaauuucuguuuuuagcacaaacaauaauagucuguacuuacuuacacuacugcaaucuccuuguugcuauaucuugaaauuuuucaaacuugaaauuaauuacauucauuaccacugcuuuuaccaggaacccuucugacucuauaauauucucucucagaccugaauaaauaucauauuauuauaacaaccuucuaggucaauuaugggauuucaaguuaaaaauauauaacuguaaaauuuaaagaaggugugcagugagaaggaagaguuguucauucuggaaaaauauauuuggauacccaaucaaguuuccuuagaaugucauuuacuugaaaaaauuaaccauuauccauaaaugauacucuuauucuuaaagaauuacaaaaauuaaucccuguauuauuucuaaauugaucagaauuauggguucuaauucagucuaauaaaggucacaaauaauuauaaauauuuaguaagcuguuauucauugggcacuaugugcaagaaauagaggacauagugguaaauaauauagaugagcuccaagucuaaaauggcaucaacuaaauuagguggggaugaggcucuucauugcaauccauuaagugcagcuccuggggcacaaauccuuccauauauggacccaugaaaugaaagagacaagccauccuucuucaaaccccccaaccuauaaugguaggauaggcacagcacaacagcuauagacaucacaguucuaaugggggaaaaugaaaaguaaaaaggagucacaggggucacuguuucaaaggaguucugaaauccagggaguaaaugggaguuucuugauuagguuucaagggcagagaauaauccuccuuggcucucagcuccauucucugaaggcuccauccuucuugguucugcccucugagucauccuuccuuuuucaugaaagguaacacauguuuguagcuuagugguuuuaucagacugcuuccugcugguagaauuuuggggacuuaaccaucuccuuuccuuuuguaguauugucucugaccuuuuuagaugaagcuggcaguguuucugcuucaauaaauuucucaagaacuuugugggucuuccauggauuucacagggauucacaccauaaaagaaaagccacauccacagauguuuuuaagauugucccuuuucuauaucuuggcuuccugcugagagggcuagaggacaaugcccuucagccuccuagaggcccucagguuugugugaaaaaaucagugaggcacacccuuaaucucuugaaaagagccuuuguacugaauacgcugacauuuugaucuuucugauauuuuuagcaaaagucacacacucucaaugccauacuuuugaguauggcuauuucucaaugccauacuuuuggcagccauuucugaauuuuagcaucuuuugccaucuggagaggcugcgaauuuucagucacguaauccuaauccauuuucuuuaacaugucuuccuucaacuuaucucucuuuugcauucuauuacaagcaguaagagaaaaccaguagcaacuucaauacuuugcuugaaaucuccuuagcacuacauacaagcaaguucauugcccacaaguucuucuuuccauaagauggcagaaugcacaauuuugcuaauaguucugcaaguauauaaaaaggaucccucuccuucuaauuuccaauaacaugcuccucacuucugagccuaacagcagugcucucaaaguucagauuucuacuaagggucuguucauggcaacucaggcugcuaugguuugaauguguccccuaaauuucauguguuagaaacuuaauccuuaaauucauguguugauuagagguggggucuugggggcuaauuaggguuagauaaugucaucaggguacaguccccaugauggaacuaacggcuuuauaagaagaggaagagagagagcucugagcugacaugcacacucuugcucucuugccuugugaugccuucugucauggaaugagccucacuagaugacggcaccaugcucuuggacuucccagccuccauaaccaugaacuaaauaaacaucuauugcuuauaauuuucucugucugugguauucuguuacagcaacagaaaauggacuaagacauaggcuuccucuaucauguucugcaaacauuuccuagccuuugucuacugucuaaucccaaagcugcucccauauuuuagguaugccucuugguaccaaaauaugcauaacaucuugguggcuuaaaacaacacucagucaguuucuccugcuuuucaucagucaggagucugggccuggcucagucuuaugcucaaagccuccaaagcugcacugaagguauuggcuggacuaugguucuaugauucugaucuagagcuugggguucucucucagguuuacucaggucauuggaagaauucaguuccuugcagcuguaggacucaggccgucaguuuauauaagcugccucucuccauaggcaguuuacaaaaugauucuuugcuuucuucuagcccagcaggagaccaucucucuuuaaagggcuuaccuaauuaggucaagcccauccaguaaaaucuacccucaauaaccuuaaauccaacugacugggggccuuaguuacaugcaaaaagccuuuuauaugcuuauaucccucugagucaggaaaaaacuaccagaguucucacucccccaucaagagccccccgacacacacacauacaaacacauaccuaauuauagauaauauuuuuuucuaaaauacauccauaugguugugugauuuucuccaguggugcugaacaaccuugguucagaaguaaagaaucuugacacuagaacuaauccaagaaaaguggguaagaaaaggucccuaaaagguucucaacaugaagcagcaggagaaauucagaagaggaagagagaucuccaucagccacuuggaguagauaaagguaucaggaccaagauaugcuaaagggggcagauaaucauccugucacagaacagaaaucucaauuagaaggcuuuccuaaaaaaauuucaaaagaccauaacugcucuuaccacacuuuacguaaccaagaagugguaaucagauaaaucuccuaggaaagagcuuaucaacucaauugagacuacauuuauauggagagggacagaggcagccaggcacaugagucagcuccccugcccccagcaccaccuuccacugugagguuuucagacuugacaacaaggacaauuuauuauuucacauugaccaaaauccagugguuaaaugagauuacaguccuguuguauuaguuucuuauugcugcuguaacaaauuuucauaauuuauuggcuucaaacacucacaauauuuuacuauucucuaagucagaacuaugaaaaucaagguggacuaaaagugucagcagggaugcauuccuucuaggggcucuaggagaaucuguuuucuugccuuuuccagcuucuagaggagacuugcauuccuugggcucauggccucuuccucuaccuucaaaagccagcagcauaucauuuucaaaucucucuccuacucugagauuuccaccuucaucuuauuaggacacuugugauuauacucagccuaccuugauuacccaagauaaucuuuccaucuuaaaauccuuggcuuacucacaccugcaaaaucucuuuuuuacagaagguaacauuuuacaaacuuucaggcauuaagaugugggcaucuuucaggggucucauuuugguuaucacaacuuccaaauaccuuucuaauauucaaacucaaucauuucauuugggcugaugauaaaaaugcucuguaauguuuuaaugaguuugcuuauaaaguuuaucugaaauauauuucuauaaauucuuauauucucugacaaaaucaacagagguguuagauugaacaaauuugauuagcuaauagaaauuguuaaguaacaucauguucuuaaggaguugcuucaaagcauucacaaagcaccuaauuuauccuugcaauugucaaauaaguaaaaguagguaucauaaaagaaaauuucaaguaaggaaaugaaagcacacaguggcuuuccuagaucucccagggagaaauucuggaagaaauaugaauagaacucagcuucucuuacucccauucaguagcuuaaaaggcuaggaauaauaguuacaaugauucauacugauuaccuagugccucuucuccaaaguacugcaaauccacaagagaaaucaucacagacacggugauaugucuuugguuaguuuuucuaccuccugguuucaacaaagcuuuaaagaaguauagagaacauggaacaaucugugagaaacuacuccaccucgagugguuccacuugaaauguaaauagguuuggaaggucuuaaguaaacaugacuugaaauuuaaaaaacauauauuguuaaccugacuggaagguaaaaacaaauuuagaagaauaauggaugugcugucuggaggcuauaauuacuggugcucuaacacagcaguguagcgagaggcugggaacugcuucaugaaaagugcuggggaacuggacagaaauugguuggaaucucaauucuucugcuuauacuagcuguauaaccuuggacaagcuaccuaaacucucagauuccucaucuuaaaaauaauaauagcugucuuauagaguugauauaaaaauuaaagguacuacauguaaaauacccggcacauaaaagcacuuaauaucuuuccuacuugggaaaaaacuaaaauguaggaacagacuuuccuguuaagaauguuuguaguggaugcucuguugugcugcccagauucugcuucagagaggaagaguuuauucuccaagcggcuggaagagcugcuaauggaaagcucuuuguugucagccccuacagggaucgccuuaguugaagagagccuuuucacccaauguccaccccauuaagaaugacuugccuccagugacugaucaaagagcccaucaucccagaucagaacuugccauggaauuggcagaggccucuguugagccagccugccaguucagcuucucccucgguccaauccugcuuccuuccuaugacuucccuucuagagguguugaucucaaugcccucccuaauaagcccuccgauauccuagucacgguugggagucaguuuaccagggaacacuauccagcaacaauguugcaggaugaacuguugcucagacuuuuauauagcccuuaccaucaccaaccacuccccacaagggcccaaaggcacauaacucacccaaguaucuuuugguugcucugguaaggauugaagaguaaggauucuuaagccuugaaccuugcuucugcugauguuuaacaagcagcuggaauaagugugaacccucugccccagcuccauuucaccccuucucaacaucuuucaucugccagcuuguauaaagauucagccugccacauuagaaauguugcuuaugucacaauugaggaaauuuuaauaugagcuguauagcaaaugauauuaauaauuauuaauauuguuguucuugagcuuuauaauacuccagauaaaaaaaaaaaaugaaggcggauaggccgggcacaguggcucacgccuguaaucccagcacuuugggaggccgaggcaggcagaucacgaggucaggagaucaagaccauccugguuaacacggugaaaccccgucucuacuaaaaauacaaaaaauuagcugggcaugguggcgggugccuguagucccagcuacucaggaggcugaggcaggaaaauggcgugaacccaggaggcgggguuugcagugagcuaagauuggccacugcacuccagccugagcgacggagcgagacuucgucucaaaaaaaaaaaaaaaggcagauaaaugaaacaagauuggcaaaaugaugaacauugaugaagcugggugacugguauuauacuauucucccuaucucuguauguuugaacuuuuccauaauaaaauaaugaauauuaauauacuuuauaaaaguauauacaauguacguacuuuagagaucaauuguuaaagauagguuuaauaauauauuuaacuucaaguuggcuuauguuaagcaaauaaaucaaaauauagaaaauucauauucuccaaagcaaauaaaauggggcuuguuaggcaucuugccaaauaguuccgaaauuuauuuuuuuuaagugcugagacuuucuuuaaaagaaaacuccauaaggcacuucaaacuaaauuuuuauguuaaaagauuuauuuuacauauuaaaguacagcauacagguauuuuguucauuauacagacuuuuagauuaugaagacuuuauauguaauagcauauuaucccaauuuuuaaaagcucaauuuucuagaugucuuuuuugauaacaaugcaugugauuuaccauaacauguguauaaaaucuagccaaaccacaccauucuuccuccacaacccuuaaagaagauccuauagacucaacaacugugccaccuaaggcuauguaaacuuuggucaaacaacucuguuguauacacaaauauagcuauaucuacagguauagauagagagauauaauauauauuauuuauacauaaugauuaagaauuaagaauuaggucaaaaaucacaacaagaaaaaaaaaaguaguaucugauucagguauucagucuguguagagugguacuauuuuugccaauccucaaauguuuacuucaagucugcuaugaugagaaaacccagaaggccuaaauauauaacacaaacauguuucccaucuuuguauccuucuauguuugaagaucuuuccgaauguuaaggucucauccauuuaaggugauuugauccagaacauuggggaauacuauuauucagaaaaugauucuucuuaaagggacuugauuauuucaaugaucauagagcugcucuaagggauuucuauagccaagucauuauuauauccagguacuuuucauauaaauaaggguucaagcaucugaaacaaaaaagaaggaaaugaaguguucuaaggacaaagacaaauggugugaguuaggagcuggucuaacagcauauaaagccugaauuuuccaaaguauuuuaccugacucucuggacuaccccccaaauaaacaaacaaacaaaccaauaaaauccaaauauguauaaaacauaugcauguugagccuaguccuauaggaaacaugacagguuugagaagaauuugaugcaaaauaaaaugggaugagaugugauaacgaucaggaaaauuaggaucuaguacuagaugugcacuaacuaagcucuaugacccugggcacuucacaucuuggcucucaguuugucucucuguaagauggaggucccuuacagcuauuauauuccaagauuaagaaucaaguaugauacuuucaauauuaauaaguaaccauaaaaauuuuaagcaauuggauuaauaccaucuugaauugaaauaaaacaauaaaaaauuuaaaauuuuuuucuaaaaguugaaaauaaauguuuuuuauuauaugaguuuagguuuccaaauauguuuuucucccauacuacauuuuccuauagcuuugugaaauaauaugagauuaaucuuaugccaggcaguccagugggugcucugcaaacuuggcucuagaggaacuugauaauucagauauaagccaugcaauuuuauauuucaaaucaaaacuaucuaauguauaauuaaguuaaaauucaacaguuacagucuagaauagccaucaauucaguuuuaaacacaguguauaaaauuuuaaguccugcauuuuagguacuugugggcuauucagcagggaaacuacuuuaggcuagugagauaaauauaaaauuucauguuguaauauaauuuugaggcagcauuaaauggguaaaauucagguaguaagccuaaaaauccaagauaacuauagagauaaauaauuauuuuuguaaauuauaauaauucccauaucugugauaauaauagcaacuacagauuuguauaaggcuuuaauuuauacaaauaaaucuguuucaauuauuacaaauguaauacaagauacauauaauauguaucguguuuacauucuuacgguauauuuugaauguguuacaucauuuaaguaauaacauaauuuaggcauuauuaucuuuauucauuauuaucaucuccauuuuauggauauggaaauugaucaaauaaaacuuuaaagagcaaacaggcugccugaacuggauggagagaucauggugcuaaccacaucaagguuaguuguuaaguuucucauccuaguggagucucagucagauaaucauaauagaaauggaaaauguauuuaggccacaaacagauuuucagcaucuauugauuuacuaauauagcuuuuuguuccuuaauuuauugaugcagugaauuacuuugauugaguugcugcuguuuaaccaccuuucuauuccuggaguagauucuacuagguuauagauauuauccacuuauuaaauugcuguacucucuuauaaaaauaucuagacauacauugacauaugagaugauugauuuuuuuaaaaaauugguauuaucuuaauuggauuuagggaucagcauuauauuagcuucaaaaaaugaauguuuuaucuuuuucuauugccaggaauaauuuagaauuuauagugauacucacacaccaugaucacuuucuuuucucucuuuauuguauguaucugaaaaauccuaaccauggcuaaaucuaauucccugccuauucagagcagcuuaacaugguugggggaaaauuaaguuuccuacucuuuaugaugacuauuucagaccuucuuucuucuccagcacacaaugccccacaucacucucaaucaauaaucauuauuauuucacugaaaaaauaaaauagaaaaaaaauccucacucuuccagcaguaaaucagaaaaucuacuuguaucaggauguauauacucucauuucacuccuuggcaauaaaugaacuguccauguuccucuagugaagucaauacguccaccuauucacugggucuaaacuuugccuuaucaggacuucgcuacucaaaaaaaaaauuuuuuuuaauuucucuuuuuuaucauuuuuuucacuugcuacuuguaagagauauuccagucugccuuucagauuucuccucaagauagucacuaauuucccccaaaugccagaaguguugccuacagagguuuacaggaauugccuugaccaacaugacaccacacauccaguguuuugucaguggguuuauucaauuccauggccucaguugaguuuucucuuaagggucaucucaguuucagagguacauaaagaauccaaugaaaucucuguuacaguuacaucacaguucaacuucuuuuguuccaccuuauuccuuucacuccuuuacuguauuguucccgagagcacuucccaauaaaucaccuacacguaaaucuuaguuguagagucuuuuuuuucugggaaaccuaagcuacaaaaguuguugccagggaauuggauaaaaucuucaauaguaagacauucaguagagaggauaaauuaguccuacacaacaggcugcuauggaaucaucuuagcaaagcuaaaaagccauuguuauacagauaccaaaaucagacagacuuuaaugaaaacaacaggccaauaucuuucaugaauauauacacaaaaauccuaaacaaauauuagcaaauaaagcucagcaauaugaaaggaggauaaugcauuaugaccaagugagguuuaucccugggaaugcaagguugaguuaacauuugaaaucaaucaaugaaguuccucguauuaaaaaaaaaagaaacccuauaaucaucuucauagauguggaaaaggcauuugacaaaauuuaauauauauucaugaugaaaaacucucagcaucugaggaaaagggaaacuuucucaaccugauaaagggcaucuauggaaaccuuacaauuaacaggacaaugaugaaaagcugaauguuuuccuccuaagauugagaaaaagcaagaaugccuacuuucaaaauuccauuuaccaucgugccagagguucuagccaguacagugaggcaaacuaaacagauaagaaguauacacaucagaaagaaagcaauaaaauuaucuuuauugacagacauuauuaucaccuacauacgaaauacuacagaacuuuaaaagcuacuaaaacuaauaagugauuauaccaaauuugcaacauacaaggucaauauauaucaguaaaccauuggacagauccuccaaagucuuaaaggcagccagagagaagaggcaugucaaaugcaagggaacuccaucaggcuaacaguggucauuuuagcagaaaccuuacaagucagagagguuggggaccuauagucagcauccuuaaagaaaagcaauuccaaccaagaauuucguauccauacaaacuaaacuucauacgugaaggagaaauaugauccuuuccagacaagcaaaugauaagggaauucuuaccaccacgccugccuuacaaaauguccuuaagggagugcuaaacauggacaugaaaaagcaguacuguauuagucuguuuucacacugcuaauaaagacauacccaagacuggguaauuuauaaaggaaagagguuuaauugacucauggauccacauggcuggggaggccucacaauuaugguggaagaacaagggaugucuuauauggcagcaggcaagagaaaauaagagccaagugaaaggggaaaccccuuaucaaaucaucagaucucgugagacuuauucacuaccacgagaacaguauggggaaaaacacccccaugauucaguuaucucccacugggucccucccacaacacaugggaauuaugggagcuacaguucaagaugagauuuggguggggacacccaaaccauaucaaguacuuuccaccaaaaaaauacacucaaguacaaggccacugaaacuauaaagcaacuauauaauaaagucuacauaacaaccagguaaaaacacaaugacaggaucaaacacacacacaucaauacuaaccuugaaugcaaacaggcuaaaugccccaauucaaaggcacacagugacaaguuggguaaauaaguaagacccagcuauguguuguuaagagacccaucucacaugcaaugacaccgauaggcucaaaauaaagggacggagaaauaucuaucaagcaaacagaaaacacaaaagggcagagguugcuauucuuauuugagacaaaacagauuuuaaaccaacaaugaucaaaagggacaaagaauggcauuacauaaugagaaaggguucaauucaacaagaauacuuaacuguccuagauauauaggcacccaacaccagagaacccagacuuauaaaacaaauuauuacagaccuacaaugauacuuagauaaccacacaauaauaguggaagacuucaacaccccacuagaucauugagacaaaaaauuaacaagauauucaggaccucaacucaacacuugaccaaauggaccuaacagacaucucuagaauacuucacccaacaacacaagaauauacauucuucucaucuacacagcacauacucuaagaucaaacacacacuuggcuguaaagcaauucucagcaaauucaaagaaaccaaaaucauaccaaucacacucuuggaccacagcacaguaaaaauagaaaucaauaacaagaagaucucucaagaccacacaauuacauggaaauuaaacaagcugcuucugaaugacuuuugaguaaaagacaaaauuaaggcagaaauuuaaaaauucuuugaaacuaaugaaaacaaagauacagcaugccagaaucucugagacacagcuaaaguaguuuuaagaggacagguuuuucuuuuuuucaaguuuuauuuuagauuuaguggauacaugugugugcuuguuaccuagguauauugggugaugcugagguuuggaguauaaaugaucccaccauccagguacugagcauaguacccaauacuuaguuuuucaacucucacuccccucacuaucucuuccaucuaguagacccuagugucuacuguugacauaagaugaaaguuuauagcacuagaaaccuacauuaagaaguuaaaaaugucucaaauuaacaaccaaacauugcaccuagaggaacuaaaaaaauaaaaguaauacaugcaggaauuuuguagaggggaguuuaaaaaagcagcagaaaauaauuacccugaaucucaagaccuagaaauacugauauuguuuugauauauuuccauccagucuuucucugaguuuuuuuuacccaguuaagauuauacuguguacaugcaauuuucuguccugcuauuucacuuaacaaaugucuuaaacauuucuccuugucauuaaaaacucucuguucacaucaaauaaauaaauaaauaaauaaauaaauaaauaaauaaauaaaagcaaaccaaccccgaugcuagcagaagaaaaaaaauaaacaacaugacagcugaacuaaacaaaacugagauguaaaaauccauacuaaagaucaacaagaccaaaacuuuguugaaaaaauaaauaagaucaauagacugcuggauagauuaauuaaaaaagagagagaagauccaaauaaaaacaaucagaaaugacaaaagggauauuaccaccagccccacauaaauacaaaaaaacccucagagacaauuauaaacacuucuaugcacagaaacuagaagaaauguauaaauuccuggaaacauacaaccucccaagacugaaccaggaggaaacugaaacacugaacacaucuauaaggaguuccaaaacugaaucuguaauaauaaaaauaauaaacccuaccaacagaaaaagcccuggaccagauggauccaccgcugaauucuacugcauguauaaaaagcuggaaaccauuacuauuaaaauuauucaaaaagaauuaaggaggagggacuccuuccuaucucauccuauaaggccagcaccauuuugaaaccaaaaccugacagagacgcaagagaaaacuacaggccaauaucucugaugaacauagauguaaaagucccaaacuaaauauuagcaaaccaaauccagcugugaucaaaaaguuaauucaccccaaucaaguaggcuucauuccugggaugcaagguuaguucaauaugcacaaaucaauaaaugugauucaccacaaacagaaguaaaaauaaaaccauaugauuuugucaauagacauggaaaaagucuuugauaaaauccaacaucccuucaugauaaaaacccucaacaaauuagauaucaaaugaacauaccucaaaacaacaagagucaucuaugacaaacccacagccaacaucaugucaaaugggcaaaagcuggaagcauuccccaugagaaaugacugcacacccacuaaccacuccuauuuauaacagcacuaaagguccuagccagagcaaucaggcaagagaaagaaauaaaagacauccaaauaaaaggagaggaagucaaacuauuugucuuugcagauuaugauucuacacuuagaaaaccccacagucucugcccaaaagcuccuagaauaaacaacuucagcaaaguuucagaauacaaaauuuauuacaaaaaugaauagcauuucuauacaccaauaauccaagcugagagacaaaucaagaaugcaaucccaaucacaacagccacaaaaagaauaaaaugccuaggaauacagguaaccagggaggugaaagaucacuacaauuagaauuacaaacacugcugaaagaaaugagagacaacauaaacauauggaaaaacauuccaugcucauggauaggaagaaucaauaucauuaaaauggccaugcugcccauagcaauuuacagauucagugauauuccugugaaacuaccaacaucauuuuucacaaaauuagaaaaaaaugauucuaagauuuaucuggaaccaaaaaugaagucaaauagccaaaacaauccuaaacaaaaagaacaaugccagugacauacauuaccugacuuuaaacuauacuacaagucuagaguaaccaaaacagcaugguacugguucaaaaacauauacacagaccaacggaacagauuaaaaaacccagaaauaaagcugcacaccuaaaaccaacugaucuucaaaaaaguugacaauaacaagcaauggggaaaggacacccuauucuauaaauugugcuggaauagcugacuacccauaugcagaagauugaaacuggaucccuuccuuucacuauauacaaaagucaacucgaguuggauuaaacacuuaaauauaagacuuaaaauguuuaaaacuuuagaagaaaaccugggacguaucauuuuggacauaggucugggcaaagacuucacgaugaagucuccaaaagcaauggaaacaaaaacaaucaaagauaagugggaucuaauuaaacuaaagagcuucuacacagccaaagacacuauucaacagaguacacagacaaucuacagaaugggagaaaauauuugcaaacuaugcauccaucaaaggccuaauagcuagaaucuauaagaaacauaacaaaaucaacaacaaaaacaaauaaccccauuaaaaaguggguaaaggacaugaacagacacuuccaaaaaggagacauacauguagccaacaaucacaugaaagaaugcuuagcaacacuaaucaucagagaaaugcaaaucaaaaccacacugaaauacaaccucauaucagucagaaugacuauuauuaaaaaggcaaaaaaugacagaugcuugcaaaguuacagagaaaagggaaugcucauacuuuauugguuggcauguaaauuaguccacccauagcagaaagcagucuggaaauuucucaaagaauuuaagucagaacuaccauucaauccagcaauccuauuacuggauauauacugaaaggaaaauaaaucguuccaccaaaaaaaaauguacacucauauguucauugcagcacuauucacaacagcaaagacaugaaaucaaccuaaaugcccaucaauggaggacuggauaaagaaaaugugguauacacaccauugaauacuaugcagccauaaaaaggaaugaaauuauguccuuugcaucaacauggaugcagcuagaaaccauuauucuaagcaaauuaacauaggaacagaaaaccaaauaccacauauugucacuuauaagugacagcuaaacacugaguacacauagacacaaagcagggaacaaacacuggggccuacuugaggguagaggguuggaggacugugaggguugaaaaauuaccuaccagguacuaugcucacuaccugggugacaaaaucauuuguacaccaaacaccagcaacacacaauuuacccauguaacaaaccugcacaugcaccccugaaccuaaaaguugaaagagaaaaaaaauuaaaaauuaaaauuaauaaaaucauuuauaauauguucaaaaauaugaccuauuagggauaaauauaaugacagaacauugcucaaagaaauuugaaacuggagaacauuauguuaugugaaauaagccaggcauagaaagacaaauauugcauguauuuacucauauguuggagcuaauaaaaaugaucucauagggguagaaugguggcuaccagagguugggaaggguagcgaagcgggggauggugaagagaaauugguuaauggguaaaaaaauaugguuagaccuaaggaauaaguucuauuguucaauagcacaguaggaucacuauaguuaaugauaauuuauuguauauuucaaaauagcuagaagauuuaaaauguucccaauacauagaaaugaucaauauuugagguaaugaauaucccaguuaacuggauuugauaauuaccugguguuugcauguaccaaugugccacauguaccccacaaauauguacaaucauuaugugccaauuuaaauaaaaaucaaguccuaaauuaagguagcuaugcaugauguucauggauagaaaauucauuauuuauaagaugccaauucuuuccaaauugaccuauauauucagugcaaucacaguaaauaccccaggauuucuauaauuucuauauauuauagaaauugaugggcugauucuaagauaaauaaggaaacgcaaaguaccuagaacaaccagaacaauuugacaaagaacaauauugggaaauuaacacuauuugauuucaagacuuaauacaaaaguagagugaucaaaacugcauggguuuugacauaagaauaggcacagagaucaguggaauaaaauaagaguguccagaaauaaacucaccagaugugaccauuugauuuucuacagugacaccaagguaauuaaauaggaaaauaaugaaauuuucaacaaauggcacagaaacauuuggauauccaaauacaaaggaaaugaaccucaaaccuuacaccauauauaaaaaaguaacuuaaaauguaaaauagacuuaaauguaggcccuaaacuaaaauuucuaaagaaaaauauaggguaaaaucuuuguaacuuuggcuuggguacagaugucucugaauacuuaaagcacaaaucauaaaauaaaagacugauaauuugaaaaucaccaaaauaaaacaucauuucuucaaaacacacuguuaagaaaaugaaaagucggccgggcgcgguggcucacgccuguaaucccagcacuuugggaggccgaggcggguggaucaugaggucaggagaucgagaccauccuggcuaacaaggugaaaccccgucucuacuaaaaauacaaaaaaauuagccgggcgcgguggcgggcgccuguagucccagcuacucgggaggcugaggcaggagaauggcgucaacccgggaagcggagcuugcagugagccgagauugcgccacugcaguccgcaguccagccugggcgacagagcgagacuccgucucaaaaaaaaaaaaaaaaaagaaaaaagaaaaugaaaagucaagccauaaacuuggauuaaacauacaucugauaaaacacuuguaucaaaacacauaaagaauucuuacaacucaauaauaagacuaacugguuuuuguuuaaucauugaaagauauaaagauacuuuauaaaagaauauauaugaauggcaaauaauaagcacaaaaaagaugcuuaacaucauugaucauuagggaaaugcaaauaacauaccagaacauacucuuuagaauggccaauaauaagaauaugaacaauaccaagugauggaaauuauugaaucaaccagaacucucagacauuccugaugggaaugcaaaauggcuuagccauuuuggaaaacaauucagcaguuucuuuuaaacauauauuuaccauaagacuauguaaucccacaucuagguauuuuuuaaaaaaaaaagacagagaugaaaacauuuguccacacaaagacuuguacuugaauguucaaagcaacuuuuuucauaauagccaaaaaacaaucaaauguucaucgacugaucaaucuaaaaacaaacuguucaauauccauaaaaaauaaugcuacucagcaaugaaagggacagacaacuaauauguggaugaaccugaaaacauuaugcuaugugaaugaauucaggacacaaaagaaugcauaguaucugguucuauuaguauguaaaugaagacaacgcaauacuaugugaucugugaaagcaaacagaucaaagauugcuuaagucaagauaaugaggggauugauugcaaagguaaauaagggaauguuuuuaagaugacaggaaugcucuaaaucuuaaggcaaaucuuugacaguuaucaaaccucaucaaauuguauaacuacaauucaugaauuucauuguauguaaaugacaugucaauaaaaaaaaucaaaaguaucagacaccaaaauaaauauucaaaauuuauuuuuggaaaaguguugauggcuauauuuuacaaaauauuucacccucuauuuuccugaaauaccugucccccuuugguguacuuauauuauuugauuuacaugaagcuuuguaggaacaccucuaaaucuagauaugagaaaugcuuauuguaccacuaucuaaaauuguguuuugucacaaaccaagugcuuuaagaucuaaagauggugaaggauacaacacauacagucuacccuggaagacuaugucauugguuuuuuuguugcacauacaguacacucuauugcuuugggaucaccaaaauuaaucacuucaacuaaagguacauguugguuuuucuccauuccaagagaguaacaacacaacugauuauucuuagugugugagcugaguaaugaaaaaccuacagaaacaugaauauaaauggaaguauauaaacugucauuucuuaaaaguaggucuucaggauagaauggggaaggaagaauuacaauaauuaauuguaaacauuuaagauucucagugugcuagguacugugcauaaugcaguggcuauaaauuaaugaaugguacugauuugaaccacauuauaccuauuuuucuuuauauuuccaacaaaugacuaacacuauuuuaugaucaguucuuuuuccacuggaauuacuccauuaauaaaugacuuuuuagaucaaauggcugugaaguaaguuaaaaaauaugaaaaucauauauaagcaaagauaaauucagggugcuucuuuuuuuucaauuaaugccaaauuauuuuucaggauaugcagcauuuuauaaaauuccuaggcaaguuaaagcacagaucaacaaauauuuaugaaacucccauauucuacaacacuauauuccauaugguaggauaagcaacagaaacagugugggauccaaaggacuuuaauuuuaauugaggaacuaaaacacagguacauagauucgcauauauguuauuaaugccauuucuucacagcaauacuggcacaugccugcucccuuaaauuacuuugccuauucaaaauuaccugucaauguuagaguuggccucuugaggcccauuuuucugaaaaaaugaaguguaucauucugcucuuaaacagagacucuagagccccuuuuuccuuuuucacaacaggguucauuuuagaaaauguguagcugccagauaugacaauguaaaaagguaggcagagaaggagauaaacacagaaagaacagaaaggugaauuaggcauuuaacaauuuauucagaaaaaugugccagcaccucaauuuuauaaagucaugggcaaaagcuuaugaaaauugauuuagcaaaacaaagcccagggaaauacaauaaugcauuuccaacuucacauggcuuuuaugugaaauucuucuauauuaaaacauacuauaggccaggcaccauggcucacaucuguaauuccaggacuuugugaagccgaggagggaggacugcuugagcccaggaguuugagaugagccuggucaacauggugaaacuccgucucaaugaaaaauacaaaaauuagugggugugaugcugcaugccuguagucccaacuacugggaggcugaguuaaaggauuguuugagcccaggagaccgaggcugcagcgagcugugacugcaucacuguacuccagccugggugacacagcaagauccuguuuugagagagaaauauauauauauaucuguucucacgcugcuaauuaagauauacccauuuauaaaggaaagaggucuaauugacucacaguuccacagggguguggaggucucacaaucauggcagaaggugaaugaggagcaaagucacaucuuauguggcagcaggcaacagaacaugagcaggggaacugcccuuuauaaaaccaacagaucgcgugagacuuauucacuaucaugagaauggcacaggaaaaaccugcucccaugauucaauuaccuuccacugggucccucccaugacacauggggauuaugggagcuacaauucaagaugagauuugggugaggacucagccaaacuacaucauccaaacuauaucauccccccggccccucccaaaucucauguucucgcauuucaaaacacagucaugccuuuccaacagugccucaauaucuuaacucauuccagcauuaacucaaaaguccacaguccaaagucucaucugagaaaaggcaaguccuuucugccuauaauccuguaaaaucaaaaguaaguuaguuacuuccuagauacaauggagguccaggcauuggguaaauacacccauuccaaaugggagaaauuggccaaaaugaagggacuacgggccccaggcaaguccaaaauccagcagggcaguaaaauuuuaaagcuccaaaaugaucuccuuugacgccaugucucacauccaggguacacugauguaagaggcaggcucccauggccuuggacagcuccgccccugugguuuugcaggguacagccccccucccggcuacuuucacaggccagcauugaguaucugugacuuuuccaggcacacagugcaaccugucaguggcucuaccuucuggggucuggagaacgguggcccucuucuuacagcuccacuaggcagugccccagugcggacucugugugggagcuccaaccccacauuuccccuccacacugcccuagcagagguucucuuugagagccuugugccugcagcaaacuucugccuggacauccagaaguuuccauacauccuccaaaaucuaugugaaaguucccaaaccucaauucuugucuuguguacacugacaggaccaacaccacguggaaguugccaaugcuuggggcuugcauccucugaagccauggcccaggcuguaccuuggcuccuuuuagccauggcuggagcagaaaugcagggcaccaagucccuaggcugcacagagcagggaggcccugggcccagcucaugaaaucauuuuuuccuccugucucugggccuggaugaggggggcugccacagaggucucugacaugcccuggagacauuuuccccauugucuugaugauuaacauuugacuucucauuauuuacccaaauuucugcagcuggcuucaauuucuccucagaaaaugaauuuuucccuucuauugcaucaucaggcugcaaauuuucugaacuuuuauggucugcuccccuuuuaaacuaaguugcaauuccaaaccaugucucugugaauauauaaaacugaaugcuuuuaucagcauccaagucaccucuugaacaguuugcugcuuagaaauuucuuccaccagauacccuaaaucaucucucucaaguuccaagcuccacagaucucuagggcaggggcaaaaugccaccagucuccuugcauagcaagagugaccuuuacuccaguucccaacaaguucuucaucuccaucugagaccaccucagccuggaccuuauuguccauaucauuaucagcauuuuggucagagccauucaacaagucucuagaaaguuccaagcuuucccacaucuuccuguccucugagcccucccagucucuaggaaguuccaaacuuucccacauuuuccugucuucuucugagcccuccaaacuguuccaaccucugccuguaaguuacuuccacauuuuugaguaucuuuacggcagcaucucacucuacugguaccaauuuacuguauuagucuguucucaugcugcuaauaaaggcauacucgaggcuggguaacuuacaaaggaaagagguuuaacugacucacaguuccacauggcuggggaggccucacaauuauggcggaaggugaaugaggggcaaagucaugucuuacgugguugcaggcaaagaguaugugcgggggaacuccccuuuauaaaaccaucagaucuccugagacuuauuaacuaucaugagaacugcucaggaaaaaccugcccccaugauucaauaaccucccauuggguaccuuccacaacauguaagaauuauaagagcuacaauucaagaugagauuuggguggggacagaaccaaaccauacacaaaacauauauauauauauuugcuacuaagaggauuuugauugauuguacucuauuauugguaauaauuagacaaagugggagcuaggaacaggaaaacaaaaagaagauaaagcaaauggcagagcaggguaaagaagcuuuuucaucaauauuagaucuuacuacuuuuugucuaauaagaagaaagguuccugccacauacaugaaguaugcuuccaacauaucuuaacaucauuucacuaggauuacccugacacugaggugguggaagaguggaagucaguaaucacagguccuaacauugaaauuugacacaggaccuuaugaaaaagcccucuugguaugaauauaagcugcaaaaaaguaaaauagauguauagcaaugaaacugaggaaaauagaaagccuaagaaguuucuaaugaucaagugauugccaaggaaugauuuuacaaugcucauuauuguucacuaagauguguaauaugucaucucuaaccucuguauagaauguucaguuuuaauugcucuaucuuagcgaaucaaacuucuauauuugauaaggucuuuucuaaauuuacuugugacuucaguaaagagaaaauggguccuaaauuaggguaguagcaaugaaaauagcagaucacauaaaaugcuguguucucacuucauaaggguagaugguacugccucaauacaauuuaggggcgaauauaaaaaguuucacauuuguacauguugccauaugacacacuuucaguggauucagaccaagauuuuuauaccauaaguaguuuuacaugggaucuuuagcacaaaaaaaaugaccuagguaaaaaauaguuaaauccaugagauagaauuggggugaauaucaacauggagggauugaaaggauaaggaggaguauccaauagagcaguuaagagaagaaacacaagaaaaaaguguuacagaagacaaaggagaaacaggggugguuagaauuguucuucagccuagauguacgaguuacauugagucagauauuaugacauauuacauagccuuucuauaguggagaaagucuuguaauauuaaagggaaauauaaugaaacagugcaaaguuaauacagaagaacaaauaucugaagguuuuagcucuggaaacagaaaaaaaaaacaguaaaaugcuacaccacugguucaagacaaauuacagugcacauaaaaaugcuuugagcuaaacacucuuagaauuaauaaacugucugguuauucaauauaaauucacuugauuuauaccaaagauucaucugcauucuacagagggaaaaaauccauuuucucuucucuuucuaaaggauuucuggacucugaaagaaagucuaugaugauuaauaaaagucuguuagaaauuuguguucagagaaaaaauguaaucuuuuuuuuuugucuuuuuuuugagacagagucucgcucugucacccaggcuggagugcaguggugccaucucggcucacugcaacuuccaccucccggguucaugcuauucuccugccucagccuccugaguaucugggacuacaggcacccgccacuacgcccggcuaauugaaaaaauguaauauuuuguacauaaagaugauauuacuuccaggccaacuaucagccaaaaugguuuugaauuuuuuuuuauucuauggaagguacaauuuauacugaauuuucuagaacuuuccuaugugaagcauaucauacacuaauuaaaugguuagcuggagauagggacaugguguauggccugcuccaggcuuucuccacuuucaucuuaucuuaaguuuagugccaugauaacugccacauccaaaaauaauuuaacagagaucauauuuuagaaauauuaaacugauauauuuuuccauuuccccuaaauuauagugacuugcauuucccuaccuauuuuauuaaauaaccuaucagauaaaauuaagacaaucucuggacagugaggcuuguuacucauuuucccuggcacacacuacaaacacuucaaacucuccucaaaguagugcugugucuaccacuuuaugguacugcccaggcagugggaucgaaaugguuuagagagucaucugaguagagaagaccugaaauggucucucucaaaucucccacagucauagagauggggugaagaaccagaaauguauauggauuuccaaggccuuuucaaaggugaauggaacaugguugaaaauuaacagugagcucaagugcuuaaggucaccacguuacuacuuugagucaagauauguuugacuguagagacagguuuaucucucuuuuccucagaagccuauaauaauuuccaacuaccuauuuuuauaaacuaaaauuauuucaucugaaguuccccuuccccaggauuuucaaucccuugauuccacaacauacacauguacuucugaucuccuuaaucgucucuacuucucauuuagguucccuugcuccugccaggcuccuuuccauuaggucaucuauauugccaguuucaaaaccugguaaaauuaccuaaauuaugucuuaaugaaguauaacuuaacuuucuggaaaacaacuuggcaaucuauacaaaagccuuaaaaaagauacuaaccucuguccaaugauuccauuuuucugagcaaauauaauaaaagauacagagcuuaaugcauaaagauauccaucagaacauaauucagaagaggaaacuaauggaaaccaccuaaaugaauguaugguacaauagggcgacuauaguuaacaauaauuuauagcauauuucaagauaauaaaaagagugaaauuagaaugcuccuaacacaaaaaaaugauaaaugcuugaggugauagacaccccaauuacccugauuugacuaugacacacuauaucuuuguauuaaaauaucacuuguaccccauaaauaugugcaacuauuauguauccacauaacuaaaaauaaaaacauuuuuuaaaaaagaaucucaguagggugguuagucaacaugguacauuucuauaaucaaauauuauguaaucauuaaaacaguuacauaggaauauacuaaaaauauaaugcugaaaaaaguacaguauguauuuauuuuaaaaauuccaauuuugagcacauauaaacauauauagauaugugaauuaauaugaaaaaauucacaaaaauguuaacucauguguuuauuuucagugcucauucauuuaaaacauucacucacacccacacccacccacacacacacacacacacacacacacacacacgcuuauuuaccaucuaacuucucuaaacaaaaaaggcauaguccuuacucuauggaguugccggucuaauggggaagguacauuuaacaaguaauuacaacagauuauaguaacacauucccuuuuucuuaauuaucugucucuauuauaacugccaacuccaugaugguagagauccuauuucucaugucugucccuugcauccacagcaucuaccacagcguacaggaucauaaauauuucaugaauguagaggaggcccagagacuaaaugggagcauauuagcaggagggccuaaaauaacucaggagguuugaaaacuuuuuugagggcaagugccauuuaaaauaaacucuaaagaaagaggaagaacuagccaggugaaggagguugaaaacacugcucaagguagaaaauggcuacagguaaaagaagugguguucacugaauucauagacucaaacagugguuauuuccgaauaaggguuuguaggcaauuucuuuuucaaauuuacuucagugaaggcguauuuuuguguccaucagagaaacaauagucuaaacuaaacagauuuuaaaaucucugacuucucagagaucacccugauuuuacauguuuauuuucuuacuuugaacugucucuauacauacaauauggaacaaauuauugcaaauucaguguccuacuuuagaacuaucuuauacuuccuccuauauuuuaaguucuuucggguaaagaauauuuuuuuuuuccuuuccuuuauuugguaucuuccauagcacugguauugugcuguguacccaguaugcuguauuuuaaaguuaaauaauuauagucgagaauacugaucuuauuaucugguggcuaguuuuuguuccaaugacuuuacagaguuagucccagagaaaccaaugagaauuaugaaauuuucuuuuauauaacuuuaaaaaauuuaucucguucgauaaaaauacuucauaccgaauuagaauaaaaauuaauauuauuuauuauccuaaaaucucagagacagauguuuuuauuuuuuuccaggauaaagagcaaagaaaaauauucugauggucaaaguaaccaugacuacgguuuucagacuuauaacaaguguuauuuucauacacucuauauugguaaaaauaauauauucuuauaaaauauauuuguggugaagcuuacuuuuauacugcaacaaaauucuuaaaauuauucauuaauucuaccaucaguagcuucuaggguaacuauuuuuccaguaaauaccauaguguggacucuugagagaccagaagcggucccugcccccgaaaauauguaaaauugccacucugguuacuacuaagaccauaaauccauuuuaccauuguuaccucgauucucaaggguaaggaauaauucucagcuuccccauuccaggcccauaucuaaaggguagcacaaguuugauaggggcucucuucgagaaagaggaacaguguggcauuagcuauguuacuagaaagacccaaucccuagucaaagccauugagucuugccccucuacauaaauggauauagacccucacaucuagagcugcauucuaggcuauuaaacaaucuuuuucaauugcuguugcugguaucuaaaauuucaaauuaucuuuagacaauguuucagcuucuaugauaacauuucagaaacagagcaaauaauguguaugguuuauuuaaacuauacucaaauguacugaaaauugguucacauuuccaaagaaacucugugaauaaguacagcaugcuauuauacuuuaagacugucauucuguucauacuaauauaauggugacuuuauuacuagaaacaagauuuucucuaucuggguaauuuuaguucuguucauuuuagcaaaauuguaaugacuagaaccaucuuggugguugaucuaaagcacacgaaaugcucuuuauuuugccagcuacaaacauguuaauaugaaaugcauucacagaacggaaggacaguuccuuucuaaaguacuacgguuugaagugaauaguccuaucauggcaaagcacaaguggaaggaaacugaccauuaggucacuauuggaugguaaggguauuucauuccacuauccaccccacaacucaaaagaggaaucugaccuaguggcuuacuagagauuggaaaugaaaaaaaaaaaaggugaaaagaauuuauuuuuauuuauauacuuggccagaaauuagagagaagcuuuuauaauacagauaucaaaggguucugaagaaaaagacauggagaaggacugaagagaagagaaagaagaugaagacaauaacgagaaaagaaaaagaauguuagacuaugaaaguuuuuucaaugaaaagagucaaacucugucaaauauuugaagagauuuauucugagccaaauacgagugagcaauggcccaugacacagcucucaggagauccugagaacaugugcccaaggugcucagggaacagccuaguuuuauacauuuuagggagacaaaaaacacaucagucacauaccugaaagauauacauugguucagcccaaaaaggugggacaacucaagggaaaugggggguguuccaagcuauagguugauuaagaaauuuucugaucaguaauugguugaaacaguuauuaucaauagaaaugaaugucuagguuaugauaaggguuuauggagaccaaaguuuuauuaugcagaugaagccuccagguagcaggcuucagagagaacagauuguaaguguuucuuaucagauuuaaagagucuguucuaucaguaguucaaaaauagaggagaguauaaugaggcacguccaucccucaacccccaucauggccagaaccagcuuuucagguuaaauuuggagugcccuggccaagaggagagguccauucagaugguugggguugggggggucuuauaauuuuauuuuugguuuacaguccucaugaaguacagugauauaauaaucaaagaaaacauuaauuuugguagucagagaccaaauacagaugacugcagucagaaucuugugauucugaauuuuaguuuccuauugaaaaaaguuugaaauucagaagcacaauaauauaauuuauaaagaauaccuaaacuuacuucauuaaggaaauggguaggcaucaaggaaugaacauucucugcaacaaauaauacacuauggcaaauaauuuaauguuaagguacauaagaauucuucucauccgaauacuggauaucaauaaaagaaaacauugauugauuucaacaaaugauccuuaauuaaaacaaucgaagcgauaaagaaggaauuaucaaacauaaauugcuaaacuaguagcagacagcuuuuacauuuagcuucauuuguuaaaugaaguaaaaugccuaucuuacuucaaagaauguuuuaaaaauuauaucaguaggauuagguugugacaauagcauuuaaauuccaugagaacuuauuauaaggaaacugccuacccugacauuuccuccaugguaaaagaaaagcauucuuauuuauaauaaauaaauuuucuuuagucuuuuucaguuuacaaagugccuguauacacauuaucauuuaugcugacaagcagcuggugcaguggguguuuuuuuuuaaucuccgucuugacagagagcagcaaagcacacagucuuagaugcuagaauccaugaucuaucacugaauaguuugugacuucaggcaaguuauuuaaacucucuaaaucucauucucccccuaucuaaaauggggguauuuaucugccucauaggguuguuauaaagacuaaauuaaccaauaacugugaagugcuuaaacugucaagugcuggaguuagcuguuauuacuacagauaaaacugaagugguccugaggaugaggagaaauuggaaacuucguguacuguuguaagaaugcaaauuuaugcagucauuaugaaaaacaguaugaaauuuccucaaaaaacuaaaaauagaaccaccauauaauuuagcaaucccacuuuugaguauuuaucuaaaggaaauaaaaucaggguccuggaggcacuugcacaaucauguucaucgcaacauuauucauuaacagccaagauguagaaacaaccuaaaugucuaucaacagaugaauauuuucaucagaaaaggugauacacagacacacacucauacgguggaauauuauucagccuuuaaaaagaaguaaauccugcaauaugugacauggaugaaucuucaggacauuaugcuuagcaaaauacaccagucacagaaggacaaauacuacaucauuccacuuaaaugugaaaucuaaaaugaucaaacucacagaggcauagaguagaaucgugguugguacgggcuggggagaggaagaaauggggaguugcuauucaauggauauaaaguuucaguuaugcaagaugaauaagcucuagaaaucugcaguacaaauaccauguuuauagucaacaacacuguacuguacacaaaauuuguuaagaagguaaaucugauguuaaguguucuuacuauaauaaaaaaaaauuaugguucauagaacuggccuaaaacuacagaguaaauaaucagaagagucaggauucaaauucuaaucuuuuacauaaggucaagugacuuuaaguaaaccuuaaaaucuaauccacauuaguuaaagcaauauguuauuccugaaagagcauagacuuuggugcagacuuaggcacaaauaauaguuuaacucaucagugaaauagagacauaaauaccuaacuuguauagucauauaagaauuaaaugagaacagaaacuccaugagaccaaaauguaagaacuuuauaaauuuaaaauugaugucuugcaauauguggccucacugaaaauauuuuaagaggucccuaaaccuauaauguuaugguuaccagccacaaaagacauaugaguuaguaagaucuuacaagauuguuuccuuaaugcaauagaugcuaauauuuggacaagcuucaaugagaauuuacucucguguuauuagaaaauugugugaaaauaguaugaauuguuccaauugccuguauauuuuauauauucuuuuucuaguaaaaaaugaaaaguaauaagaugaauauuuuauuuuaaaugcugaaauguacaaaacacauuuuucagaaaagaggaaaucuuauuaguauuaguauguaucaacucauuuuagaaaauauaaaacuaauuauguccaacugaacaaauuaacaccaucauagucuagcuaagcauuccaaggucguuccuuuaauuuuaugaucucgcacauuaacucauauuaaagaaaagaagauucaaguaaaucuacuuggguuaaaacaugccccuguauaauaccucuuaacaccuuuaaauaaaugauucaaaacaaaauacauaugcuuugugcauaguacauagcauacaucuuuuauuguacuaaaauaugcaacuaauccuucaauucaaccacuacauuauuccuggggaauuuucucaccaacuuuugaaauuacaaccuaaguuuuuguaaguauccaaaaaucaacacaguuugguucauuggcaaauguuugugauaucaauuuaaauagaugcauggcaucugugaaauaugagaugcugggcuccacagcuagcuaugaaauaauuuuaaagccagaaacuaccuugccaaaacaaauuaguugguagacucuucgaucugaauaacaauguauauuuuuauuuucaauaaauagaaauauauuaaauuucuagcacugccacaacaaacuaccauaaauugaguggcuuaaaaaaaacaaaaauuuccuaucucaguuuuggaagcuaaaaguauaaaucaagaugugaguagaaccauguucccucuaaaggcuccagagaaggaucuuuccuugcuucuuucaaucuucucaugguaucaucaauccuugguguuccuuggcuugaaggugcauuaccccaaucucugccuauauacucauauaaaccuuuuuccuguguguccugugugugccucuguguccucuccucuuguuauaaggauaaaaaaucauauuggauuuagaacccauccuacucuaguauguccgcaucuuaacuaauuauaccugcaaagccccuacuugcaaauauggucauauuuugagguuaugaugaacaugaauuuugaccuaguauggggguagguuuaugcuuauuucaugcaauuuuaaucuuuaaaguauguuuaagcuguaaaauucugugauuccauaauugugagaccaaaaaauaaacuuugucuagcacaaaaaugcacaaguuguuuucucaaaauuagugauuuucucauaauuaaaauguuuauuaccaaaucaguuaauccuauauguaaacauuacaguacuuccucauguuucuggacuuuacucauguaggucuuuaauuucacuacgcuacuuuuaccucaggauagggcaaaaaagagaaguaaggaagcaucuauauuguuaggaucagagugcaggaccgaggagaccaggagaggauacugaugagcaaaaaaugaauucauuccuuuugaguagauuccuaggaguggaauugcugagucauaugguaaauuuauguuuuacuuuuuaagaaaacacaaacuauuuuauugaaaugacuaugcaauuuuauauuucuaccaacaaugcauaaaauucuaguuucuccacauccuaaccaacacuaauauuguccaucuuuauuauuacagucauuaaaauuacauuauaauuguaaucuguauugcucuaaugacuagugaugugccaggaagucuucuuaguggucguuauaaaaggugaauaauacauaauacuugccuuuacaacauuuaaugucugagggagagagagagagagagacagagagaagcaaaaauuacaacacacuacauuaaauguacacacacuguuauaccuuuuacuaaauaguuuugugaaauuuggacauuuucccuuaugaaugaagaauuuuguggaaauucaacuaagauuaaacaaagcccaacauuauauacaagccaucaaccugugaaguauuuccuccauguacuucugaucuuuaaagcaaucauguaagacguucucucaacuaaguacuucauuuucuuuaaaggacauuugcaauagaauaaaguacaaaguaaugcugcauuuaaguguccucagggaaaagaaaugaacauuauuauuuuagcagaauguccaaaaggugauuuuaaugacaauagacuuuucugaugaugauuuuuacugauuuucucauagauaaaauguuuauuaucaaaucaguuaauccuauaucaaaugguuucuauaauaaaaauaccaaaaauaucaaauggacuuucaaaaacaucgaauggcgccuauaaaauggagaucaaggcacaugaaaggaucucuagcacucagcaauccuaacacuucuauuaaauauggaauaauucuauaccucuugaccucuaugauugcaaagccauguaaaugagcuguauacauagucauuuuccuuaaaccaaguguuaaauuauuuuuuaagucucucagauggccuaccucugaacccaguaaaaacugaaauaggggugagaaaaugcugaccucuugaauuauauacaaaguugaaaauauucuuaaggcccuaccaagaaguagagaauuaccaucugagucuuguauccaucagaacuccagucuggagaugagagcuaauacauugccacauuagauaaaacauauagauaaaaauaugauguaacauuuuuuugaaggaugaaugaacacaggaauaggcauugugggagcuccagguaagggaauagugacuuaauaguagccaggcacuggguauuacaagaauuccuccuuccuucaaagagcucauuguccagugaagagacagucauaaauacaaugaaaauacaguaccguaaaagcagcuaacauuuauugaacacauucuauuugcaagcuaucauuuuuacuuagauuaucucuuucaauccucacaacaaaacuacaagauagauaccguuacuauccucauucuacagauauggaaacaggcuuagagacacaacuugcacaaggcuacuugacccaccucuaaccgauucaaguggcccauauucauaaccacugaggcagcuuuacugccacuuauaccacuacuauaaacauacagauguuaaaauaaacauagcaggcacaaugggacagagggccgacuugccagagagagucagaaaaaguuucacagagugugcucugaaaauuaacaagaauuuuccagacagagaaacagaggagaagcauuccagauugggggcaaaaauauaugugauaaaaagaagcauacacggaaauaacagaaacaacuguuguauuaguuuccuauggcugcuguaacaaaauaccauaaacuuguuacuuaaaacaacagaagcuauugcaguucauaguuugggaugccagagucugaaaucaauaucgcugggccaaaaucaagguguugggugggccacgcucccuccagaggcucuaggggaaauuucauuccuugccuuuuuucagcuucuggugacugccagcauccccuggcuuguaaucauauugcacaauuuuuaagucuagcaucuugaaauuucuccaugucuguaaagaucucccucugucuccuucuuauaaggauacaugugauugcacuuagggcccaccuagauaauccaggacaaucucccaucucaagauccuuaacuuaauaucugcaaagacccuuuuuccaaguaagguaacauuuacugguaccaagaauuacaucugauuucuuugggggcauuuuucagucuaucacaacagugauaggggaguccauguugguagaauuggaaaauacacaaaggaguaaaggucaugagaaauguggcaggugggagggguaaaauagaagaaacuaaaagaggcuagcaggucagcagggaccagaugaugaugacuagauuggcuacagacauguuuaaauuguauucuguaggugacagguaaaauugacauguuuugauuugcagcauuauauugugauauuugccuguuagaaaaaaaucacuacagaguuaauagugaagagagaucaguagaaggcaagagauuauugaaacccuuaauaauuauucaggaauaaaaagaagagauggauaagauauaaauuuggccauuauggaugaaauauagagaaaagaacaaggagaaauuuaggauaacuccuaaauuuacaguuuugggcaacuggguggauaguggggauaacugugaauaggaaauaccauaggagguacuaaaggcaaggaugaaccuggcuuuggacaugcaaaucuagaggugucugcauggcauccaaauugagauucugguagauaaauugauaugaaagucuggaguacaaaaggauuuagaacuuaaauguauacaucuaaauuugaaaauuuagagaucuagauuuaggaaucacuggccaugaguauaguugaaaguaucaaauaagucaguguuaguagaaacugcuuuuauugcuggucccagugaguuccaaggcagucucuucagaauuuuuaugcugccaugaauguuucaauuuguucauuggugaauuuuagccaccuagacuguaucuaauuaucucauuuucuuuagacacugccuguaccauuuuggaaaauuaucuuauuaaagucagcucagaaaaaaaaauagagcauuuaguguucuauuuacaugugauuauacauacucaggguccuggugcuagggaccucauaaaugcugaaaagaacuguuaaucuuaaaaggcuuugggaaaaaauuauuacuaauauuaacccucuagggaacuaaugaugaaaaauuacccuaccccagugguccuuaaaacuuuuucaucccgugacuacucaagcucuacaucauuucuucuacaauaccacaucacauaacugcaggacuuuuaugccgcugcgaagggaagaaagagauuaucaucuucaugagaccacaggguacacuaaauaaauguugaaaacagagcaccaggcagugacugagaaaagcuacaggaagacugcagagccugaggcuuugacaagcaggugcuuccguggucaucaaaucacuauucauagacaugucguuccaggccagagaauccagcucugagaaacaaugccucagccauuagcucccaaaagacaucaaucacgccugccaagacacacaguuagcucaggagggauuucaaaacuuaacugggucaaaaauugcuucuaagcagguuuucuuaaucuaaucuaaacugcaacuugagaaaauagaaggaauucuaccuccuucuaaacugugguuccuaccuacaucuccaacacuauuuuuaucucuuuuguuuuccaaguacaaaauguuuugauccaauguaaaugagcuauguauugcuuucuauaagaccuacaaauuccuuccuaccuucucacaucacuuauucuacccagaaagucuucccuuuccuccuucuacuuucaaaauacaaauuucauagaaauuugcugggaccaugccagauaguagucauaaugcaucuucaauauuucugccauaauuguaaaauuuggaacucaguaaaugcugucuugcauauauuugcuuucuguauauguuauaugccucuaacaagauuuuaaguucuguggauggagucagcauuuaauaucuuacugggauaccgguguccaguaggucucaauagaugaggaugacaaagacuccaaaauauacaucugccuuuuauuucugccuacgaagauuuuaacaaauuuuuaaccuguguaaauuuuucuaacuaaaauuuucaccucuuucuuaccaauauaguuuuguuuucauauaugagauuuccuuacuaucuuugcuuuaauaacuauuuuaucucaaauuuuaacauugccuggaaaaaaacagaugacauuguagcuuuagauuaauuuucaaaguaucugauuauuuuaauguaucaagagaaagcaggaagaguaagagauugccuuuugugcuauuuugcauauauaauuggcuuuacacaaaaaauaaugcauccuguaaggacagaaaagguguaaaaucuuucuucacucaucauaaggaucacggucaacacucuuauaauaaaagacaagauaacaagagaaaagcauaacagguuuauuuaaucaaaguuuugcaugacacaauacccuucagaaaugaagauucagagacccaagggacaacugucaauuuuuauacuuagauucgaugaagaauggacaguuguguagaaaugagauuggacagaaaggguaugaccuaaugguagacugagugaggaaaccuaguaagaccuccuguucuuauucuucuugaacucucuguauagcaguucuugguccuagguauagguccggaccccuucugaaaugagucuugugaccuacuauaagacaagguagaccagaguauuucuuuguggccagcucuuauacaaaaagcugggagaaaguuaggguaauauuucuagguuuuaugucuggcuuuaggggagaggguuucuaguuucuauggccugccuugggagagaaaggggagcaggcauaaaaagggcaggagaaggucagaaagaucuugcuucugugaccuuuuucuuuaguucaacuuauucagcaugcuaaagugccauacuuugugguaccauuuucugagcccaacauucccccaucugaaacuuccccagaaaguuuaacaguaaaaaaauuggguuguuggauugucucauaagccaucaaaucagucuuucaguccugaaaauaugucuguccaauuagacaaauaaugguugugucuaauuugaggaggugguauugcagguaggccuccaccaaacuuaguccuccauauggugugaguaaucagauauuuaacaauagucauuucuauaaaaacaaaagaaaacaaaagguaauguuugaaguaauccauaaacucauuccugaguccagaggguauccaauugagacaauuucuagauuuggccucaaaguaucuucaggugaagacagugcaggcaguggcaaucuaacagcuuuuucuugcuuuuaguuuucaagugagcuuucugaguaaucuauacagcaacaggcaugaagguuguucauacaaaagcugcuguggugauuucccugaagucuacaucaagucaucaagcuuuggcuaauuuuagggcuucaggaaaagaacaguuuuaauuucaaugauaucaagccagaagggugggagaaaaauuaaaaauauuauuuuggagaguuguggccagauauuagaggaaacuagaagaauuucagaauacagcccagauuucagguagauauggacccucaaaaacaauuaguuagaaucuaauaacaagugcacuauaguuuucaucugacacauaauuuuucucucuauacgcacuuucauuucuaguaaagauacucaaaguagacugauuuguuugcaaaauaaguuuagucuccuuaaacuucuccugauuauuuacauaaauccagcaaaaauauuuauugaccauuuucuuugagaugagucuugcucugucgccaggcuggagugcaguggugugaucucagcuuacugcaaccuccaccuccuggguucaagcgauuccccugccucagucuccuaaguagcugggauuacaggcaugugcauauuggcucuuuuuaaguuuguuuugcugaaauuuucaauuaggaaucucagauuagacuuuuaaaagcuucuugaggcuaggaauccaagccaaggacucacugucaaauuucccauaguaucuauauaguuuggugaauuccucucugcucaagggguccaaaauauccugagguuucagggcugucagaaagugacauucuuuagccaucuauaaggcaaccaugugaacuuuguucaagaaaccaugccaguuauugcaaagcgggcuuuauuggcuccauaaugucaaccuuaguuccucgauguugucugaaaauaugacauuccagucaaagccuugauaacauagccaguguuuccaauugugucauguuacaaggagaacaaauucuuacugaaguuacacaaauaauaauauugccauaaaauaagaauccuuacaaauaguuucugaauucuggagggauacaguagaaaaaaaaaguaaauguuuuaauucuguuuacaaaguuauacuuuaccaaauuguuauaagcuauagaugccuucagagaaaaaaaaucuuuaaauauagaaaauaaacauuuaaaauaagaaccagaaaacuuucaaauaaaaagucaugaaaacauuuccucaucaguugauucaguccuguguaauuaauucuuauuauguuugaucuugguuagcagucucauuaagucaucuguuuauucauuagaguuguggaaauucuuaccuaguccaaugauaugaucccaaaguuaucagaaaccuguacuugucagaguuauuuccauccuuucccugaacuuucuugaagacacaacacuuuacaauucuaguugcuugcaaaaacuuuucagaaagaucaucagaauaaagcaauuaacuauagacaagacuuaaaaugaucaugguuagaaaucuguuaagaguucauuauaaccagcaaaugacaaggaaauuuggugauuucuguggcauacaacauuuuaacauaauaaccaaaaauugugaauaauagcauaucagacuucuaggaaucucauaauuuuuaaacacucauaugaauaacauccauagauauaacuuacagguuuagcaucccuuauuacuugacaaugcuucccauauaauuuagcauaucaaauaagccaacuggcuuauuugaggccaacuggaaaaucucaaaguuaauuugggucaaaaagacuuaauuuagaauuuaauuuugagaacuuugucaaaaaugucaaaagcuuuaaaacacuugguuaaauauuaucuuggauauuuauuaaucaaaaugacaauaaaaaauguuuaagaggcuggguggagugccuaacgccuguaaugccagcacuuugggaggccaaggcagguagaucaccugaggucagggguuugaagccagccugaccaacauggugaaacccugucucuacuaaaaauacaaaaauuagcugggcaugguggcaggcaucuguaaucccagcuacuugggagacugaagcaggagaauuguuugaacccgggagguggagguugcagugagcugagaucacaccauugcacuccagccugggcgacaagggcaaaacucuaucucaaaaaaaaaaaaaaaaagaaaagaaaagaaaaaauuguuuaagacaaauagagaagguuacauacuugugaacaaaaacugagcucuuuuaauagaaaacucaguuuucuuaaguaaucaaagacuaauaugugaccacaugaaauaaacuacauuaauaaaacacaaaauuguuuccuaggccaauuacauaaaaggaauaaaaacugucacauucucagaccaaaauacuccaagaaacuuuugucauuuuaacagggaagaccaaauuguacuuuugcuucaguguacucuuaacacuaaagguaauuuuaaauaaauuuuaaauaaauauauacaaucucagucagcuuugaccacacaacauuuucauaaacauuuuuuaaacuuuuaaaaauugauacagaauuaugcauacuuauggaguguacauugcauauauacaaugcaacauaaucaaauuaggauaauuagcauauacauuauccucagauacuuaucauuuguuugcagugaaaacauuaaaaauccucucuucuagcuauuuucaaauauauaauacauuauuguuaacuacaaucauucuacugugcaauggaauacuggaaauuauucauccuaucuaguuguaacuuugaacccacugaccaaccucuccucauuuuccucuccccucuacccuucccaaccucugguaacaacuauuccacucucuaguucuaugagaucaacuuuuuuagcucccacauaugagugagaauauguagcauuugucuuucugugucuggcuuauuucacauaacauaauguuuuccagccucauccauguugcuagaaaugacaggauuguauucuuuuuuauaguugaacagaauuaauuguguaaauaugccaaauauuuucuaaauccauucauccauugauugacauuucaguugauucaaugucuuggcuuuugugaauacugcuauaauaagcacaagugugcaguuauuuuuuugacacacugacuucauuuaaucugaauauauacccuguaguaagauuccugaauaauaugguagcucuauuuuuaauuuuuugauggaauuccaugccaauuucccuagugguugugcuauuuuacauucccaucaacaguguauaagaguuccccuuucuucauguccucaccagcauuuguuauuuuugucuuuuugauaauaaccauucuaauuacugugaugugauauuucaucgugguuucuauuuacauuucucugguaauuagugauguugagcauuuuuccauauacuucuuggccauuuguaugucuuccuuugagaaaugucuauucagaucuuucacccauuuuuuuuagugaaauuauaugcuuuuuuccuauugaguugucugguuuccuuauauauucucauuauuaaccccuugucagaugcauaguuuacaaauguuuuuugguauaacauaagcauuuuuccuauuuuuuaacaaaaauguguucuuuauucauuaugaaacauuuuacuuccucacaaagaguuguuuccuuuauaauuucuaguauuuuaauuacauguauuaacuauaauuuauaacuuuuaguaacuuaauuucuaguuaaaaguagcaaacuuugugaacugucucauauuaguacaaaugauuucauuauuucuagagacaugcauuuccucaauuuuuuacauuuauuaauagauccaaauauauuuagcuucucuauaucuuauaaaaagaagacgccaaaguacauaaacuuaugaauaaucauauauguuuucauauuuuaacuuacuuagaaauaacucagacaauuaaugaguaucucuauuacuuaauuucacuauaagguuucaaguuaccaaaaagaauuuuuaaacuaugacaaguucauuuauaaacauuuaucucauucacauuuaccuaacuguauucauucuuaacaguuauguuuaaauugaucaugggaaacaggcuauucaucaucuuaucuuuuuguucuuuuaaaaaacaaaaccaaacuaacccuacauuugccagccuuguccuaaccaaagccucugaaacacuggacacagauacccuccccauuguucaccccagccauccuggguccuaaacauccacucagcacccagaaggcuacaaaaggcaagguccauauggaugguacagagcucaggacagaggacaggaaacagacagcugugaagacaaugccuggaguacuugacugcucccaggauggccaagaagcagaguuaggccagggaggauggggccauacugggcuuggcccuccccugugguugacuggcagccuaggcgcugcagaaacacacauguccuagacuucaccauagccuccuucccagaccccagaauccagaggcucaaaacuaaauacauaggcucacaagauguacacaaggcuuuaugggagccuagcagucauucccccuagcuuugaccuaccaauaagucaggcaaguaucaaaaauaucaaagaagcuaaaaguuaaaaguuaaauguaguuuuuccuuuuuuuuuuucccccaugacucauauacauuuuagcaauccauauuuacugugcauucuacucugagguuggauuuaaaguauuaugaccuuaaacaccuagcagagguaacauaccuguuugaucagcaaacacaggcaaaaaugucuauauuauauuuaaugacauaaucauacagaaagaagcagauccuacagcuuuaacuuuaagccacaugccagguccaauaauucaagacucacuagcuggauuuggcgggacacguuaccugcuccagauggcuagagcuuuuuaccaauuuguauggagaaggcuucugagacuuuucaugggaccaguuucuaaacauuuuuuucuuucugaugacagucaucucccugaauuuuguauuuccagaagauaaauaucaaguucuagagaagucaggauaggaaauuuacaucucaaaagcacagagaaagaaugcaaguuuuuucauguaguuugaggaauguucaccuauuaacagagaucagucuuauaaaggauguggacuagauuuuaggcugguaacugaggaucuaguguaugaaugucuucaaagcccccuaugagugguacaaaaaguacauaaaugagccuaggcaaaaauucaggaguccauucaaaauaaccagcugaucccauuauuacauuggguuuugggucucuuagagcugagguaaaagccuaagaggacaacaucccauaguugggucauacaacauuuucacaauguaccuuguugcaugggcauuuucuugaggcuaguguguaaccuaaugucaauuagcccauuuugugucccgcuuauccuaacucaggagucucugucuuugugugcaugggugugguaagcacucuaguagcuuucaagugcgcaaaccaugcacaccaucaaauuguggcuuuggcuccgaaauuccuuugaccaacuuagccaaugauuuucccauucugucugacccagucaaacaccugaggcuucucuuaugugagggcacaagaaacaaagaggauggaaacaagauauaauaccugugaauuuggaaaacuggaguucacauccccuauagcaaaaaccacuuacaaaccacuuacagcaaccgcugucuguuguauugaaaacugcagcucuacccaguaacuggucaaccaccaugaauccaaaagucaaaugccuucucacagcacaaacuaacccuugguaccccaaaugccaaagauaucagggagcucaaugccaaagagaacagagguccagaugugagaaggacuaacucaugacucuuagggaagacacaggaccaaaugaggaagacagaggaccacaaaaaggaggucaggggcaccuuuccuguguuuuucaaggggucucagagucuuuagaggucuccuuccggucccuauguaugauuaccagaaugcugauguuuucucuuaguaauuuuuuaucugcugaccaacaaauggaggagggaaggaguugaaggcccacucaaggaaacugaauggaagauagacgguggcacaaggaggauacaggagcagaagaaauggaaagaagagguuuagaggagucaaucuggggagaucuuaaguucaccaaaaaggccaauaaaguuccacauuguccucaacaaaaaucacacuaacaaggaaggaaguaaacagaaaaacagaauauguaguuagcaggaguuugagaaaaggaguuucaguugacugugaaguucccaugggagaagcaggauccaacagagaaacucagacaccuuagaaaaagccugaauaucagcuuccacuuaaauugacuuuucaccauacagccuuuuaaaaaaauccuuucaaaugucuuauuaucagauuucagccaggacaaacaacaaauaauucugauuuuuuuccuuuuccuuuuaaaccaaaggaagguauccaucaaguaacucagaaccaaaaccaguaagucuuuuacgacuuaaccagugaugagagagacguccucaagagggugcgaaaagguacaguccuccaaagacucagaaccacucccaaaagaaaagucaaaagaacgaaagaccuuugcuaccacaggaccaagcaaugaugguggagaugacaaaagccccuuugaauugggacuuuuuauaagaaaaaaaaaaaaauccccugagagcuggcacgauaaaacagagagcauucagggaccucauccacuggcugccugacacaagccaacacuugugcucucuggcugacagagaucaggggggauauucucacaagucuuaaggccgaacucucaggauguaaaaacgagacaaacaggaaagacaaagacaacugucccugagagggaaaggauccauaacaaauggguaccccaaggcuaaauuuacacaacagucacaauccaaacaaaugauuuucuccugcuaaccugaauuuggaaaggaacaaauacagauaaaauuuuaccaucuauucucaaccaggcauuauagacagagaccagggaagagcugauguuaguaaauaauucucccuuugccggcuuuuggucaguuguccuaggaucucaccugcaggcacuggagugagucaguugccucagccgcuccacauugaacaccagaguuacaagcgcagaaaagguaugacaccuuuccuaccuaucaaaagggucacaaccaacacuccuacaagaaaagguuaacaagaaaagcauaacagauuuauuuaaucaaaguuuuaugugacacaauagccuucagaaaugaaggcccacagacccaagaggaaaacuguccauuuuuaugcuuagauuugaugaagaauagacaguuauacagaagugugauugggcaaaaaggauaugaccuaaugguaauagacugaguagggaaaugcaguaaggccuguccucauucuuccugaccucucuguguagcauucuuuccucauggguauagggcaagaccccuucugaaaugagggucuugugaccuaccauuagacaaaguaggucacagaauuucuuuacagccagccucuacacagaaagguggggaaaggucagaauaauauuuccagguuuuauaucuggcuuuuggggauagaaguucuaauuucuaugaaccaccuuggugaagaggaauucuaguuucuauggccugccuuaggggaaaaugggaagcaggagaaagaaggguaggagaaugucagaaagaucuugcaucugaguucaaaguauucgcuucaguccaaaguacugagaaugccaaaguaccauacuuuaagaaauaauuuucugagccccaacaauccuaauuugaaaaguuaauuuauaggauucaaccuuuuuuauaucagagaugcuagcuggguagagguguacaacaaugaaugaaaacagaaauuuuuguuacuguagaacucuuuuugaggaagucaagaauauuuaugaguaugccuuuucuucacagcuuaacuaaaggucuguuaacaaauguaauagaguuaggcaguaucuuugagauaagguaccucaaaaguccccaaagguucuuccaaaaacacugucacugccaaaaaagguucuauaaucacauaaguuuaggaaauucucccuguucucuucccacuuuggagacacauaucaugacaucuaguccacaaaguccagcaggagagaccucuucaauuucauaaacauauuuaacuacaaacacuuuauaucaauagugccuaauaauagucuagaaaucagaacucguaaucguaauacuauuuaggcaauguugaucugguauaaaacccuuauuuuacagauauuuuuaaaaguaagagucacagaaguuaaauagcuaucuaguucagauacucuagacagagccaaaugaacccaaucucccaauuccacguuucuuccaugacucauucuuuacaugccaggcauuuaaccuaaucaucacuuuguaauuuaaaauuuccccauccagccucaaauacauguuuguuuguuuguuuguuuaagcacacaauaauauacauuuugagcauauccaaagcuuaucuaucacccuggauaacuuucuguaagugccucccuguuuauaaaauuaaaaacacugaaucugauagcaaauaaccugaggccucugugauaaaugagacagggcuucggggcguuucagccagccuccccugagacuagguuuaagacaucuccaucuuaugugaagacuuaaauuguguuguagcagcuucagugaaauuauuuuuaaugcccauuugagauuuuuuagaaauaauagagcuuuuaugcaggcauucgaggcagaauccuuaaugagguaaggcaugaggaaugaauucagaaggaagauuuucaugauuggaggagcuaugcgucauaccuaauguacauuccaggaauauuuuauuuaaagcaaaauuagugaaauaucaaucuguggaauucuacaagaaauucauuuuauaacuccuccauuauuccugucaucaguaacuucauuuuucacauaugagaaguucucacguaaauguccugaauaucuaaaccaauguauucagugcccagaauauauuauacauccaggauucacaauauucacuuaaauaugaugauuagagcaaaauugucaguuaaaaaauagcagcaguauuuagcugcauuugagggaaugugaucugaaguaccacagcaaccuuucuuaagccccaagcaaugcaaagucaugacauguacggguucagagacacagagcugauugagcaaaauacauaucccaaagauuaauggucaucugaaagaagauaaaagauuuauuguaaguuuuuauuugacauagugucacacaaaagugaucuaugaugucuucaauaacaaccaccaccacaaaauaauggcuaacacaucuaaugcucacuguguaccaggcacaguucuaagcacuuucuauauaaucacucauuucauuaucauaacaucuccaugaaauaguacuacuauuaucuccacuuaacaucuauugaaacugagaugcagagaguuuaaguaacuugccaaaggucacacagcuaguaagaaacaacacauagguuggauucgaauccucaaaguccagcuccaaaauccgcaaugucugagccuuacuaaaugccaagcaccaugagagguucuuucuugcauuaccucauuucauuaugcuuauuuaacuuuauuuuuaggauaaaaucaacuguaaaauguuuuucucuuucauuuacaaguuugcauggcuuguggcuacauccuugaauuuaucaguaaaucuccaauauaauaaaaaccagcuguguuccaccugaaacauuaaaacauuauucuuugcauugcguaaguuaaaaaaacuguuuaguuucuacuucucuagccuuucuugaguaagcagcuauggguaguaaagcauacaggacaaagagauaucucaggauccagcucacccaaugagggagcuacaaaagacagcaaggaaggccuucaaguaaugaguuagcaagcugucuagugauaacccugagccaaugggaaugcccuugggauguguccuaugcuuaauucaaauaucuguggcacagcauagcauccuugaacugggagaaaccucuuuguagcauuaccaccaaucuuuccuaaguaaaguuagccauuuccaccucagugaggcuaaucuucaaguaauuucuauuguugaguaaagaaggcauuuucgacuauuauucaaaagucaaaaaaauaacagacgcuggcaagguuguggagaaaaagaaaugcuuauaccaacgcuguuaguagcaguguaaauuaguucagccauuguggaagacagugugaugauuucucaaagaccuaaagucagaaauaucauucaacccagcaaucccauugcuggguauauauccaaagaauauaaauuguuccauuauaaaauacaugcacacauauguucacugcagcacuauucauaauagcaaaaacuuggaaucaacccaaaugcccaucaaugauacaauggauaaagaaaaugugguacauauacaacacagaauaccaugcagccauaaaaaaagaaugagaucauguccuuuucagggacauggauggagguggaggccauuauccuuagaaaauggaugcaggaacagaaaacuaaguauugucuguucucacuuauaaguggcagcuaaaugaugagaauacauggacacauagaggagaacaacgcacacuggggcuuaucaggggguagaggguaggaggagggagaggaucagaaaauaacuaauggauacuaggcuuaauacuuuggugaugaaauaaucuguacaacaaacucccaugacacacguuuacuuauguaacaaaccugcacauccuguacaugcaccccuaaacuuaaaaauaaagucaaaauauaugcauggaaaaaaaaaaguccugccaaugccugaaacucaacauacuccaaauuaaauuuacccuauccuauuccaaaaagucaacuuuauuuucaaaguuuucuaaauaucccagauuuaaaugauucuuugauuccuaauuuuuuuuuucaccuugcauauuaaccagucacuggaacccaacauucauucauuuauuuuucuucacaacgucucucagauuaucuuuccuuucugcuuucgaggcaaaacagcauacuugaaaauccauagaggcugggcaugguggcucacaacuguaaucccagcacuuugggaguccaaggugggcagaucaccugaggcugagaguucgagaccagccuggccaauauggcaaaaccccgucucuaccaaaaauacaaaaauuagccuggcgugguggugcaugccuguagucccagcuacuuaggagacugagacaugagaaucacuugaaugcaggaggcggagguugcagugaguugagaucacaccacugcaauccagccugggugacagagugagacucugugucaaaaagaaaagaaaaggaagggaagaggaggggaggggagggaaggggaggggaggggagggaaaaucaagcccacacauaggaguuaauguagguccuggauuuuccauguacuaacagcaaagaaaaaaaaaaagaauucucaguagaggauuuccacuuccuuucuacuuucacaugacuguuccuauacaaaugcaccaacaauuuuauugaaaaugguuuuuuuuacauguaguauauuuaugugaucucuacuguuggaucucucuauuguguauguuuauacugaaccaaaucuuucagugacucuguucaugcuuuucacucauuucauccauuucucauuauuucauuauucuucccaucucaaaucaguaguaauauuucuaggauuuucauaauucaaagagagugaaaauauuccuuucgguucucuuaauuaauucuuccucaggaaaaaaaaaaaguugcuuuaguuuaagguuuuuccagucuagaaugaaaugaaucucaagaaaucucaaggaucuccaaugaaaggggagaacuugcacccccaccuugaaaauuacuucuuacgcaaugauuccauccauuacugauauauuguaucaugaaaauaguguuuauaaaaacuaugggaaauuuugaaaaaugcuuguuaacugcaaaagcagaauuccaaaguguuuacacagaugacauuagguagguagguagguaggcagauagauuacacagacagacagacagacagacagacagacagauacacacacauaaacucaugcauagaaaaaaaucaagaaaaaaucaucaacauaauuuuguugggauaauaugacuuguuguccuuucuuauauuucuccucauuuuucaacuucuuugaauaaucacauggcacauucaauaguuaaaaaaaaugaacauuuacuuugcagaauacuuacacaucaggcaacaaaauaucacuuucuuccaaaguacugaaauuucucugaaucuagcccuguagcuaaacaaaccucccugacaauguaauguucugguuugggagucugucuuuacaaauccaucacauaaacagaaccaaugacaaaaaccacaugauuaucucaauagaugcagaaaaggacuucaauaaaauucaacaccccuucaugcuaaaaacucccaguaaacuaaguauugauguaacauaucucaaaauaauaagagcuauuuaugacaaacccauagccaauaucauacugaauaggcaaaagcuggaagcauucccuuugaaaaccagcauaagauaaggauucccuuucucaccacuccuaugcaacacaguauuggaaguucuggccagggcaaucaggcaagagaaagaaauaaaggguauucaaauaggaagacaggaagucaaauugucuccguuugcagaugacaugauucuauauuuagaaaacccuaucaucucagcccaaaaacuuaagcugauaagcaacuucagcaaagucucaggguacaaaaucaaugugcaaaaaucacaagcauuccuauacaccaauaauagacaagcagagagccaaaucaugagugaacuccgauucacaacugccacaaagagaauaaaaugucuaggaauacaacuuacaagggaugugaaggaccuuuucaaggagaacuaaaaaccacugcuaaaggaaaucagagaggacacaaacaaauggaaaaacguuccaugcucauggauaggaagaaucaauaucgugaaaauagccauacugcccaaaguaauuuauagagucaaugcuauucccaucaagcuaccauugaauuucuucacagaauuagaaaaaacuacuuuaaauuucauauggaaccacaaaagagccugcguagccaggacaauccuaagcaaaaagaacaaagcuggaggcaucacgcuaccugacuucaaacuauacuacaaggcuacaguaaccaaaacagcaggguacucguaccaaaccagauauacagaccaauggaacagaacagaggccucagaaauaacgccacacaucuacaaccaccugaucuucaacaagccugaaaaaaacaagcaauggggaaaggauuuucuauucaauaaauggugcugggaaaacuggcuagccauaggcagaaaacugaaacugaaccccuuucuuacaucuuauacaaaaauuaacucaagauggauuaaagacuuaaauguaaaaccuaaaaccauaaaaacccuagaagaaaacuuagucaauaccauucaggacauagacaugggcaaagacuucaugacuaaaacaccagaaccaauggcaacaaaagccaaaauugacaaauaggaucuaauuaaacuaaagagcuucugcacagcaaaagaagcuaucaucggagugaacaggcaaccuacagaaugagagaaaauuuuugcaaucuauccaucugacaagggcuaauauccagaaucuacaagaacuuaaacaaauuuacaagaaaaaaaaacaaacaaccccaucaaaaaguggguaaaggauaggaaaagauacuucucaaaagaagacauuuauguggccaaaaaacacaugagagaaagcucaucaucacuggucauuagagaaaugcaaaucaaaacuacaaugagauaccaccucaugacaguuagaauggcaaucauuaaaaagucaggaaauaacagauaugggugaggauguggagaaauagguacacuuuuacaccauuggugggaguguaaauuaguucaaccauuguggaagacagugcagcaauuccucaaugauauaaaaccagaaauaccauuugagccagcaaucccauuaccaggcauauaccuaaaguauuauaaaucauuccacuaugacgacacacauggauguuuauuguagcacuauuuacaauagcaaagacuuggaaccaacccaaaugcccaucaaugauagacuggauaaagaaaauguggcacauauacaccauggaauacuaugcagccauaaaaaaaugaguucuuguccuuugcagggacauggaugaagcuggaaaccaucauucucagcaaacuaacacaggaacagaaaaccaaacaccacacauguucucacucauaaaugggaguugaacaaugagaacacauggaccuggggaggggaacaucacacacuggggccuuucagggguugggggaaaaagggagggagagcaugaggacaaauaccuaaugcaugcagggcuuaaaaccuagaugauggguugauaggugcagcaaaccaccauggcacaugucuaccuaugaaacaaaccugcacuuucugcacauguaucccagaacuuaaaguaagauuuaaaaaaaaaaacaaaacaaagcaaaacaaauauacauaaacauagauacacacuuaauacaaucagguaggcauauacugagugauuuuuaauguaaauuaaaucacaucaauauuuguuuaaaauccuccaauagccucucuuuugaauugaaauaagucagaacucuuuaccuagauguacaaaguccaauacaauuuagcuccuaaccaccucuuugaccucaaucccuaaugcuuuccauaacucacucuagggcagcuccuuuggcuucauuugugcuucuuucugccuaauagagauuuucugauggcugaccccuuccugucauuagguaucaacucaaacaucaccuucccagggaggccuccauuuacuacacagucuagucugucauccauuucuuuuccccagcacuguuuccaucaccuuuaaaagcuuuuguauguauaaggacaaaacacugcugaaagaaauuauagaugacauaaccaaauggaaaaccauuccauguucauggauugaaagaaucaacaucuuaaaaucucuauacugcguuuuuuccccaacaggguugauuagaggcuuuuagcacgccucaguaacuuggaaguagcauaaaaauagugcauaaaaaucaacucuggggacuuuaauucaagaaggaaaaugggaauccucagcauucgugaaggacacccaagaucccugggaggagaaugcuggccaacagcuuccaugacagcaucuggcugacaaaaaugagugaagccccaguaugugagagaggcagagaacuucccacuguaacucaucuuuccacugaggauuggagcaaccccaacugagaaagagcacuuuguuucucccaagccuuggaaauaacuugggaaggggcuuagagacauugugagcgcaagacaccaggaaauacugcagacauuuucccagacccaggacugagagcaggauucuguuuuuaauucgagugcauacuaagucaagcuuuucuuugugacucagcagcauagccaugcaggcauuuuagucucaggccggagauuggaauggcugcucuggaacaggcuaggaaucuccauaaccagagcugugaaaagcaccucaguagucggcacuggaauuguacucuacccugucacaacccugugguagaaggagagcugcuacagcugcaguuucuccugggugaugauacuugcagacagggcuggcuuggugaccugcugugugugugccauuguugggugcuccagccugcuccccugaguucauggugcagcaggacccucucugccucauacccaggcagaaauucaggcauucagagcacacccucacauggacccacagccugagccaccccacccuucaugaguauagaucaugaugcaucaggacccucuccacaccaugcccaggcagauuuccagguauucagagcacccccucacucaccugaaucagcagccugagccacccuacccuuccugugcauagacuuagauacaguggggcccucucuauuccuaauguggccagaccuccaggcauuuagagcaccgauucacaugaaacagcagccugagacacccuagucuuccugcgcauagaucuggguacaggaggcucucucugcuucacacccaggcagaucuccaggcauucaccugguucagcagccugaaccuucccacccuuccugggcauagauuguggugcagcacggcucucucuacucacguccaggcaggucuccagacauaaaggauaccugcucaccgagaucagcagacugacauguucugugcuuccugugcacagauccuggugcaggaggcccucugcuucaugcccaggcagauuucuaggcauucugagaaccuauucuccuagauuaggaguuuaggcugcccucaucccccugcagagaacuuggggcugaggagguuucccaacuccacaccuaggcccauuucugggugcuuggaggccacccacuggauucuugcuuggcacugguaccugugccugccauuggaggaccuguuggcagaccugccuguuccaguaccaucuaucuuaccccucuagagcugaggagggagcucagaccacugugcacuccacacauucacccauugccuaagacaaaagagagcuucucccaguaaacagggaucaaguauacacccagcuacgguggccucagcuggcuguuaccuauaagcgccaucuacuggcuuguagguugaacugcacagcccaauauaaacccugccaacagaagagcacagggcuguagaagcaaagccaaaacacccuacccaguauucucuacagucacaccccuuagggagaugggaaagggaaaaggacauuuugaaaauaauauuacagagaaaaaaagaagagaaaauccuagaugcaugagaauaauuacaaaaauuugaagugccagcaucuccagaugagaaagauucuggcaccaugaaaaaucugaauguagugacaccaccaaaggaucacacuagcucuccagcaauggucccuagccaaaauggaaacucaaaagugacagauaaagaauuuaaagcauugauugcaaagaagcucaacaaaauccaaaacaaaguugaaaaucaacacaaauaaacuucuaaagcaauccaaaaaauggaggaauagauaaacaucuuuaaaagaaaucaaucagagcauuuggaauugagaaauuugaaauugaaaggaauugaaauacuuucaagagaaaauuucaaaauacaauugaaagcuucaccaauugacucgaccaagcugaagaaagaauuucagagccugaagacuggucuuuugcacuaacccaguuagacaaaaacaaagaaaagagaauuuuaaaaaaugaacaaagucuucaagaaagauaagauuauguaaagugaccaaacccaugaauuauuggcauugaugagagagaaagagaaaaaguaaacaaugugaaaacauauuuaagggaauaacucaagaaaauuacccuaaucuugcuagagagguagacaucuggauagaagaaacccagagaacaccugcaagauacuauacaaaaugaacaucaucaaggcauauagucaccagccuguccaaagucaacacuaaagaaaaaaucuuaaaggcaaauagucagaucacauacaaagggaaccccaucaagcuaacauagacauuucaguugaaaccuuacaagccaguagagauacaggccuauuuucaacauucuuaaagaaaagaaauuccaaccaagaauuuaauauccugccauacuaagcuucauaagcaaaaaagaaauaaaaccucuuccagacaagcaagcacuaauggaauuuauuaccacuagaccaaccuuacaagacauccuuaaggaaguucuaaacauggaaaugaaagaacaauaccugcuaccacaaaagcacacuaagguacauagccuuuagacccuaaaaagcaagcacacaauagaaacuacaaagcaaccagcuaauuauuucacaauaagauccaaaccucacauaccaauauuaguauugaauauauauugucuaaauaccccccacuuaaaaucacagagaggcaaauuggaaaaaaaaaaaaaaaacaagacccaucugucugcuaucuucaagagagacaucuuacacauaacaccacccauaagcucaagguaaaggguuagagaaagaucuaccaugcaaacagaaaaugaaaaagagcaagggucacugucuuuauaucaaauaaaaaagacuuuaaaccaacaacaguagaaaaggagaaagaagggcauuacauagugauaaaggguucaauucaugagaagacuuaacuauccuagauauauacacacccaacauugaagcaucuggauucauaaaacaaguauuucuagagcuacaaaaagacuuagacagccacacaaugaaaauaguggaggacuucaauaucccacugacagcauuagacagaucauugaggcagaaaacaaagaaauucuggacuucaauuugacacuugacuaauuggaucuaauaugcuucuaaagaauacuccacccaugaaccacagaauauacauucuaccugucuacacauggaacuuacuccaagaucaaccacaugcuugaccagaaggcaaauaucaauaaaaacaaaaauuugaaaucauaccaaccauacccauggaccagaguggaacaaaaauaaaaauuauuauaaugaucucuuaaaaccacacaauuacaugaaaauuaaauaacuuucugcugaauuacuuuuggguaaauaacaaaaagcagaaaucaaaaaauuuuccugaaauaaaaacagacacaacauaccaaaaucucugggaugcagcaaaagcacuguuaguaggaaaguuuauagcacuaauugccuacuucaaaaaguuaaaaagaucucaaauuaacaauguaauaucacaccaagaggaacuacaaaacaagaacaagcuaaccucaaagguagcagaaaacaagaaauaacuaaaaucagaacagaaugaaauaaaagugagaccccaaaagucauaaaaauaaucaaugaaaccaaaaauuguuuuuguaaaggauaaaggauaaaaaaaucaauauacugcuaaacagauuaacaaaaacaaagagaagaacacaaugagaaaugacaaaggugacauacaacugaucccacagaaauacaaaagauccucagagacuguuaugaacaguuaugugcauacagguguaugcacauaaacuagaaaaucuagaggaaacugacaaauuccuagaaacacacaaccucccaaaauugaaucaggaagaaacugaaacccuaaacagaacaauaugaaguuccaaaacugaaucaguaagaaaaaacuuacccaccaaaaaagcccuggaccagguggauucacaccuaaauucuaccagacaugcaaggaagagccaguaccaauucuacugaaacuauuccaaaaacucaaaaaggaacacugcugccuaucucuuucuaugaaaccaguaucaccaugauaccaaaaccugucaaagacacaacaauaacauaaaaguaaaaacuacaggccaauauccuugccaaacauagauguaaaaaugcucaacaaaauacuagcaaacugaauucaccugcacaucaaaaagcauuuuaccaugaucacacagacuucauuccugggaugcaaaguuggcucaauauauauaaaucaauaauuguaauucaccacacaaacagaauuaaagacaaaaaccauauggucaucucaauagaugcagaaaaagcauucaauaaaaucuaacaucucuucaugauuaaaaaaaaauccaucaaaaaacuaggcaucaaaggaagcuaccuuaaaauaaugagucaucuauaacaaacccacagcuaacaucauucugaacagggaaaaaauugaagcauuuuccuugagaacuggaaucauacaauaauggucacucucaccaccccuauucaacauaguacuggaugaccuagccagagaaaucaggcaagagaaagauacaaagggcacccaaauaggaaaagaagucaaacucucuucuuacugacgauaugauccuauaccuagaauacccuaaagacucugccaauaggcucauggaacugauaaacggcugacaaaguuucagaauaugaaauuaacauauaaaacuuacuagcauuucuauaaaccaauaacauuuggcucuuaucugagagccauaucaagaaugaaaccccuuuuacaauggucaccaaaaaauaaaauaccuaggaauacaucuaaccaaggaggugaaagaucucuauuaggaaaacuauaaaacacugccuaaagaaaucauagaugacacaaacaaauggaaaaacauuccacgcucauggauuggaagaaucaauaucauuaaaauguccauacugcccaaagcaaucuacauuuucaacgugauuucuaccaaacuaccaacauuauuuuucacagaacuagaaaaaaacuacucuaaaauucacauggaaccaaaaaugaggcugaauagccaaagcaauccuaagaaaaaagaacaaaguuggauacaucuuauuacccaacguugaacuaugcuauaaggcuauaguaaccaaaacagcaugguacucuuacaaaaauagacauauaaaccaagggaacagaauacagaacccugaaauaaagccacacaucuacagucaucugauucuugacaaaucaacaaaaauaagcaagggugaaagcuccucuuauucaauaaauggugcuggaaaaauuggcuagccaugugcaaaagauuaaaacuggaacccuacuuuucaccauaaaacaaauuaacccaaaauggauuaaagacuuaaacguaagaccucuaauugucaaaauccuagaagaaaagcugggaaacuacuuuuuagacaucagccuugacaaagaguuuauggcaauauccucaaaagcaauugcaacaaaaacaaaaguugacaauugagaccuaauuaaagagcuucugcagggcaaaagaaaacuaucaacagagcgaacagacaaccuacaaaaugggagaaaauauucacaaacuaugccucugacaaaggacuaauaucuagaaucuauaaggaacuuaaaucaacaagcaaaaagcaaauaaccccauuaaaaagugggcaaaggagaugaaaagacacuucucaaaggaaugcauacaaguagccaacaaacaugaaaacaaaaaugcucaacaucacuaaucaucagagaaaugcaaaucaaaaccacaauaaaauacuaacucauaccagucagaauggcuauuguuagaaagucaaaaaauagcagaaguugaugaggcugaggaauaaagggaaugcuuauacacuguaugaauguaaacuacuucugccacugugggaaacaguugggagaguucucaaagaacuaaaaauagagcuaccauucaacccagcaaucccauuauuggguauauaccaaaaggaaaauaaauugcucgaccaaaaagaaaccugcgcucauauguuuaucacagcacuauucacaacacugaaaacauggaaucaacccaggugccuaucaaugguaaauuugauaaauaaaaugugauacauauauaccaugggauacuaugcagccauaaaaaaaagaauaaaaucauguccuuugcagaaacauggaugcagcuggaagucauuauucuaagcaaauuaaugcagaaacagaaaaccaaaugucaccucuucucauaaagcgggaguuaaaucuuggguacacaugaacaaaaacaugggaacagcagacacuggggagggaaggagagagguggguaaaggcugaaaaacuuccuacugguugcuauguuuacuauaugggugauaggaucaaucauaucccaaaccucaauuucacacaauauauucuuguagcaaaucugcacauguaccccgacucuaaaauaaaaauagaaauuuuaaaaaaacuguacauagcaccuaucauuaucaagucuccuugcuuauuucuuuacuugccauuguuugucuccacuccuagaaugcaaaauuuauaucacugcauccuucuuacuuaaaacagugucugauacauagcaagagaacaauaaauaaacauuaaaggaauagcaacugaagaaagacagugauaagaauaguaguuguccaugauacaaauguugguuuuaggauucucuuuaaaaacauacauagcugauuuccagucuuaccaacuucaugauaacaaugcagcugguguaacuuaauauaugcaaauaaauauaaauacuucuggaaaaagucaagaaguaaagaaaacguucacaggagaggaugagaauauagagguuuugcuuaucacagagaguaguaagaaaagaaauggaaauugaguccaaugagaguaauaaaaggguaaugauaguagagaauugguuucuagugguggcugagguauaauaggauuaguccagaaagucuccuuguggaacaugggcacuugguucuaugcuuuggucugccacacaucaggcaucuucuuagauagccccccaaggaauggcugaaacuagggcaucugugaucaucaacuaaaagauaccuaaaucuuucuaugagguguaugagacugcuauauugacuauauggugaucuguuuucuucuauaucaaaaugaaaugcucuaaccugagaaaaacagguuacaugaagaacuaaaacauauaguuuuuaguuuucugggcuaaauauauguugcaaaaauacaaaaccauuuaagagcaaauuacaaauuuaauuaucacaaaacaaccagccccuaaaauaucaccuuuucaauauauuuuaaguagccagcgguccaccauugccaugaaaaaugguacaucaaagguauuuaacaugcuguaauuuauucuccacuuccaggugacaaugacaaauugcucaaguucccuccuuguucuuugcaucaucacuacauguuugaaaaaucgauauaucacuugcaaccaaggauuacaaaugcagcccacauccuuucacuuucuuuuuucuuuccccaucuaucagagcauuucccucuaaucauugcuuaccuguucuuuccucuccaucuuuacuuguucucucccugagaccauauuccaucuucuucaugaccaccccaaucuuuuaccucacacucaacaaagcaauucuuuacccaccuuuauaauaggucaagcugcuagccaugaggaggccacagggccugacuggcauacauuggggcgaauggaaaaccauccugggaaucuaggguuugguaaggagcaagauaucaggaaagaggcauaugagaaagaagaccauggacagggccugagcagcacuagaccgcagggucaaucagagaggucagguguauuaugauccgaaggcacauaaacacaccagaaauaaagaacaagguuggugaugucuuucaucuuucuaugauuguuucucccuucuauuauaaaauaugcacuggccauucaaaggauauaauaaaauaauagacaccacuuucccuuuucucucacaaauucccuuauaaucccugauaauuuuacaugcuuucagaauguuagcgccugauaaguaaaacaaaauuucaguuuggccacagacucaaagcaagaaauaggacuccuugaaguugauuugaaauaaauauagcuauauuuuugcugcuauagcaacuauaaaauagaacuauuuauugacauaugcagaaaacaacauaacauuuuauuaauacacaauugagauguucuuuaccuuuuuauguuuacuuauuaauggguuauuagucauuauuagaacauuuacaugauagaguaguaauuaaaacaaaaagagaaauugaaugcauccuuuagcuauaauaaaggcuaauguuuauuaugugccagguuuucuguuaggcacuugacaauuaucaguucauuuaauccucacaaagcaauguaguauuggaauuauccucauuuuacagauggggaaauggagggcgauucagagaaauugagcauauuguuaauaagugauacagucagaauuaguacccagacugccaaacaacucacauuugccaaaaagcaaagaugcuuuuuacacuauuccagcauaucucccuacaaugacaccaaaggaaacuucagaauucaacaaacauagccugagggccugcggcaugcaaugcacacagcagagugugcuggagaucauaaacauuugucagaaacaaauguuaucaucuaaaagaagagauaaaacauguauauaaacagcuauaauaaaaggcagaaagccacaguuaucaaaaagaaauucuuugcauguuaagagaaaggggguuauuucugguggagaggauuaaauaagacuuuaggaaggaaauggaccuuaaaguuuauaaaauuaauaguuuugcaccaacuacuugcucacugacauuaggaagaaguacccaucucgcauuccacaaagaacguacagucauguaucauuuaaggaugaggauacauuuugagaaauguggcauuaggugauuucaucguuguaucagcaucacugaguacacuuacacaaaccuaaaugguacagccuacuacacaccuagguuaugguauggccuauugcuccuaggcuacaaaccugcacagaauguuacuacacugaauacuguagacgauugucuacaguauuaaccauuugcaugucuaaacaggggaaaggugcaguaaaaauacaucauuauaaucuuaugagcccaccaucauauacacagcacuucauugacugaaagguaauuaggcaguuccugaccacgucucauuuagaaauuaguuucuaaaaauccagagugguucuacaccaauccuaaucugguuucuguuucuaagaaauguguuuaaguuaaacaucuaaaaaaaauuucugugaaauuuugagcuuugagcuuaaaagucugaaaacuuacacucuggauucugguuacaugugaaaaauacuuuuuaaauuauuguccacagcauuguugccuuuuuucuaagcuuucguuuuucuguacaggauaaaacauuuucucaucugaaaauauuuccaaauagacccuuauugccuuaaucuguuuuguguugcuauuaguauaacagaauacuucagacuggguaauuuauucaaaaauuagagauuuauuuggcucacaguucuggaggaugggacauccaaagucaaggggucccaaucuugugagggccuucuugcuguguuaucccaugguggaaagcaucacaauggugagagagcaagagcagagggagccaaacuuacuuuguaucaggaauccauuccugcaauaauagcauuaauccauucaugagggcagagcccuuguaaccuaaucaccucuuaauggucccaccucuuaauacuuaauggguaggacauucaaauauuaguacauauuaauguggaucuuauuaucaguauuaggauucuaauuuauuuauuuuguagaccugaggucagccaacuucaacaaaaauccauccuaccacuugcuuuuaugagaucuuauugaaacacagcuauguccguucauuuucauauuaucuauggcucaugauacaauagcagaacuaagcaaugugacagaggccauauagcacucaaaacccaaaauaguuaccaucuaaccuuuuacagaguugcagaccuuugccauagaccauccauucacucagcaaguauuuauuaagagcuuauaagggcagguggcugguagguagcuagcauagguuguuggcugaaaaacuguagccucauuaaacuaaguuaaaaguuaauucauacugaauuguauucuucaauauaauuaucuucacauacgagaaaaaaacuugaacaacuuuuccuguggaaaaaaauguacuaagugacuuggaauguaauauuacuaggagguacucuacuauuacuacuuacacuauugaguaacacuuauugagcauuuacugugugcucaacacuauuauaaacacuuaauauaaauaguauaugucauuauuccucacuacaccucuaggauguaagugcuguuacuauccucacuuuacaaauggugaaauuaagacucaaaccaauuaauuucugaggucacacagcuuauauuuguuaaagcugggacuuuauagaagaugcuuucauucuuggagauauuaaaauaagagaguggauaacuuauuaaaaagguaaaaugguguaccuuuuuaaggggagcaaaauauaaauaacuaccauuuacugagagccuacuauaguucugucauuaugcuaugugcuuuaaaaacauucucuaauuuuuauaucaacccuucaagguagguauaaguucccucuuuuacaagcaaugaaaaaauaauagguuauaugacugacaaaagguacauaccuuguaaguugcaaaacuaagguuaaaauuuagaucuaccugucuuguucuagaauacaugcuaaauucuauuuuuuaaaaaauccuagguguauuuuucuaauucuugaaacugaacugcacuuacaaaugaaagcaacagauguucagcagcugaacaaugaaauaucagauaggacaaauaaugaaaauauaaccuacacaacuaaaauagcagagaaaaauauagaaauaugaagcauauuucuauauguaaauacagaauuuguuccuaaugguagccaggauucaaaucagaauaagcuacaauagaaauuucugaaggcacuaaaauaaucugaaaucucauuaauucauucucuaauaaagcacugaugcauugacacuuagcagauaucucuguuguaaucaguuauccccguuuccaugggagaaggggacuggucaacccauuuccauauuuuugcugaagaaacaucuaaagaugugaacaauacccuucucuuagauaugauugaauaauaaagaaaaaaaaagaggggacucugggcuuuaggaccaaagagaaauaaguugguauauucaccucugcugcuucauaacugugucaccacaacaagcuaauugacuucucuguaacugaguuuucucauuuaaaaggauguuuaugagagaugcuguagaaaagcaucaggcaugcccucuuaaaacacaucuaagggaauuauuauucuuucaguuguaaucacuuuucucaaggaagaucuuuaagagaaaauauuuucucacuuauucccuuuccuaguggggaguaacaggagcaagacucacugugugaugccccgcguugccuugggacucuacagcacguccuuaccagcaagaaggcucucaccagcucuggccccuugaccuuugauauguuuggcugucucuccacccaaaucucaucuugaauuguaguuccuacaauucccaugugucaugggagggacccagugggagguaauugaaucaugggagcgggucuuucccaugcuuuucucaugauagugaauaagucucaagagagcugauggcuuuauaaaggggaguucuccuguacaugcucucuugccucaugucucauguaagacaugacuuugcuccucauucgcccuccaccuugauugugaggccuccccagccauguggaacuaugagucaauuaaaccucucuccuuuauaaauuacccagucucggguaugucuuuauuagcagugagggaacaaacuuauccaaucuuggacuucucagccuccagaaccauaaaauacaaauuuauuuucuuuauaaauuccccaguuucagguauucuguuauaaguaacagaaaaugaauuaauacagaaaauuguuaccgagaaguggaguguugcugauaaugaauaacuaaaauuguggaagcagcuuuggaacuagauaaugggcagaagcuggaagaauuuggaggagcaggcuagaaaaagccuagauucuggugaggguuuagaagacaagacaacuagggaaaguuuggaaguccuuagagauugguuaaguagucaugaccagagugcugauagaaauaugcacaguaaaggccauuucgaugagguuucaaauguaacugaggaacaagggaguggaaaccagagcaaaggucauucuugucauaaaugggcaaagaacuuggcugaacuauguuaaugcugagggcuuuggggaaggcaaaaaucaacagugaugaacuagaguauguggcagaagaaauuucuaaguaaaacauaaaaguugcugcaugguuacuuuuggcugcuuacacugagaauugaaagcaaauaauaacuuaaagaaagaauuuauaaucaagagagaaggagaauugaaagauuuggaaaaugcucagccuaaccacauaaagaaugaaaaaauguguucaggagaggaaaccaaggguguagcccagugaccacuugcaaaagagauuacuacacacaaaagggagccaggugcuauuccucaagaaaauggaagaaagacccagaaagcauuucagaaaucuucaaggcucucccaucacaggcucaaaggcugaggagaguagagugguuucacgggacaggccuggggugcucauugcccagguccaacuugugacuuugcuccccacacccuugcauggugcuccaugguugccccagccauggcuuaaguggucccaggugcagaucaugccacaguuccugaugguacaagucauaaacuauagcaacauccauauaauguuaauucuguaggcuugcagaaaacaagagcuguggaggcuuggcagccuccacccagauuucaaagaaugucaucaaaagccuggggucucaggcacagacuuguuacaggaaaggagugaccacagacagccccugcuagagcaagaaaaaguggaaaugugggguuggagcugcugcagagaauccucacugcauagggcaguaccuaguggagccauaggagcaaaaccaccaccaaaaugccagaacuauacagcugccagcaugcaauccuagucgaggagagcugaagcaugagcuaagcccaggaaagccacaaaggcaggguuuuucaaggccuuggggacuuaacccccacaucaguuugugcagaaugcuagucauggagucaaaggagauuauuccucacccuuagauuuaaugucugcccucuuggguuucagacuuguuuggggccuguuacuccuuucuuuuggccugugucuuccuuuucuuucuauauauauauauauauauauauauauauauauauauauauuuuaauuauacuuuaaguucuaggguacaugugcacaaugugcagguuuguuacauauguauacaugugccauguugguguccugcacccaguaacucgucauuuacaucagguauaucuccuaaugcuaucccuccccccuccccccaccccaccacaggccccagugugugauguuccccuuccuguguccaaguguucucauuguucaacuuccaccuaugagugagaacaugccauguuugguuuuuguccuugcaauaguuugcugagaaugaugguuuccagcuucauccaugucccuacaaaggacaugaacucaucauuuuuuaugucugcauaguauuccaugguguauaugugccacauuuucuuaauccagucuaucauuguuggacauuuggguugguuccaagucuuugcuauugugaauagugccgcaauaaacauacgugugcaugugucuguacuacaaggcuacaguaacuaaaacagcaugguacugguaccaaaacagagauacagaccaacggaacagaacagagcccucagaaauaauaccacacaucuacaacuaucugaucuuugacaagccugacaaaaacaagaaauggggaaaggauucccuauuuaauaaauggugcugggaaaacuggcuagccauauauagaaagcugaaacuggaucccuuccuuacaccuuauacaaaaauuaauucgagauggauuaaagacuuaaauguuagaccuaaaaccauaaaaauccuagaagaaaaccuaggcaauaccauucaggacauaggcaugggcaaggacuucaugucuaaaacaccaaaagcaauggcaauaaaagccaaaauugacaaaugggaucuaauuaaacuaaagagcuucugcacagcaaaagaaacuaccaucagagugaacaggcaaccuaaagaaugggagaaaaauuuugcaaucuacucaucugacaaagggcuaauaucuagaaucuacaaagaacucaaacaaauuuacaagaaaaaaacaaccccaucaacaagugggcgaaggauaugaacagacacuucucaaaagaagacauuuaugaagccaacagacacugugucuuccuuuucuaauggaaaugucuaccauaugccuguauaacaccacuguaucuugaauguagguagcuuguuuugauaucaugagacuaugaauuuuggacauuuggguuggugcuggaacaaguuaagaauuuggggcuaugauguggaagaaauggauuuuuaugugagaaggacaucaguuuuggagggccagaagcaauauacuaugguuugaauauuuucccauuucaaaacucauguugaaauuuaaucuccaauguggcaguauugagagaagaggcauuuaagagguguugggucaugagaacagagcccucaugaauggauuaauacauucaucaauuaauagaugaaugaguuaauggauuaaugggcuaucaugggagugggacugguggcuuuauaagaagaggaagagagaccugagagagcacauucagcccccucaccaugugaggcccugcaccaccuugggucucuacagaguucucagaaggcucucaccagauguagccccuugaccuuggacuucucaaccucagaacuauaaaaaauauauuacuuuucuuuauaaauuacccaguuucaaguguucugauauaaacaacagaaaauaggcuaauauaucuauuuaaugcauaaaaagagacuugaaaacagaaauuuauaccaugucccugaguaaaauauuaaauguuguaaaaugcuaauuuuauccuaaauaaucucuaaauuugcuauucuuccaaucaaaaucucaacagguaaaaucuaaaacuguaaaacucuuagaagaaagcagaaaagcuuuaugacauuggauuuggcaaugauugcuggguuauaauaacacuaaaagcacaagcaacaaaaguaaaaauuagauaaauuggacuacaucaaccuuuaaaacugugcgucaaggggacacaaucaacagaguaaaaaggcaaucuaugaaaugggagaaaauacucuuaaaucacguauauaaagugauuaauauccagaauauauaagaaacuccuacaacucaacaaaauaacccaguuaaaaaauagaaaaaagacuugaauagacacuuuuccagagaagauauacaaauggucaacaagcacaugaaaagaugcccaacaucacuaaucauuagggaaaugcaaaucaaaaccacaaagagauguuacuucacaaccaucaggauggcuacuaucaaaaaagcuaaguaaguguuggcuaggaugugaagaaauuggaauccuuguguaucauugguggaaauuuaaaaugaugcagccacuauggaaaacagcacugcaguuccucuuaaaauuagaaauagaauuaccauaagauccagcaacuuuacugcuugguaugcauccaaaagaauuaaaaacagaaucaaagagauauuuccaaacccauauuauagaagcauuuuucacaacagccaaaagguggaggcaaccuaaguguucacugacaaaugaauggaucaacaaaauaugguauauacacacaauggaauauuauucagccuuaaaaagaaaaaucgugucauaugccacaacauagaugaaucuugagaacauuaugcuaagugaaauaagccagucacaaaaagauaaauauuguaugauuccacuuaguugagguaucuagaguagucaaauuccuagaaauaaaaaguagaauggugguugccauugacagauagggggaggaauaaauagaaaguuuuguuuaauggguacagaguuucagauuuccauaauaaaaaaacuuuggagacugauuagacaauaacaugaauacaauuaccacuauugaacuguacacuuuaaaaauaguuaauauggaaaauucuauguuacguguaucuucacaauuuuuuuuaaaguucaguaggguaauuaugcaaauguaacauuuaaaaucaauagaggaagcuggauuauucgauaaaugaugcuaggacaacugaucauuaauuuggggguaggaaggaaccauagauaaauuauaaaucugaaaauaaauaaaacuauacgaagaaaauaagguaaaauauuuuauaauuguggggcuggucaaggucagccuaagcaagauacaaaauccagaagcuuuaaguaaauacacagauagaacacuucauaaaaauuaaaacuuuuacaccacaaaaaaaagauaaauaccaagaaacaggcuggaaaaauacuuuuaaaauauuuuuaacagacaaagucuguuaaauauauuugaucuagaauauacagucuagaauauagaauucuguuuggucuagaauauacagucaauucuugcuuucacaguaauuuuauucaauaaagccaccaugaacaccaaguuaguaaauacuaaaucauugcuccuaagagaaugcagguuuagauuccuggagccucuggucacaauauuuuuaucaacugaucaauacaaaaucuuguuuuguauaugcuucuguuuaaagacaacuuauuuaacauauauuguugauuuauuaacauugaacucacagccaugaguuccacaauauaacucauaccucagugaagcuuaucugacacauagauuuucuccauaagcuacaucacuaguguuucuuaugccucuagaaacacuagaaaguacuucagcacuacacuggaggccauuuuaaacagugaaaugcccaaggaaaaccagaaaauuuuuuuuaaaaaacuggcacuaaauagaauaugaaaaggacacuuguuucuuguuuacaguaugagaacugaaacaagaaggcagaguguugucuuguucaaccucaacugggacucaacugggaacaugugcaauuuuccacugcucugugcacguccaugaaugagaagaaccaugaaaacaaagaaccauuuaugauuacaaauuuuagcaaauaagugaauuuccaaauauggcauccacuaguaauaagaauuuaauguuuuaaaauacacuucaaaaucaauucuuugaaaaauauaagaaguaaaaauaauuugauucacaugagaaaaaauacaauugccucaaaaaucuaaagggaaacaaaaguuccuucucacuaauaaucaggaaaaugugacuucagucaacagugaugaugauggccgggugugguggcucacaccuguaauccuugcacuuugggaggccaagguggguggaucauuugaggucaggaguucaagaucagccugaccaacauagugaaacccugucucuacuaaaaauacaaaaaagaaaauuagcugggcauguuggcacaugccuguagucccagcuacucaggaggcugaggcaggagaaucacuuuaaccugggaggcggaguuugccaagaucgugccacugcacuccagcuugggcagcaaagugagacuccaucucagaaaauaguaauaauaauaauugauaccucugauaugguuuggcuguguccccacccaaaucucauauuggauuauaguucccauaauccccaugugugaugguuaauacugaaugucaacucgauuggauugaaggaugcaaaguauugauccugggugugucugugaggguguugccaaaggagauuaacauuugagucagugagcugggaaaggcagacccacccuuaaucugggcaggcgcaaucuaaucagcugccagugcagcuaggauaaaagcaggcagaagaacgugaaaagaauaugcuggcuuagccucccagccuacauuuuucuuucaugcuggaugcuuccugcccucaaacaucagacuucaaguucuucagcuuugggauucagacuggauuccuugcuccucagcuugcagccuauuguggggccuugugaucaugugaguuuaacacuccuuaauaaacuccccuuucuauauauauauaauauauauauaauauauauauacacacacauacacauacacggagagagagagagagacauaaagagagaaaaaaagagagagagauccuguuaguucugucccucuagacaacccuaauacaccaugugucaugggagggaccuggugggagguaauuaaaucacggggaugguuacccccauccugcuuuucucugacagugagugaguucucaugagaucugaugguuuauaaggguauuuuucccccuuugcuuggcacuucuuucuccugcugccaugugaagaagaacauauuuguuucccuuucugccacgaacuaauauaguaaauugguaacacagagagugggggacugcuauaaagacacacgaaaaugugaaagcgacuuuggaacuggguaaccggcagagguuggaacaguuucgagggcccagaagacaggaaaaugugggaaagucugcaacuuccuagagacuugagggcucagaagacaggaagauauggggaaguuuggagcuuccuagagacuugcugaauggcuuuggucaaaauguugauagugauggacaaugaaguccaggcugaggugucucagauggagaugaggaacuuguugggaacugcaauaaaggugauucuugcuaugcuuuagcaaagagacugguagcauuuugcuccuguccuagagauuuguagaacuuugaaugugagagagaugauuuaggguaucugguggaagaaauuucuaagcagcaaagcauucaagaggaaagagagcauaaaaguuuagaauauuugcagccugacaaugugguagaagagaaaaacccauuuucuggggagaaaucaagugacugcagaaauucacauaagucacaaggaaccaaauguuaaucaccaagacaauggggaaaaugucuucagggcaugucagagacauucacagcagccccuccaaucacagguccugagaccuaggagggaaaauacgguuuccugagcuggguccagggucccccgugcugccucacaacuuggcgcccugcaucccagccacuccagcccuggucuaaaaggugccaagguacagcucgggccauaucuucagagggugcaagccccaagccuugguggcuuccaugugguguugguccugcagguccaacagaagacaagaauugagguuugggaaccuuugccuagauuucagaggaugcauggaaaugccuggauguccaggcagaaguuugcucuaggggcagaguccucauggagaaccucugauagggcagugugaaagggaaaugugggguuggagcccccaaacagaguccccacugggggacuaccuaguagagauuguuuuagaacuuaaagguuuaaugacuacccuauuggauuucagacuugcacggggccuguagccccuuuguuuuggccaauuucucccuuuugaaacagguguauuuacccaguaucuguauccccauuguauacaggaaguaacuaacuugcuuuugauuuuacaggcucauaagcagaagaaacuugccuugucucagguaagacuuuggacuguggacuuuugaguaaaugcugaaaugaguuaagacuuugggggacugcuggaaaggcauaauugauuugaaaugugagaacaugauauuugggagguaccagggguggaaugauaugguuugcuuguguccccaccaaaaucucaucguggauuuuaguucccacaacccccacgucaugggagggacccaguuggaggcaauuggaucagggacaguuacccccauccugcuguucucauaauagugaaugaguucucacgagaucugaugguuuuaaaaggggcauuucccccuuugcucggcacuucuuucuccugccgccauaugaaggauguguuugcuucccuucaaucuugauuguaaguuuccugaggcauccccagcccagcagagcugugagucaauugaaccucuuuccuuuauaaauuacccagucuugggcaguucuucauagcagagugauaacuuacuagaacaaccucuuaacaaaaauggucagauaggcugggcaugguggcucacaucuguaaucccagcacuuugguaggccaaggugggcggacuaccugaggucagcaguucaagaccagccuggccaacacagugaaaccccaucucuacugaaaauacaaaaauuagccaggagugguggugagcaccuaucaucccagcuacuugggaggccgaggcaggcgaauuacuugaacccgggaggcagagguugcagugagccaagauugugccacugcacuccagccugggugagagagcaaaacuccaucucaaaauaaauaaauaacuuaauuaauuaaaauaaaauaaaauuagacaaaaacgaucauacaaacaauucaucccacacugucuucagcuguccguacuucauccuccuuguagagcaauuuugaugauucaagacaagugaaucaaaaauaccuaaaaugauguugcuaugguuugaguguccccccacaaaacucauuuugaaauuuaacugcuauuuuaauaauauuaaaaggugagacuauuaaaagauaauuagaccaugaggacuuugcccucaugaauggauaaaugucauuauucuuggaguguguuugcuaugaaaggaugaguucaaccgucucucauucucuugaccucucuuacccucucaccuucugccuugggaugauguaggaagaaagcccuugacagaugccagcacccugauauuagacuucccagccuucgaaacugugagaaguaaauuucuuuucuuuauaaauuauccagucggugguauucuguuacagcagcacaaaauggacuaagacagguauggauugaaaugaaaaaugaacggaugaguggguagguagauggauggaugaauggaucaauggauaaauugguugaaugaguaaugaauggacagaugcaagcaauaacuugcaaacuauucuacaggaacucauggugccauaaggagucauuacgacuuuuuacaacuuauggcauuuauuuuuucagaaaauauaaaaucuuuauuagaaaaauuagaucugcuugucauaaauaauucaaacaauguuuaaguauauaaagcaggaaguuaaagucucccuugaaucuuaagccuuagaaauaaccacuauagcuguauacuauacauacuuccagauuuucugagcacauacaaauuaacauugcacauauuagaaugcacuuauuauaugaaguuguuuuauacuauacauacugccaauccuaccaaaacugacagagugaugucucugaaggccacaaacaaaacaauuuuuaaaaaugugcguuuguauuguaaauaauuuauagagaaucuugcauuuauauugaaagagcuucauaacaauccuacaaacaaacaggaacuagcguccucauuuuaaagaagcagcagcagagggugaguuacuugcccaagauuuuauggccaacaaauaauagucaggccaauuacuuuaacuaaauuauaaaguuucucagagcagaaaccacacauaauuccaguuuuguaucauuuacaguaccuggcacaaaauuauaaacagguaugaggaggguaugauguuuauauugcuuacugcucuaugccacacauauaacaaauggucaauaaacaucugugaaacaaauggauggaaagauguauaaaagaagaggaaaugggaagagauucuaaaugaacuaagauacuuaucaaaccaucauuuuuucaauuuggacaauaauaaauacguuuagcagcucauccacuccguaagcauaauacaacaugauaaccaauaucauugauaucaauaucaaaaugauaucaauugaauauacucuagauaagagugacaucaacaauuacugauuuccucuuuaacagugaaaugccauaguaaaaaauauugaacaguagacacuauacacccuuauuguugcuaaaagaagcuauuccgucuauuuuuuuaauuuuauaucaaauauucacauggaauuuggcucaaacacaauagauaugcaaacuauaaaaguauaaauaguccauagggacuaugggaaaguauaaauaguccauagaauuacugugaaauauaagugagacaaggaacguuaagugcuuaucacugcacuuggaaugugguagguacucaauaaguguuagauaucauuauuaacaucacuauuaacaucaucaucauaaggcuuuccuaaaaugauuaaaaaauugaggcuuuccaaaggcaaaauuauaguucauuuauuuuaaaaguuauaaaaauaacugcacaaaacaauaaaaaucuagaucacacaaaugcuugacaggaaagcugaaaugcauuuuucuguaaaauaaauauaugucccaucuucugccuagaugcagacuacaggcauauucuccuugagugcaucuaugagagaugaaaugucuacugaccuaauuucuguagcuauuguaucuguuucuuacagccacuguaacaaaccgccacaaacuuaguauuauagcuuaaaauaacaaaauauguuuucugacaguuauugggaucaaaaguuuaaaagacauuucacagggcuaaaauuaagguguuagcagggcugguuacuucuggaggcucuaaaagagaaucuagggggcaugguggcuuaugucuguaauuccagcacuuugggaggccgaggcaggugaaucaccugaggucaggaguucaagacaagacaggccaacauggugaaaccccaucucuacuaaaaauacaaaaaauuagcugggcguggugaugcaugccuguaaucccagcuacucaggaggcugaggcaggagaacugcuugaacccaggaggcagagguugcagugagccaggauggcaacagagcaagacaacaucucaaauaaguaaauuuauaaauaaauaaaaauaaaagagaaucuguucccugccuuuuucaacuucaaggggccaccuguauuccuuggcucauagccucuuccuccaucuucaaagcuagcaauguaacaucuucaaaucucugcuuuccucaucauaucacacuauaaguaccuucauaauuacauugggcacacauugauaauccaggauaauccccccccaucauaagauccuuuaguuaacaauauaugucccuuuugucauauacaguaacauauucauaggcucuacauacuagaauuuagacauuuggggaggagcauuaugcugucuuuaucacaguacauccucuggacaccaaauaaucacauucuuccacauauaaaauccauucaugccaucucaacgucccauaaaucuuaacccauuacacaacaucaacuuaaacucaaaaucucaaaaacucaaaagucccaaauuuccucauauaaaucaagcaugagucagacgcaucugugaaucugugaaacuggaauaaaaaguuauucgcuccuaaaauucaaugauaugacaaguguagcgaaacaauuauagauauccccaaccaaagagagagaaaugaaaaauaaaaagugagucaacaguccgaagcaauucagaacugcaacugggcaaacuccauuagguuucaagcccugggaauaauccuuuggaguucucagcucuacccucucgggccucagucccauccucugaguccuccuuucuauuccauaaagguuaacuuauguuugcaaacucaguaguuucauaagccuauuuccugccugcagaauuucaggaauccaacagccuucuuucauuuuauccucugucccuuuaaguccaagcuaccaaagucuccgcuaauaaaccauucaugaaaacacugugggucucccagguaugucacaagaauuuccuggauaaucccaacucugaaucccaucucagcguaauucaucucaucauaauucagaucugcucaaucucuucaaagagcccucugugugguugaauaaucucaguuuuugauccuccugaggcacuagaaacaaguuaucuagccaugcuuucagcuuucucucuaaguacacuucuugacagugaaucuaaaaauuucaguguuuuuugcaaucuggauagauugagaauguuccaaccaucaaguccugguuucuuugaguuuaaauguucuucucacaauuuaucucuuuccuccucccacauuucaguauaggcaacaagaggaaaccaggccauaccuccaacacuuuaucuagaaaucuacucagcaaaauauccaaguucaucaccuacuagaucugcuuugcacauaaccauagaauauaauuccucuagacuaucugcuauuauauagcaaguaucuccuuuccuccaguuuucaauaacauguuuccuauuuauuucugaguccuuaucagaagcaccuuuaacauucauauguuuauuaacauucucucuacaaugauuuagguauucucuaagaucauacaaguucucucuaccauuucccccgcuuucuucugaacccucacaguagugacuuuaacauccucguuuguauaaacauuauguuuaugacaauuagguaaucucuaagaaaauacagguuuucucuaccauaucacuucuuucugagcccuuauuagcggcaucuuuaauguccauauuucuguucaaggcaaucuaagcucuuuacaucaugcuccucaaaauucuucuagcuucuacccagugcccaauuccaaagccauuucuauauuuuuaugcaccuguuacagcagcacuccacuuccagguaccaaaauguggaauaguuuccuagggcuaccauuacaaauuaccacaaacuuaguugcuuauaacaacacaaauuuauucucucauaguucucaaggucaaagucuaaaaugauucucucugggcuaaaguuaagguauuggcagggcuaucuccuucuggaggcucacagggagaauccacuuccuguuuuuucagcuuccagaggccucuugcauuccuuugguccauggcugcaccacucugaccucuacuuccaucaucacauaucuucugacucugacccugcugccuuucucuuacaaagaccacugugauuacaccggacccccaacguaauccagauaacacccccaauucagauccuaaacugaaucacaucugcaaaguuccucugccacauaagguaauauauucacagguugugaagauuauaauguaaauaucuuuugggggaauuauucuguaaaccacagccauguucauuauuaacugauuucuguuuaaaauacuuaacccauauuuucaauuacauaguuuuaagcacuaacaccgcugauugccuaucuuacugaacuaauaucuugccauuuccucauuucaaacguugguucuuuuaaaaguuuugggaagacgaaauuuagcaagagaauaaaaucauauauugaauuaaacaauucccagagcaguuauacgaauaauaucucgauucauuguuaugguucagaguaucuccaaaguauguaguaguuuuguuguugggagagagggggaaagcuaaagcccuaucacaaaaccguaacuauucuggaguugaaagauagcucaggggucaucuccauuucaaggcugagaaaaauaaggcccagagagguuaaauuauuaacccaaugacauaaacuccaacagagaggagagaguauauaaauuuauuuuaauauaucuagugacuaacuauauagaaaucugauuuaacagcaaccacacagaaagcugcugcauuuucauaaaaggaauuucuuaaucucaaguucagguaguuuuuuauuuagcuaucugagcuucucaagucuugaggcaaaugcuaaaaagguaguuuucuaaacagcuagaggaauuucagacaaaccccaucaaauucauaaaaauagguauuugccagaaugcuacauaggaugguuaucaagccaaaugaaagagguuccaccguugucagucuacugacugguguggaaaauccaaacaucuauaggcucuauaaguaauguaguuucuggcuuccuuggagaccagcgcucuaauggaacucuaagacaaauaucuugucauauauguguauagcaaaaaaguacuuuuaagaaaaucaguaaaaaaaaaaaaaaaaggcacuuaaauuaaauuuugcuguguccaauacuaccaauccuguuaucccuuaugaaaaacaucagaaccacuuggacacuuuuaaaacguuauuuuacuaaauguguauuugguuucuugguuuugccaauuacaagauaaguaacauagacuugaaguggaaguuaagauauaaagacuuuaggaagggcaguaaaaagugcuauugauaugugaauaggcaucucaauaaauaaaauaaaaauacuccaaguauccaaaauaaucaaacauuucaauaugaaaggaagaaauuauguuugcauugacuuaugcaacuaaagacucaagugggcugggcacgguggcucacaccuguaaucccagcacuuggggggccaaggcgggcgaaucacgaggucaggaguucgagaccagccugagcaauauggugaaaccccaucucuacuaaaaauacaaauuagccgggcgugguggcacacgccuguagucccagcuacuaggaaagcugaugcaggagaaucacuugaacccaggaggcggagguugcagugagccaagaucacgccacugauuccagcccgggugacagagugagacuccaucucaaaaaaaaaaaaaaaaaaaaaaaaaaagacucaacuauggcuauggcucuguguguguguguguguuuguguucacauggguuaucauguguacugucauuucaauaaagauauuauaaucuuauugaauugaaaauauuugcaauaccuagcaaaauucuuuacagcuuuuuuuuuucucaauacaaucugaugguaaagaauagagcauaaaugugauguuuaaggcucuuuucauuccauagccaggguaugaaugucuagguaaaacucaaaaauugcaucaacaguuugagggugagucaaaacauaaaauuuaucauggcuauagaaacagaaaaaaaaaaauacauugccaauaaaauaguuauuuccccugguaacagaaauaaauuuccuaauaaaaauagaaguuaaaaagaaaaugaaaauuauaccuaagcacuuuaaacauuucacugaacauaauuccauauccacaaacacauacacguggucuuacauaaauugaaucucaccuauacuaugaguuugaaaucaguuuuucucuuauucuuuaagaaaaaaaaaggucagggauaucuuuucaugucaauaaauaggaaaacuacguaaucauuuuuagggcugcagacugucccgucacagaagcuccauaauuuauuuaagcaauccccuauuguaagacacuaaugcuguuuauaauuuuuuacucuacaacaaacauugauaaacauccuguaccaaucuguuuaccaauuuauccaauucucucuuuaaaauaaaugucuacaacuagaggagcuggauaaaugaguauacagagaauguauauuaaacucuugccuugcacagaaaauuuaccucuaacccuuuugaaagcaauuugccagaaugcauuaaggucccuagaugguagguugguggcgggguaguggucugcugagcuguggagggcgguggggcugagggugggguggagagggcggugccccugcucugaggcagggacuacugggugacagagacaaaggggugugugauggggcaggucacaauggguaggggaggauaaaagugguccugcggggugguuuagcagcaguggaugguucagguugggaagaagagcagugggauugccaguuaagguuguggaaucaaagagcaaaggcuguugugaaguggaauaucaggcucaaauggaggucccucccgaaugagcacugacaccugugugcccggacauccacgagggccccaacaccugugcuccugacagcuccaugcacuaagcagggcacagucuggauccaggggacugacugucucuggcauugagcgguugguaaucaauaccccacccucccuguucucagucacuuggggacaaaaaagaaagccugcagaacacgacugcuggcccaccugccagaguagccaaggaaacaggaugcccgcuaaagcauguuaaggaagguguggagcagcugcugggaacugucuugauuuaaaggaagacauggaggacugcuguaugcuaccguauuacacggcccaaagcagccccgcaaugggcauguuuaacaccuccauggggaagcugcagcggcaacuguacaaaggcgaguauacuauauucagguaugcacccauguuugagagcgacuuuauccagaucagcaaaagaggagaagugauugacgugcacaaccgugcccgaaugguaacaaugggcaucguucgcaccagccccugccucacacuaccugaugucaugcugcuggcccgaccagcugcugucugugacaaugccaggugugguccugccacccagaaaagagaaaguccgccugcagagaucuuagaacuaaccaggcugcuucccuugauguuugugaaaauaaccauccacaacagcguaaaaaaacagcuccaccugaagcuugccacgggccgcucuuuuuaucuucagcuguguccuccaucggaugcaagugaagaccuuuuuguucacugggaaaaccuuguuuacauccugagaccaccaguggaggcuuacagugauaccagggcuauccuagcugggaacacauuggacucaucuguguuggaggaagugcagaggagcccaguggugagucuaugcagagacuagauggggccuggaugcuuugggggagagcagguacagguccuguaaagccuuuggugcugcagcucaccugggaaaugcauugcauuuggaaggucugaaggccaaaugagcuuccauuuggaggccaugguacauugaggagguuccuagugcuucuccaggguucuccaagccugaauuucagagauuucuuagcugucagcaacucuucauuuuauauccacagcuguucauuuuauaucaauguuguaaugcuguccaaagcauccugaccagucuauucugaaacacauacuaugaccuaggcaggcugauauguuguaggacgugucucccugcaauugccacuuauauacauugguggcaacacaacauguuuguguacuugugcaauaauuucuuuuuguuguuuaccuauaggaagagaaaggagaucuugcuggucucacugucuuugcuuauuuguucucucccuagggauaugccaugaaguuuugugaagagaaggagcaauucagaaucaguagacuucacaugaaugcugaaauguuuggguccaccuauugugauuauacaauagagauaugaauccaacauaccucccacauauacuacguucaagaguucacacaccccugcagucauaaaaccuauagugccugaugaaggggcaggguagcaacagcaguagugaugacaguaagcaccaccacagguaccauggauguggcugcaaccaagucugcagacucaggagagaaacacagcacuggcaaaagcagccuucagagguccaggaggaaguauagccagcauggcuauuagugggugcuuccaugucuuaaucuuguuauagcaagggcugcaugcacauucuuguccuaaaaggguacuucaagcauaucaguaagugcuacuggccucucccuagagagcaguaugaaugugguggcuacaggagcagagagauacugagaaggcuguugcauugacaguaucucucugcuacucaaaggcugacucucugcuacucagcauugggagucaguuaucucaacucugcaggaugaggccacaugcgugaaugggauggaagccagagggucucuaccuagcuggauugacucugcaguaauaaccucaaagcccaguacuacacauggugcagagguggacaucucaccuaagacuguggaggggaacaaugugauucaccauaauaaaauccaucaacucaaauuaucugcucuaauaacauaugcucuauugacaggaaggguagcaauaaaacuaauggcaauuuaugaucaggcucugaaaacuaucuuuaacuuucccuuaacuuuauauuuuuuaaauaaauuaauagaugacagaauaaaauguugaagauuacucucagauaugauccuacauuaggagaauuauucuaaaacuguuuuccaaaauauaaaaugagaacccaggaauacacacacacagacucucucucucucuccucucucucuccagguuugaaucacagcauugccacacauuaacugugaguuucaguagauuguuucuuuaaauggucaccuugagaccauacauguauaauaucuggaacauaguaggcacuguguaaaugguaguguugagaaacaaauucugaguuuaaucauacuuuccagaaagggcuuaauuuucccagucucuucauucuugauuuccuuucuuaaaucuuaauuaacugcuuugcaauugucccauaaaagcucuauuuacaguaaaucuucucaguaucuuccaagaauuuuaauccccugacgcuauuuagaauucuaaauuuucaugaauuuguagaaauuucaaucuaguuacaauggaaagauaauugcaaagcacucaucuuuuaccugguucucuccaauuuuaguauucuuggagauagaaaaauaaaauguaauauaggaucaauucauaaucuggacaaaaacuggaaauuagaucauuuuagaauuguaagauccacauccaugggauuagccaauauucuaauuuugcaaguaaaaagucugcucgagucuaaaguaauacaucacaugguuugagaaccagaauguauagguaaccuggcccccaauuaugucuguauuguuuccauaacacucaugauucugacaagcacugugcuuugaauauaaaagauauuugauacauguuugcuggauccaauuaagggcuauaaaugugaaauauaauuuauuccaaucaaacaaaucuggggauauaaaauuuuacauaguacuguacuaauuguacagaucccaaaggccccuguauauauuguaaggaagcaguuuaccaguagacccucacagcgcuuacgacuuaaugauuuuuaauggccuccaaaagugcuucagaccugaaaaaaaugguuucaaaauaugaaaaacauuucacagguuagauguucuagcuuugcgaauuucaagguuacauuacugagaaaucacaucuaaccauaaaucacuuuucagcaaauaauuucaaaugaaaaaauuuaaaaauaaaacaauuuuuguuuuucaugugguacguagcccaguaucauaugauacuggagacccccuaagaagcuuuaaaaugaccauauugcaaacucuuaacagagaccaacuuuaucuuuauauucaaggacugucagcaugcuuaccacauuguagucccuugauaaucauagaagggaucauuguuaaaagcacugcacauuuuguauuuuuucucuaaaucuuaaucugacucaaucucuuuuuaaauuguauauuccuuugguaaauauuucaaucugcuucugauuacaaauccugaugcuuauuacuaucagauccuguuccuaggucacaguuuucuuaaaauucuaaaacaauacauauccuguuaccucaucucuuguaaucaaaguuuaagagauaauuuagauaauagauacugauaauaacagaaaaagauuuaaaaauuaccauuugugaaugguugagaaugguugaauccuagguaauaaacuaaaaaaccagaugaauuaaaaaauguugcaaauuguguauguguguauguguauauacuauauauauguacaaauauacuauauauacacaaaaauaugcuauacauauuauauuuuuaauugcaaaacuucaaaaauucuuuaauauauuuugcaaugaaaauguauauauauaaacauguuauauauacauaaaacauguuuacauguguauauauauauauacacacacauauacacacacaaauauaaaugcuaaaggauagcccuuaaacaauaauauucacagacacacacacacacacauucuuaagaauuuauagugagaggcugggugcaguggcucacgccuguaauaccagcacuuugggaagccgaggcgggcagaucacuugaggccaggaguuugagaugagauuggccaauauugugaaaugccgucucuacuaaaaacacaaaaauuagccaagcauaguggcgcaccccuguaaucccagcuacucaggaagcugaggcaggagaaucgcuugaaccagggaggcagagguugcagugauccaagaucguaccacugcacuccagccugggaaacagagcgagacuccaucugaaaaaaaaagaaaaauuuauagugagagaaacauuaguaaaauagucuuauugcugguuuguuagauuaaauucaguuaaaaaaaaacacccaaaaccuguaucucaaguacauuuauagauuuaaugcaguaaaaauuaaaaucccaauagagauacuuuuuaaacucaacauaguacuuacaaaauacagauuuuauaaagcaagcaaucaagucagcugcuaguuuuaauuuaauaauggauaauaccaacacugagucaugugguuuaaaaaauaggaaggcagaaauaaacaagccuucagaaguaaaaccaaaacaaaaggauaaaaacgagaggaauaugaguuauuguucaauggaaagucauaggaaaacuagauaucaacaagcaaaaaauaauauagagccauaauugaaauuuauguuaaaaggaguucuaaauaagaugaauuaaaugaaaaauaggauugagaagcuuaaucaacuggauaguuuuuuuaaauuacaugaugcacuuguacacauacaaauuaagacaaaaagaaaagcugcagacugggaaagauuuugugguaaauguaacuagaacaucugaggaauuaauaaacuuauugaacaauaccagucuucaccaaggaaauggccaaagguaaagcaaaccuaauauuaaaaauuguagaccaaaagcaagguacuaccaagccuaaaaaauaauaaaaucaaauuuagaaaaaagcaaauguuaguaaggugguagaaaaucagauacaaucauauuacugacagcuuuuugauuugcagucaucuggcuaauauaguaaauacccugauuauuuuauuucaguaauuauuuuuaagauauaaggcaaaguaaugauuaggaaauguauuuuuacaaaugcaguuuuaugaggggaaaauagguuaaaacauuuaauuauugauaaacugcuaagcaguuaaggguaagcuaauaaaauacaacuuaugcuuguuaauuuucuuucccuuuacccauguagauaugagguaaaaaacuauauguaaaaacuuuaagugaagacaugacacccuagaauauacacauuuguucacugagauucauucaacuauuacuucauuccaauuauuuuuuuuuguuuuacauccaucagauuuugcuugauaaagaagacauuuuuuucucuuccuuucuuucuuucuuuuuuuuuuuuuuuuuuugagacagagucucacucuaucauaacccaggcuggaaugcagugguaugaucacagcucaaugcagccucaaccucccaucucagccuccugaguagcuagggcuauggguguguacuaccacaccuggcuuauuuuuguauuuuuuguagagacaaggucucacuauguugcccaggcuggucuugaacuucugggcucaagcaauccacccuccucggccucccacagugcugagauuacaggugugagauaccacaucgaacccauucuucugauuugccaggaacuacgcguuagacugcagaugcugagcaucaaaagguugaaucucuaccuuuauggagcucacaguuuaguauguauuuacaacaauucuguaaagguuacaguaaacugucuuaaaguccuaugaagagauuuuuuaaguacuauauacugauuugaauauccuacuuagcuuucuacaacaaauuaauauugaaauuugaggggcuaugaucaaauuaugauacagacauguggaagacgugaugguuucuuagacauaauuguuucguauuugucgugacagaagggaaaauaucuuugagauguaacacuuuucuggauaaguacugugauuuaucuucuguccuggacugcuuuuuccacccacguucuauguaauuaaccucuuaacauuauacccuuucauauuaaguucuuugcuuauugugcagagauauuuucaccauggcuucaaauuuccuaucucuggaauauuuuagucauuucugaaacuccucuaagaguguaugguucacaacccacaacaggaaccugaaggugauacuacagauuuaaaguagucuuaaugauagugaaaugacuugaaacuaauagucaauauuuuaguguucugguuucauuuuuggauuuuauuccaaaaccuccagaaguacacauucccauuauucuacaaugcuccauugugaugugaaaaauauaaucacuggcuaugcuuuuaaacagccauaauauguuuccuuauaucuguagacaacuuuuacuuuuuaaaaauagcauucuuuaaacugauauauuucuggauucaaaauauuaaaaccucauaaacaagauaacuuuucugcauuauaaccaaacuaaauaauacuaauuuuuuacauaaauuaugucuucgcauauguacacauaugcacaccaaguuauaugcacauuuuacuugacacuuugagaaaaaccacaagauccaaaaucacaaagugaacaagauccuaauuugauuuucgaaggggagggagauuuuaucuuaaaaacauaggcaaccauuuuuguuuuauuguaccuuaauaaaagcaaacuuuuaccugggcaagcauggggaagccaagguuccuacauccauuacacggaguuaaugcuucccaaaguccugauggcccacacguauuuucaucaucauccucuucuuccacuucuccuggugacaaauugauuguagaugagguucucugaaauuaaauuuauaucauaccaauauauuauaucaaugauauuuagauaucuuaacaucaauuaaauucuauaaaugacagugguauaucucggcaaacaagucagcucacuuuuagccacaguuacauggcugugcccugugccugagauaaaaauauguauaguccaacuuaaguuaaaagugaaaaaaacuaggugugaaagacuuauaaaauaauauaugaaguucauaaugaagaauagaacaugauaauggccuaauaaaauauuugaauagcaacaaaugagaaaaaucuuaugguuuaucaagaauuuagguuuaggcauaaaauuaaggaaaaaugcaguuagggcacuaacaggaaaauauuuuauugaaaugggaacuccugauaaaccaguuuguucagaaugccacugaaauaaaacuuuauaaacuuucauaucauacauauaacaggaguaacaguuuuaaaauucauaaugagacuuccauauuuagcacauauauuuuccuucguuaucucccaaaucucacuaaaaugaugguagaacauuuauaaaaauguuuacaccauaaaaauaaggaugacaggagagaugaacagacaauauuaagaaaacuucuggauaauguugaguaacuuuuggauaacagauggguauuaccugacuuagcaaacaugagaacacugaaagcaaagaaccuucauguggaaagaauuggagggacuggcuaccugugaagguguaaguguagguggggcagaaacagacugaaacucaguaucagaaagaauuauaccccuagacccaucuccuuuucacccagccaggaaacuaaaucuuuaccacuggcaagaaauuagagguuuaauuuuugaagaaguugaagcaaaaggauuaugaauucuaagacuacagauauacugagucuccaaaaacaagagaauuaauaucuauauaguaaugaagauucauaaccuaccccgugccuuaccauauuugcauuagacaacauggcagcacgguuuauauucccagauaaacaacuagaauacuccucccuguagaaacagaccuccuaagaaaaaaggucuauaaauaagcaggaaaauggugggaucuauguaucaaucucuacugugaagccaaccucucaacaaguuccacucacaagaaucauauauuugagaaaaaccucuuaacagacaccaaaauaaauauagagaaaaaaguuauaaauaguauccucagagagaagauauuuauagccaugaaacaagaacagaaaguuacaaaauacauaaaauccaauacaagaguaagaaaaaucugagaaaauuucccaaaagaugaacagaauuuaaaaguggagaaaacuaggggucaaaccaagaccucuaacaucugaacaaaaggagcuccaaaaauuaagaguagagaugggagggucaaagaaauaaagcaugaaaauuugcagaaacugaggaaaaacuucacucuaagagccugcugaauacuuagcagacucaauuuaaaaaaaaagauguauaugcauaaauaaaaagaaauacacuaaauugucuaaagguccucugaauguagcguucagcacaacauugauagaucaugauuacuaaagcaaguaaauauauucuacauauuggauuguaaauagcauccuccccccaaaauuguuccuuuuaaaaauagaauauaagauuuuauuuuuccuccuauuuaaaagaauuuguuuucugcauucacauuuuaacuuccccuugaucacuugucaguaacuaagaagcaaugaaauuaaguugucccccaaucaguugcugucuauaaaauacaauaauaauaacaacuguuagacugagaacuuacuaugugacuuggaguaucacuggccuauugucuguuaacuauuuuaauucacacaacagccauuugaggcaaauauuuuuccucucacuuuauaaaugaggaaacuaagggacagagaggccaaguaaaacccaaggucacgaagcuggcaaguggcagaaaaaggauucuaacccagacuagggggcugcaaaaccuacucuccccucaccacuacauucugugaccacuccuuugguacaauaaccuguggaagacaauauacugaaaaaccacacugauguaaauaauugcaguuuaaauaaaagagguauauuuggugaauacguuucuguuacacgaguaaaguccugagagcauuuugccuucugugacagggagugaaaauuucugcaauuugauacauagcagcccaugcuuucauaaauacacacuucucaaaucaauaauagaaggugauuaucacagggauuuuugacccuacagauccuuugaguaaaauaaaaaaucuugggaaauuuaaaaucuuaaucugaaagaguauauauauauauaugauaaaguuguucacaggaauaaauaaaaugaucaaaaagguaucuccuuuaccagcucaugaucagcuaacaguuugaccaucaacauugaugcggcacauacuauaaaccaccucauaguuggccaagaauuaucaacauuuuagauuaauccauucuuuucuauuuuguuaauggugcuacaaugauuuaauccaaucacacagggaacuuccucuaucucuuucuccucccucaaaaaaaaaaaaaaaaaaaaaaaaagcuuaucucucuucccugcucauaaagcuccaauuacuucccauuucacagcaaaugauauccaaauuccuuaaucuggcuucagaguucuauagucaaaugauuuuuuagcccuuuuacuuuuucacuauacucaccucagauuauaaccagguggaauuguuuacccuugccuaaucaugcucuaugcuuuuauucuuucuuucaccuuacuugucugcacagcguauuguagugguuaagggcuugggcucuaaaauuagacaguccugaauucaaguuccaaauacccgccucacuagccguaugauuuucagcagauaagaccauugucagccucucuugccuuaucuaugcaauggaaaacaauacaguggaaccucucucagggcuuuuuccugaugacuaaaugagguaauaaauauaaagugccugacacauacagcuucaauaaguauuaacuaucauguuuauuauuuucuuauaaucccacugauucaaaauagaguucagauuucaucccuuaccuaaaauuuuccagauuucccacaagcaugcaugauaucauguucuucugcuugucucucuuugugcaaauguuugcauuugguauuucacauucaccuugaguugauagaugcuauaguggcaaagagcauuggcuuuuaacucaaacagauauauguuuaaauccuagcucuaccacuuccaagcuuugugauuuugagcaaaucacauaaucuuauuaauccuuaguuucccuaucugaaaaaauaguguaaucauuuccacuugcagggcuguaugaagaucaaauuaauugcuugacagagacuggcacauaaaaaaucaauaaguacugcuauuuuauuuuuuaccauaaaagaguuguguacacacacacagugugcuugugcaaauauacuacacagacacaaguguggcuuauuuacccuugugaaguaaguuauuugaaagaaaacauugccuuauucacauuguaucuccuacaauguguugugcauaaugaaacaauaaauauuuauugaaugaaucacugaauaaaugagcuucaaauuauuauuuucauuugacuaccuagaaaauuuuacuaauauuaagggguguguauaauuguaucacaaauaucaagauugccauuuuagcuuuauuuuauauuaacuauuacaaguagcuuugcagaaaugaagaaacuuaucagugguuuagcacugcccccuaaagacagcauauaaauuggcuguguaaaaccauaauuuuuaacuucauuucuuuacaguuaaagauuugaaggaaaauauuuuaucaagcuacauauaaucuucaauuauauaugggaagaagccagcggaacacacuuaaccucagaugguuucauuuauuccaaaugcuguucaaacuuuuuacuggagaacaaacucuguuccugaaguuccagaaagaugugaaaauucuacuauaaaaaaaaauagaccuaaaucuauacaguuugaacccauuagcuuucuugguuauuacacgguaauaaagaaagacuggaccaauucuauguuguugcaaauugaaaaacagucacaauaauauacuguagggagacaaacuugagcucaaucaaagaaaaacacuuuugagaauaauuauauuagucuaacauugaagaaaugggauuucccugugaggcaguguguguucguguguguuugugugucugugugugugcauguguguauguguaaauuauaugacaacuauauauaacggugcuucauaauuuauaaaaugcuuucagauagagaauagcccaauaaaauagaguaagaauuaucccuauuuuacaagugaaaaaaacugaugcucaaaauguuacucgauuugcaagaucauacuacaaaucaguccagauuauaauccaagcccucuaaaucuagguccuauugucuuucuaccacaccauggaagccaccuccuuaauuacuagaacucuucaaggggacaacaaauguucaagauugucaaugcaaagggaccaggccaaaaggcagaauccaggaaagaggcaauaucagagauggcaaucaaagcaaaaggcaacaaucuggaaugaguuagcaaucuagacuacuuuauagcauugccacacgccuuuuugccuuuguuuaguucuaaaguaaaauugcuuuauagauuuuucaaugaaauuuaaaguaauacaugcuuauuguaaaacaaaucauucauaaugaaaaauuauacaugaaagagugaagcuuuccuagccucggucccacauucaguggguguacuuccagacuuuguaauacuuacucuacuugccugaugacuuucucacgauaaauucauaaaugagaaauuguauacaccaaagaguaugccuaccuuuaucuuucuuuuucuuuuucuuuuuuuuuuuuuuuuuugagguggagucucacucuguuguccaggcugcagugcaguggcacaaucucugcucacugcagccuccaccucccagguucaagugauucuccugccucagccucccaaguagcugggauuagaggugcccaccaucacaccuaauuuuuuguauuuuuuuaguagagaugggguuucaccauguuggccaagcuggucuugaacuccugacuucaggugauccaccugccuuggccucccaaugugcugagauuacaagcaugggccaccgugccuggccuaaacuuucuaaguauugccaauguugucuuuaaccuguucacagugaucagagaaauguuuuuucauaugagaaugugaucauguuuuccucuuccuuaaaaccuucaauagcuuuucauguucuucugauaaaguucaaaauucuuaauaugauccaaaaggcuaugcaugaucugccccuaccucccucuguaucccaccacuaaucuggcaggccaggucucacuaacagcugaacaggaaggccuccaugacaacuguuucagcacugacugagugguuaaauuaaauauuuaaagcugauagagccagugcccuuauacgaaggcuggaauguaacgaaagcccaccaagaguuuugccuaggccuuuccagggccuugaagcaugaugaaauaacaaaggaauucuuaacagaacccguuuaguauuaaacagguuuuacugggggucugaaggaacuccccagaccuccacaaacaaguuuuauugaggucuaaaggaacucccaaaucuucaugauuuagcaggagacaagauaagcguaaucaccccuggcaccuggauccaucuagauugaguaaauuuacugaagcuccagaggaaggucuucaggacucagaccuuagguauagaugagaagaaguuaaucacuuaugucuuuagaugaaugcacacuuacauguagacauacagcuuagaagguauauaagcucuggaaaacuuuguaauuuugaguuggucuggcaauauuuucccuggccuucucccuguacccguuuacagaaguaaauucucuucuuucccaguuggucugcaucuuguuauuggaccaugagaauaagcaacccgacccuugguuugguccaggaacacuaacacuauuccucuccuuugcccauaauguuuaaacacacugagcuucccucuuucccucaaguauaccaaacuuccucuugccucguaccuuaccuuagcacaugugguuuucucuggcaaagacuauuagucaucucccaauauacaguccccccuccuccuuuugucuuuaguaacaccuucuuuuauucuuguaugguacuaauacuccaacuuuuagcugggcacauguauucuuugaauaaauaccacauuguccagugucuguugcagcuaggugugaccacauggcuaagucauaaccaugggauauaagaagugcucuugaagugaauaggugugcccuucuuccuccccuuccucuuccugcugauugaaugcuaaugaaauagcuggagcuggagcauuuguccugggccaugaaguauccuuggaacuagaggaccugcacaauggaacaacaaaauagaagaauccuggguuccucauagaggugaucccuaccagccuuggacugccuagcucuaagcuuuagaagugggaguaaaacaaacucuuucucuuuaagccauuauuauuauuuuagauguuuuuguuauuugcuauugugucaaacccuaacaaauaaauuccuuugcuugucuucaucaggauuaaucuuauuggugcuuuagguauaaauauaauucacuuccuuuggaaggccuucuugaugcucucaucaagauuaauuuccuuucuuauaugccuucacaguauccugcuuuucuaauagcaauuaucacaaugauaauuuuauaguuacugugugacuuugguucaguaucuccuauccuuaguccauaaaagcugcaugauugcagagaugccuguuggguuagcuaccaaagccugauacuuggcuaguacauugaauaacaguuuaucacauauguguugaaaaugaaugaagaguaaaugaaugaaugaaugccagcuugcccucauagauguuuuauuagugugaacauuuucacuaguucuaagaggaaccaauguaacuauaacccagauuuuaauguccuuuguucucuaacuccauuugcucccacugucuuccuuccauauucaaaauaauguagaaaacagcaucuauuugauuucaugaaagaauacauuuaugacaaccauuggugcacaauuuacauuuuaccacaaacucuauagcggaggugaaugggcuuuaaauugcacagcuuaacuccucccccuccccuaucaauauuuuucuccuuauaguaauaauuggguagaagggugcuuuucaucuccccuuccaccaagaagaauagaauucuuggugucuauuuuugccugcagacuguuuucauuagcucuuuaaauucuucuccucuuuauuaugcaagcaauuucacacuaggauacaucuuaucugcaaauuugcauagccaaucucauuacacaagagaucuuacaugagaacuauuauuuugucaauuuaaaaggcaacaacuauguaauagcaugauauaucauauuuuccuuuuuacaaucuuuuaaaaccggggaucuaagggcuuaauggggcacuaagaagaaaacgugagguguuaagcugguuuacuuauuccaaagcuaugauaguauuaaugaucagauagaugauaggucagugaucauauuacucacaaaggaacagacucaaccaucuuaaauuuaguccugggagagauaucacaugccacaguugaauauauuagcaaugaucagaaaaccuacuguuaaagccacaguugaacauauuagcuaugaucagaaacccuacuguuaaauacguuucuauaagcuuaguaacacuaaacaucuguucaaaauuuucugaaaauuaccuugcaaggcuacccuacacuaccuuucaccacaaccauuuguuccauguuaguaaaauucacaaaagcugcaacauuuaagucugcugaaaaauaaaauuucucuaagauuaauuuggaguuagcugugaauccuguacugcauuuauaucugcaaggaaaagaaaggaagaagaaaaacaagucuugaugccaaugaguacacugaguacaucuccuaguaucugcacucugaaaugacguuacuauguauggugauauuuuaaacuugaggauuugccagugccaaauguauuucacauuuauugaaggacagaauugcuauuaaagcaauuguuuuaguugcaagaaauauugaacaagaaaguaaggauagucuuucucuuuuuaauaguacaugagacauuacaauuccucugaaacgcuuaguuccaacacauuauguuccugccugcuguuuacauauuugacauccuuugcauaacaucaggaaacuucaaagaacauauuuuguuugcuauucuacuuauauacaaucaauuugaacguuuuuauuaucucucaaaacuuuuguucauuuaucugacccuuaccuaguaauuaauacuguuuauuauuucaauauuagaaagagcuaagucuaaacugaugccaauuuuaugcacaauacgcagaagcuaauuucaaaaaaaaauguuaaagucaccuuagaaaguuuaaacuuuuuuuuuuucaacaagacaguacagaaggcaaaauguauaacuuugggaaaacuaaauuauccuccaugacagaucauuuuauaugaacaaauaacauuuuucuaaaaguuuacuucuuuguuuuaaaauaaaauucauuaaagucuuauuuauauaccuaacaugaacccauuuuauauauuuauuuuuuguauugguacaaaucuuuaauagaauuuuuauuuaaauaggggauucuuauguuacuuuaaugcaaaauagaaagaaaacaaaugaaauuuuauauaaaaauuaaaaaccuaagaguaaaaagguagauguauguagaauccuccacagucagcguacaguauggcauuuucaaaaagcugagggaaaaggagcaagaaacugagaaggaagcaaaggagaagaaaggggagaguaaagaaagaaagaaaagaugacaugcacccauuuuaaauguacauaccugugcauucaccaccacaaucaagauacagaacauuuccaucaccgcaaaagguuaccuugaaucccuuuccuaucaauauuucccuacugguagccccagaaaucuuuuuucugccacaauauaguagcauauacacuuuauguuuggcauaaguuuucuguaaagcuuauuaacacuaaacaucuguuuaaaauuuucugaaaauuaccuugcaaggcuacccugcacuaucuuuucaccacaaccauuuguuccacguuaguaaaauucacucagccuaauguuuuugagauucauuccuacuuuugcauaucaguaguuuauuccuuuuuaauccaaaguaauauuccauuguauggcuauaccaaaguuuuguuuauacauucaucuauuuaugggcauuugguuguuuucagcuugcggccauuacgaauaaagucgccauuaacauucacauuaaaaucugugagugcccauaaguuuuuguuucucuuggguaaauaucgaaaaugcuaggucacacgguaaaugcaucaaacuuuuuaagaaacugcuaaaguguuuuccaaaguguuuguaccauuuuacauucccauucauugugucggagaguuucgguagcuccacauucuuggcaacacuuaauuuuaguuauucuaauggguaugcauguagaguuaucgcaauaguauguaguuaucaaaugguauguagaauuaucacaauaauaguacuuuuaauauacauuucugccagugcuacuaaugugcuaaauaucuucuccugugcuuagaggccauuuaccuucuucuuuggugaaguaccuuuacacauuuuuauuagguuguucgacuucuuuuuuuuuuuuuagacggaguaucacucuguugcccaggcuggauggagugcaguggcaccaucucggcucacugcaagcucugccucccaggcucacgccauucuccugccucagccucccaaguagcugggacuacaggcgcccaccaccacgcccggcuaauuuuuuguauuuuuaguagagacgggguuucaccguguuaaccaggauggucucgaucuccugaccuugugauccgcccgccucagccucccaaagugcugcgauuacaaccuuagcgugagccaaguuucuuugacuucuuauugcuguguuguaagaguauucuuuuuaaauauucuauauucuagacauaccuccuuuguacuguuggugaauauauaagaaaucuuugccuaacacaaaguuaagauauuuuccuauauuuucuuccauaaguuuaagauuuuugcuuuuacauuuugaucuuuguucuauauugaguuaauuuucauguacagcaugagguaaagguugagauuuaagaaaccuauuuuuuuaauauauaaguagaaguagucagccccauuacuugaaaagauuauccuuuccccauugaagugcccugcaguuuuuuugaaaaucaauugaccauacguguauggguuuauuucugaauucuacuuuguucuauugaccuguaaaucucuucuuaugugaauaccacauugauagacguuuauaagccuggaaucagagaaaccuccaaauuuguucuucuuugaaauuauuuuggcuauucuauguucucugccuuugcauauaaauuuuagaguaagcugucaauagcugaaaaauuagccugcuuggauucugcuugggauuguaguccauaguacaauuuggggagaacaaauaucuaaaccacauuguccuucauuucaugaacaugaugguauauccccguagguauuagguuuucuuuaauuuccaucaacaauauuuuuauagucuucaguguacaggucuugcccauauccuguuaaauuuguagggguaaauuuguaggggugguauaucuuugcacguauuagguuuucuuuaauuuccaucaacaauauuuuuauagucuucaguguacaggucuugcacauaucuuguuaaauaugaagggguaaacacacguuucguguuucuggaaaaucuuucaaaugguauuauuagguuaauuuaauuuucuuuucccucuagcacuauuggggcauaauugacaaacaaaacuguacauauuuaagguguauggcauauuauuuugcuauauguauaauugugaauuaccacaaucaagccaauuaacaucuccaucacgucauauaguuacuaugggguguguguguguguguguguguguguguguguguguguggugaggacacuuagaaucaacucucuuagcaaauuucaaguauacaaugugauguuauuaacuauaguuaccaugcuaugcauuugaucuccagaauuuauucaucuuauaacugaaaauuuguaaccaaacuucaaauuuguaccaaauuuuaaaauugaauuuucagcugagugcagugguucaugccuagaaucccagcacuuugggaggucaaggcagauggaucacuugagguaaggaguucgagacaagccuggccaacaugaugaaacucugucucuacuaaaaauacaaaaaaguuuagccaggugugguggcacgcaccuguaguuccagcuacucgggaggcugaggcaggagaaucacuugagcccgggaggcggagguugcagugagccgagaucaugccaccacacuccagucugggugacagagcgagacucugucucaaaaaaaaagaaaagaaaagaaaagaaaagaaaacccugaauuuucaguuacugauaguuccucauguaaaaaaaaaauuugauuuuuauguuuauuuacuuugcaucuugcacacauuuuaggucuaguugcuuuccuauagauauuuuaggauuuucuauguaaaugaucauaucaccugugaauaaagaguuuuacuuuucucuuuaaaaucuuuaugccuuuauuuucuagcccuugucuuacugcacuggccagaauugccaguacaauguugaauacaaaucuuaagugaaaagcauucagccuuucaacauuaugaaguauaauguuaguuagcuguggcauuuuuguaaaggcuuuuuauuauaagguugagcaaauuauuccuauucucaguuuacuaaaaguuuguaucaugaauagaugcuuuucuacaaugacugauaugaucauaagguuuucuuccuuuauucuguuaaugugguaaaauauauuaauugauuuuaucuguuaaaauaaccuugccuuucuggcauauaucccacuugguuguaaugcaaaauuuuuaaguguaugccggacuugauuuguuacuauuuuauugaggauuuuguuacuguguuuaugagugauauugaucuauaguuuuccauuugugaaaugucuuuguuaucacaguaaugcugacuucauauaauaaauugggaacaacccuuaucuuuuauuuucuaaaaggauuucaccaguaaaccaccucuauguaaaguuuccuuguggggaagaauuucauuaugauuuaagcuuccuuaacauaggauuauuuagauuuuauauuucuucuugaguuacuuuuccuaauuuaggucuuucaaauaauucuuccauuucaucuagguugucaguuauugcuacaaaguuauucauauuguuccuuuauuauucuauucauucuccuggaucuuuauucauauccccucccuuuuauuucuauuggcuguuuauauucuauuuuacugauauugauuuuaaucauucucacuuuggguuuaauuuccucuuuuaucucauuuuuuuuaaauguggaagcuuaggucuuucauuuaagaccuuucuccuuuuccuauauaagaacugaauucuaugagacuccuaagcacugcacuagcuuuaccuacaaaguuuaauauucuugguucuuauuugcauuuaguuaaaaauauuuucuaaguuucuuugugacuuuagcaacuagauuaugauguaucuuugucuaguuuucuuuguuuuugucaugcuuugcauuuguugagcuucuuggguugguguuuucauucaaguuagaaauuuuucagccauuguuuuuguuauuuuuuuuuguuauucuuucauuccuaaccccuccucuccuucugaaucuccaauuacacauauguuucauugcaugauauuuuuucacaggcucuguuauuuauuuuagucauuuuuuucucuguauuuuauuuuggcuacuuucauuugcaauauuuuccauuucaccaaucguuccuucugcaaugacagucugcuguuuauugcaucuacuuuauuuuucauuucagauacugucuuuuucaucucuagauguuuccuuugaacucuuuuauaucuacauuucucuauucaugucaccucuuccuuuaaaccuuugaguauaucaagcauauuuauagcaaauauuuuauucucucauauacaaauucuaucaaaucuguaauuccaggccuauuuuuauugacuaauuuuuugcauguucaugacuuucauuuuccuuauuuucauguguaguaauuuuuuuaagagaaggcuucucacucugucaccuaggcuggagugcagucauacaaucauagcucacugcagccuugacuucuugcacucaaaugaucuucuugccucagccuccugaguagcugggacuacaggaaugucccaccacacuuggcucugaguguaguuguauuucuuuaaaaauuacuggacaucguuguggcauagaguaaaguuaucuggagaucaguuuaauucauucaaggcuugcuuuuacuuuuuuuuuuuaggugggucuacaguaaccuuuacucuggagcuaacuuaaccccacuguuaagacuuacguucccucuggaaugucuagugaaugugccauguauuaagcaugaucccucuacuugggcugguaguuacuugaaugauuguuggccuugugugagcuccagggauuuuucuguuuauguaucuccaguauuguucuuucuuuggagguuuuucuuuuucugucuucaugaaguuucacucuugugcagauugauauucaacugaagauacaaagauaacuuuagguuguuuucuggaccucuuuuuugguauaguacccucuuuucuguuccucugccugaaaauucuagcugacucagccuuccccaacucuaguuucuguacuuucaacucagaggauuacuugacccuguuucuguuuuucuaccuggcaccauauuuaggaauuggauucaggcaaaaagcugggugaugguaggguuugccuccuuuguaucuuuucuauuagggaucacaguccugucuuuuauccaggucugaucaugaauguuugacauauuuuuguccaguauucagcaguuuucagaaggagccacuccauacccuauuaccucauggaaguuugacaaaaccuuuaaagguuugacaaaaacacuuuuuaaaagaagacguguauuauucauaucuguuucuccauuuuagaccuuucuucacuucuuaccggcuaaauaaucccauuuccucuauuuuguacaaaucccucaaacauauuaauauucucuuccuccacacuguuaacugcacauuuaucacauaaaguuagucuuuucuuuccaucaucaugcuugucuugccaauuuccuaauucauaauaaauagaugguccuaggaaaacaaucucaccuguaauaugagaguuauucaauuaauuuuuugcaucagugaauacacauaccuuuuacaaccaaccugaacuuccugugugcauaauuucauugcuacuuaacuuaauuaaaaaauuauuguuuaugcccaauauuucaaauaaauuuauuuaaauuuauuaaauauuuauugauuaaaaacuacugucuacaaggcugaacucuaggaugagggaagaaaaauauaaguaugucauaaacucugaacucaagguguaaagacacauaucuauacauaacuagacaguaaaacuagaccaaaauuauaagcauuacagagauacuaaaacaagguauuagaaaacauaaagaggaagcaaccagggcaaguagaggagagaauucacagaguguuugcauuugagcaaaagcaccucaugagauaagaauucugacagagaaaaggggagaugggaaugaggcacagaguuugcaugauuaaggcaguaugaaugugcuugcugugucuggcaaaugagcuauuaggaaaggcaugguggggagaugguacaugaaaaauaaaucagggcucuauuauguaaaacugauaguuuaaaacaaguucaacauuagucaaggcacaauuuucuacuucuuauucuacugagaucaaaaaauagaaagcuucuacguauuagauacaaaaggauucagagacuguuucucuucucuaaauucccauaauucagauguuuggacaacucaaucuauuguuuugaacuauuuucuggagauugcaugaaguauaucuuaucucuguaauugcaagaacaauauuuucuauuauuuguguauccugcaagaugacuagcacaguucagggcacaucauguguauauacguuuugauuagacaacucuugcucuuucacauguucuauuuuguccuuagaugacuauaaaauagaaaugcuuucagugcugauguuuacguaaauauguacuuguaugcauguguguguguauauuggacugaaacagaaauuaauaggcauguuugaucaaaaaaaugugaagaagucucucaacagccccgcaaucaaaagauaaacacccccauuauuaaauagcaauauuuuauccuuuucaauauacaacauauauucccugucuuuucucaucuuuauauuguauacauauuauuucuaucauauuuuaagccauuuucugggaaagcaguuguucaguuacaugaaaguaaaauuugggagaaaaaguauauaauuaaaauguauauuaacuaagucaugauaaaucaucaaaacuuaggacugaagcauuuuauauugaaaauaaaaugaauauaaauuagacauuaagucuguuagaucagaagucuguuagaacugacuaacucuaguucacgacacuaaaucaagguagcagaaauaaaguaguaugugguacuacuccagauauugccaaauuuaaaaugcuucuuuuguaugcucaauagcauucaguaaauuuuuuuugguugaaaaauuuauuaauuaacgcuagccaaagaaaauaaaaccugauguuuucucccccaccccaaauaaucuuuaauaaacauauuaacaaugcugagugauuuuaaaacucuuuucuuuuuugagauaaaauuuuuuaaguggaaaagaauuuuucagauguaccaagacaaguucaaaaacauggcaauauccuucaaccuaugcaacauucucaccaucuugucagcauuuaauuaaaucucccugacccagguucaaaugccagaauuggaauaccugaaccacauccuaucuagccaaggcauuaaacccaugcuggauaagucuucugucugagauaaugaaguaggagguacccaggacaaucaaagacaucagcaacuucugacuuaccagguuuacuguuaauucauuccccauuucuucacuuugaucuuccuaauggugaacuaauuucaucuucaagaaaaggaauuuuucuacucuucaucuauggauuuccauaucugaaaaucccuuucaaauacacguaacucugaccaaacagaacuacuccaaacauaucugacccugugccacuaaaucugucaguuacaacaucaccagggaaugccauccugucauugcauaaagacaaaaccucuuccuguggcagccugcagcuaauaacugguugaagaagugcagcuaccuccuccaaacugagaacaauucugaaaggucaccccagcuucugaguuccugugauguuggucaagcagaaacagaucauucaguggacagcaccuacagaaaccuucuccaguaaggugugaaucccaaccuuagggagaggugcucucuuccaugauuguccuuccuuggauacucucccccagccauagaauaccuuuauaguuuguuuuacauauuuauaguuacucuccuaucauaguuuaauaaucuuugguguuaaacuuucuugggaaacuucaacacagaaauauaagcaggaaaugauaagaaaagaaaaggcuaauguugagccaaagacacaauaaaacugguugaaauaagaaaagaauacauuaugaaauuuaaacuauuuugucucuaaaagccaaacugauuuuacauaaaaucaaauuaguguuuugguggccaaauuggagacauucaccaaaauccauacccucaaaaaggucagaaaacaugguguaucaaagaaaucaagaacacugaucuauucuaagaccauauaaucuuaggugaaaaagccugagcagagaauacaaacgaaauaaucaaaaauauaauagaagaaaacuuuccagaaucaagaaagaugagguauacaacaaaugccuggaagaacuggaaaauaaucauaucaagacauacucaggcaaaaucuuuuaauuccaaggaaaaagaauaaccuauccaagcuuccagaaugaacacucagauugccuacuguacuagccaggauucuuagaggcaaauaauagaaacugacucuguuaaguaaaucagauacuuuguuuuuacaucccaaacauccagaaaacaaagaaaauuuaaaaauccugaaguccaccauaucuaugccaagaagaaaaaauauuauguugaccuuauauuuuuggaacauaugcaauauaaacaauaguauaagcauuauaugacauaaaaugucaacagacuacucaagguacaagguuauaacucaagaauuuuauaccaagaaaaguuacugguuauguuuaaaagcaagacagauaaugcaguccucaugaauaauucuugagauaauacauuuauccuauuugaaaauaaauuacaacuugccaagagacaaauuaaggaaucaaaaaggugcaacaugucauauaaaguauaauucaugaauauugaaauaaauuaaauacaaaguuuuaagcauaacaauauuuauuaauauaauuauagaauaugguuauuaauauggucauuauuuucagugaaacaauuacauauuuauagaacucaagaucagcucaaaauuauaauuuagaaggguaaaguauggcaacuaguuacaagauuaauauaaaaaucaacagucuuucuauuuauaagcaaagacuucuagaauauacaacaggaaaagaacaugagucaaaaaauuuaaaaaucaaaaauuaaaacaacuaacaauaaccuuaaauaagaaacguuggugcccuagggaaauaaaacuaauuaugaaauaaagaaauacaugucaagagacaaaggaaaauuaauuuaaauggagaaaaaugucauaauaauguuugagaaagcugaacuuuucaaagauggcaaaucuuccucaaauaaaaguguauuggggauuauaauaauuuauggaugcuuuauauaaguuauacauaaagugagggcugaaacuuugucauauuuuauuauaucuaagacuagaacuguacauaacacacauuuguuuaacaauaaauacuuuccaauaaaugguuaaaguaauaaauuaauccuagcuggaccugcaaggaaagauggcaauaugaauuuaaaaaccgcuauaaaauaaaagaaagaagagaagagcuaaggaaauguaugacaaagaauauaaguacuaugaaaaguaaaacacuacaggacuugugcaagaauaauagaguaaauaguucuaguucagaacugaauauauaaucuuuauuauaaaaacacaugaaaaagaagcaccaaaguuuauaaaaaauaaguggauuacucaauaaacuaugaugggaaaugaguuuaugugucugaaaacaaaacaugcgaauugaagucuucugugggaaaaaauaggcauuuucuuuuaaaggcauuucuacuauaaauaguaguaaauauaauagaagaaaugauuuauagacuucauuucauuaaaaaaauuaaccccuguauuugaacauuaauacuaaaauucuaaaacacgugaaaacuuuggaaaauuauuuacaauaaauacaacaaaauaauaauauccuuaauaugcaaagacucuauauaccaguaagaaaaauagcacgguaaaugaaaagcauacaaaagacuugaaaagaucauuuuaaaaguaguacaauugaccacugaucauacaaaauauguuuaacuacuuuaguauuuauagcaauuaaaacucaaauagcaaggagauaacauguuuuaucaaucaaacuggcauguuuucaaaccauaauguuuggugaggggcuuugcauugggaauguaaauuaacaaaaauauuuugaaggauaaguugguaguauguguaaagaaucuuuaaaaaguuucuucucuuucagaaauuccacuucuaguuaucuauacuaagagaauaaauguuauauguauguguaaugauauucauuauuccauugauauaaaagcaaauaauugaaaacacuuaauauuuaacugaaaaacacuguuaaauaaauuagaguauaucuauguaagaaaauauuuaaagaucuuuaaaaucauauucucagaaaauauuuaguaauaugaaaaauugucauuuuauuauuuuaauauguugcacuguuuuaaaaaguaguauaauaaacccuaggaggauaaauuccaguuuuaaauguuuuuuaauaaaauuuaucuuuaaauagugaaauaauggccuauuuaaauuuuuuaauacuuuucugaauuuugcaaacuuucaaugaucaauucagaaugcuuuuauaaucaaauauuacugauguuauaugugucaaugaaguuauuucaccucuaccaaucuaacccaaaaaaagguagaugugcacaaagauuuuuuacucaaggauauuuaucaucauauuauauauaauaaaauaaauguauaaacaaucuaaauguuuaaccauagaaaauaauuaaauugugcuaccucuguguguauacuuuuauauauuaggauauuauuacuauaaguaaaauuucauaaaauguuauuggcaugggaaaauuuucaugaaaauuaagaaauaaaaugcacagcaugauucuguuucauuuuuauagugacuugugauaggguuuggcuuuguccccacucaaaucucaucuugaauuguacuaccuguaauccccacaugucuuuggagggacccagugggagguaauugacucaugggggcagauacccucaugcaguuuuuugugauagugagugaguucugaugguuucauaagggguuuuucccccuuugcuuggcacuucuccuuccugcugccaugugaagaaggacauguuugcuuccccuucugccauuguuuuaaguuuccugaggcuuccccagcccuguggaacugugagucaauuaaaccucuuuucaucauaaacuacccagucuuggguaugucuugauagcauugugagcauagacuaauacacucgcauauauaaaaacuaagauaaaauauauuaaaacacaucucuguaugacaggugaauuuucauuauucauacauauccuauuuuccaaauugucuauaauaagaaaaaacaagcuuuuuaaagaaaaauggaagauuauuccuccauuuagaaucccauaauacuaagugauuuguugaaauguucaucagaaugcagaggcaauccuaagaauuuaacugcaaauuacagaauuuuccuaucuucacacuuucuaauugccaaauaauuuauaaaaauaaguaggacuuaauuucaugacauguauuaaaauaaauaaaguaaaugguuuucaauuugaaauauuccauuaagucuuuucuaacuugagcuuaugaaaugcaugcuugcuucuuguuucuuuuuaggccuuugcuuccagaaauguuaaaauaacaugauuacuaaauauaucuccaaguuucauacagcuacugugaagucaaaaucuggaaaacaaguagaaaaguggaguacuuacuguuggcaagaacuaccacagaucccuaagacuauuguucuauaaauguuaaauuauaaagugauacaaauaaauuagauuuuaaaagggaggaauggaguaggaagaaggagaauguguugugagacacaguagaacacacaggaagaguugagguauauaucuuuauucuuacugacauauaucccaaauaaaugaaagcaaacucaauauuucauguauucagauuaauaacaccuauuucuaauuuuaauguaauagguucuuuaacaaaaaguuuucaaaauauuucaaagggcuuauaaaagugaaucuuuagcuuucuucuaaguacacuuuugcgcuccuacaucuuucauagccuagaccuaauuucuaguuucuggccucaucuccguuucuagguccugcuccacagaggugugaucaggagggccaugcaccauuacaaaauugacaugacuuagaucuuaaaagcaguaccacuugccccuccuccaaacuguuuguuuuuuuauuuuuuuguuuuuuuuccuuaaggcugcucaagaaaguagcaaauaauauagccuaaauaauauaugauuuguugaggacuuuuuuggaggagaggaaagggaugugauuauuuaaaacugcacaagugggaaacaauuuccaaaugcuuuucagaaaauaucuuguaauuagauucucuuuuaaaacuacuaggacuuugaaguaaaauaaugucugcugcugagaacacuguugaauugcaguuaacuccuacuagugaucaaaaugacccagucaaaucuccagcugcuuauguaauucugaauaaauucuccauuuuuuaagaaggauacaccaaagaaauaaaguucaguuuguaguggcucacgccuguaaucccagcacuuugggaggcugaggcuggcagaucacgaggucaggagaucgagaccagccuggcuaacaccaugaaacccugucucuacuaaaaauacaaaaaauuagccgggcgugguggcacgcgccuguagucccagcuacucgggaggcugaggcuggagaaucucuugaaugugggagguggcgguugcagugagcugagacugcaccacugcauuccagcauggacaacagagcaagacuccgucucaaaaaaaaauuuuuuuucaguuaaaagauacccacuaaaacaacucugucuuggcaaaaauugcaacacuucaauaagggagaauauuuggcaugcuccauucauuacucuguugugguguaccuuacgagagacaaccaaauaagauagaacaaaaucuauguugagaacuuacuguucuacuuaacacaggaguggaguacauacuguuaccaagaacugccacagagcccuaagacuauaguucuauaaauguuaaauuacaaaaugauacaaaucguuuucaugauuccaggaagauggcagccugugucuguauucucuauuccuucuccuuccuaagucccugguguggcuacuuuuccuagaaaauaacuaaguguacucuuggaggcuagaaagaaccuggaaucaucugagauuuuaaguccuaaaaaugaagauauaauucuggccuaaaacuuacuggacaguggucagaaccccuucuaggcuaacuucuccuacauaacuuggaacaaaugucacagauucccggauaaccacaagcaaggagagaaaauucuccuaccuguuuacuaagagagcccaagugucccuuuacacuguaguguugggcuaaguacaauccaucccugggcuaaguacaauccaucccugauugcaccaaacuuaaaaaaaaaucucuuuuucuaagccuaaauuucacuaaaagcacucuggagcuaaacacucccauuuaauuauuuauuguuguuuaauuaccauuuucuuagagacuccaaaaccugagcaguacagguguugacagaucccauguccaauaauaugaaugcccauuaauaugaacaauaaggaucaacaaaccauuuuaugagacaguggcuuaaaagaagaaaacuuagaugaucaacaagaguaguagagguaaaaauaacagaggacacacaaaaaaauggggaaaaauguacuauaaucucuuauaaauaugaaauuagaauguguaaaaacagugucuagaacuaaaagaaagaacucuugaauuuuaaaguucaguugagaaaaugaaaacgucacugaagaaaaguaauuuuguguuuuagaaaaucaagugaagaaaacagaauaaaaaugaacccugauagguaucaaguacagauuaaacauuuguaaguuggugaauaaugggauaaaaacaaaugaagaugugaucaaagaaauaauaaacaaaagcucuccucaucugaaguuacacucagauuaaaagagcucacuuguuaaauaauuuaaauggcacguauuuaaagauaaucugaugauuuuugaacucuaaaguuuuguuguuguuuuguuugagacagggucuggcuaggucacccaggcuggagugcaguggcaccaucucgacucacugcaaccuccacccccaggcucaagccauccucccaccucagccucccaaguaccucggacuacagguauguaccaacacacccagauaauuuuuuuuuauuuuuuguagaaauaggguuucacuauguugcccaggcuggucucaaacuccugacuucaagugauccgcccuccucggccucccaaagugcugggauaacaggugugggcuaccaugacuguccgaacucuaacauugaacuggaaauauuaccaguuucaacaagggaagagaaaagcagauauuuucaaauaaaaaagaaccaaauuauuaucaaauucuuaacuguaacaucagaaguuagaacacaauagaccaaccauuguagauuauggaagaaaauaacuguuaaaaauaggcagcuggacuugaaauccugccuaaauaugggaaauggcagacaggagucaggacuaacuugcagcacccacucggauggagagaacagcauguggagacucacauuguaaacuuuugcuccaagaacugccauaggaacauaccagaaaaacugaaagaauucacagauccuuugaaagaagcaccuuguuacugcaaacucugugagacaguugaaaaaaugucuugaaaagugugaaaggggaaaaucugccuccaaacacacauccuccuuggggaaccugaaaauccagaccacgggagaaggauuuaaacuuaucuagagcugaaacaaauuuagacagccaagcaaaauacaaaaguagaagaagcaggccagguaugguggcccaugccuguaaucccagcacuuugggagacgaagguggguggaucacucgaggccaaaaguucaagaccagccuggccaacauggcaaaaccccgccucuacuaaaaauacaaaaccuagccagccaugguggcacaugccuauaaucccagcuggcugggaggcugaggugcgaggaucaccugagcccaggaggcagagguugcagugagccacgaucacgccacugcacaccaggcugucuguuaagacucugucaaaaaaaaaaaggaagaagaagcagcagcaggaagagcccuguaggcagucucaggggagccauuucugacuuuaucucacaggggucugugggagggcugcaaguggaacuggggaaggaccacagggagaaagaaacuuccagcugaacuucuguaauaauuuugaccaagcaugaauuuuccugggcagaaucgggggagggggagaauaggaaguguggacauaaacacagaaacugcggcaggcagggaggggugaagccugaaaucccugcuugcuuucucagcucuuaguggguaggcuuguagccugguacaagaucucaguacugcucacaggcucccuguauauaaacucagugcuauuggaggggcgugguaagaguuagacuagccuuacuggcugcaugggagcugagugaggcccgucacugccagcuuuuccccacuucccuggugaccuguauaauguacgagaggcagccauaaucccccuaagaacauaacuccauuggccugagaaccacaaucccaucccccacagaagccauagcaaguccugcccaaggagagucugagcucagacacaccuaacccggccuccacuugaugauuuuucuccaccugcccugguagccaaagacaaaagacauaaucucuugggagcuccauggccccacucaucaccugagaauccugaguacuuauccaggcaaccuuaaagcaagcuuguauaccccuauacuaugcaguugaucucuccugaaagugccaccuccuggcuagaggccaaccaacucaagccauuacagcaacucauaaaagaacaaacccacuccaaagaagaagaaaacaacagcuaauuccacugccuguagcauccuagcuaaccagagguccugagucuguccaugugacaacuucacugcuaacacaacuagcauugagaaaaccagaacaauaaacaaaauuacaaccaaggacacucacggaguccacuucaccccucugcuaccuccacuggaguagcugcugguauccacagcugagagaacugaaaauggaucacaucacaggacucuuugcagacacuccccaguaccagcccagagccaaguagcuccacuggguggcuagacccagaagagaaauaacaaucacagcagucaggcugucaggaagccccauuccuagaggaaggggaagaacaccacaucaagagagcacccugugggacaaaagaaucugaauagcagcucuuuagccccagaucauuccucugacauauucuacccaaaugagaagaaaccaaaaagacaacucugcuaauaugacaaaacaaggaccauuaacacccccaaagaucacauuagcucaucagcaauggauccaaaucaagaagaaaucucucaauugccaggaaaauaauucagaaggucaccuaacacauaaggacucacauaaacuuaaggaaaagggguggaaagagauauuccaugcaaacagacaccaaaagcgagcaggaguagcuauucuuacauaagguaaaacagacuuugaagcaacaaaaguuuuaaaaaacaaagagggacauuauguaaugauaaaaggacuaguccaacaggaaaauaucacaauccaaaauauauaugcagaaguucccaaauuuauaaagcaauuacuacuagaccuaagaaaugagacagacagcaacacaauauuaguggaggacuucaauacuccacugacagcacuagacaggucaucaaguuagaaagucaacaaagaaacaaugaacuuaaacuauauccuauaauaaauggacuuaacagauauuugcagaacauuuucuauccaacaacugcagaauauacauucuauccaucaucacauggaacauuuuccaagauagaccauauaugauaggccacaaaacaaagcucaauaaauuuaacaaaacugaaauuauaucaagugcucucucauaccacagugcaauaaaauuggaacaaaaggaaccuucaaaaccauggaaauacauggaaaugaaauaaucuacuccugaauaaucauugggucaacaaugaaaucaaaauggaaauuuaaaaauucuucgaacugaacaauaauagugacacauccuaucaaaccucugggauacagcaaaaguggugcuaaaaggaaaguucauagcauuaaaugccuacaucaaagagucugaaagagcacauauagacaaucuaaggucacacuucaaggaacuagagaaagaagaacaagccaaacccaaacccagcagaagaaaagaaauaaccaagaucagaguagaacuaauugauauugaaacaacaacaacaaaaauacaaaagauaaaugacaugaaaagcugguucuuggaaaagauaaacaaaucaauagaucauuagugaguguauuagucccuuuucaugcugcugauaaagacauacccgagaauggguaauuuauuaaaaaauaaaaaaaaagguuuaauugacucacaguuucaucugacuggggaggccuaacaaucauggcagaaggugacauacacgucauacauggcagcagacaugagagaaagagaaucaagugaaagggguuuccccuuauguaaccaccaggucucgugagacuuauacacuaccaugagaacaguaugagagaaacugcccccauuauucaauuaucaccuacugggucccucccacaacauguggaaauuauggaagcuacaauucaagaugagauuuggguggggacacagccaaaucauaucagcgagauuaaccaagaaaagagagaauauccaaauaagcucaauuagaaaugaaaugggagauauuacaauagauaucacagaaauagaaaagaucauucaagacuacuugaacaccuauaugcucacaaaguagaaaaaccuagaggagauagauaaauuccuggaaauauacaaccauccuagauuaaaccaggaagcaauagaaacucugagcagaucaauaacaagcagugagauuaaaaugauaauaacaaaucgcaaacaaaagauguuccaggaccagaggaauucaccgcugaauucuaucagacauucaaggaaaaacugguaccaauccuauuaacauuauuccaaaagauaaacagggaauccucccuaaaucauucuaugaagccaguaucacccuaauaccaaaaccagaaaaggguauuugaaacaaaagaaaacaaaaaaccaauaucccuuaugaacauagaugcaaaaauccucaacaaaauacuaguuaacugaauccaaaagcacaucaaaaagguaauccaccaugaucaaguggguuucauaccagggaugcagggaugguucaacauacacaaauaaaugugauacaucauauaaacagaauuaaaaacaucaucucaauagacacagaaaaagcauuugacaaaauccaguaucccuuuaugguuaaaauccucaguaaaauuggcauagaagggacauaucuuaagguaauaaaauccaucuaagacaaacccacagccaauauuauacugaauggggaaaaagugagagcauucccccugagaccugggauaacacaaggaugcccacucucaccaauucuauucaacauaguacuagaaauccuagccagagcaaucagacaaggcacagaaauaaaggguauccaacucaguaaagaagaagucaaacugucacuggucaccaaugauaugaucauauaccuagaaaaguauaaagacugauccaaaaagcuccuagaacugaaaaaaugaauucagcaaaggaucaagugacaaaaucaauauauacaaaucaguagcacugcuauacaccaacagugaccaagcugagaaucaaaucaagaacucaacuccuuuuacaacagcugcaaaaaaaaaaaaaaaaagggaaaaagaaauacuuaggaauacaucuaaccaaagaggugaaagaucucuacaaggaaaacuacaaaacacugcugaaagaaaucauagaugacacaaacaacuggaaauacaucacaugcucaugaauggguaguaucaauauuguaaaaaugacaaaucuacaaauucaccaaacuagaaaaaacaauccuaaaauuuauauggagucaaaaaagagccugcauagccagagcaagacuacuccaaaagaauaaaucuggaagcaucacauuacuuaacuucaaacuauacuauaaaucuguagucaccaaaacagcuugguacagguauuaaaaauaggcacacaggccaauggaacagaguagagaacccagaaauaaagccaaauacaugccggcuugaucuucaacaaagcaaacaaaaauauaauguggggaaaagauauccuauucaacaaauagugcugggauaauuggcaagccacauguagaagaaugaaacuggauccucaucucucaccuuauacaaaaaucaacccaagacgaaucaaagacuuaaaucuaacaccugaaaccaucaaaauucuagaagauaauacuggaaaaacccuuccagaaauuggcuuaggcaaagaauucaugaacaagaacccaaaagcaacugcaacaaaaacagagauaaauagauaagacucaaacuaaaaaguuucugcacagcaaaagaaauaaucagcagaguaaacagacaacccacagagugggagaaaaucaucacaaacuaugcaucuaacuauauaaacaaaggacuaauauccagaaucuacaaggaacucaaacaaaucagcaggaaaaaacaaacagucccaucaaaaagugggcuaaggacaugaauagacaauucucaaaagaagauacacaaaucaccaacaaacauaugaaaaaugcucaacaucacuaaugaucagggaaauauaaaccaaaaucacaaugcaauaucaccuuacucccagaagaauggccauaauuaaaaaauuaaaacauaauagauguuggcauggauguggugacaaagggaacacuuuuacacugcugguggaaacugcuaguacagcuacuauggaaaacaguguggaaaguccuuaaagaacuaaaaguagaucuaccguuugauccagcaaucccacuucuggguaucuaccccgugaaaaagaagucauuauaugaaaaagacauuugcacaugcauguuuauagcagcacaacuggcaauugcaaaaauauggaaccagcccaaaugcccaucaaucaacaaguggauaaagaaaacgugggguguguuuauguguguguguguguauacauauauauauauacacacacacacauauauacacaauggaauacuacucagccauaaaaaggaaugaaauaauggaauucacagcaaccuggauggaguuggagaccauuaccuugagugaaguaacucagaaauggaaaccaaacauuguauguucucacuuacaaaugggagcuaagcuaugaagauacaaaggcauaagaaugauacaauggacuuuggggacuccaggguaagggguggggauugaaagauaaaagacuaugcauuggguacaguguacacuguuuggaugauaggugcaccaaaaucucacaaaucaccacuaaagaacuuauccauguaagcaaacaccuauuucccaaaaagcuauugaaauaauacauaaaauaauaguaauuuuaaaaauaagcagaagaccauuagucagaggcugucucugcacuaugaguugcuacaugaugaaccauaaccuaauuugguauguaaacaaaccaaaauguaacuuaggaguauaacagccaaguuucagcuaaucacaagcagccagguuucagucaauuauaggcagccagcuuuucacaacaugcccaaauaaggcaaaagccuuaucacacuaugcccaaauaauauaaauaccucauuguagccaaucagaugguuucucgacuuugcuuccauguugaaccaauaaaagcucacugcucaugcugcugggcagagcucucugaaccucuucugguucugagugcugccugauuccugaauuggucuuuguucaauuaagcuacauuaaauuuaaauugucuuaaguuuuucuuguaauaaaacuaugaaucaagaauccuauuaccaagcaagauaucacucacauguaagaaaauaaguaugacaauuauagacauguaaggguucauuuacauuauuuaaaaauuacucuaaaaagcauuuuaaguaacucaaaccacuucacacauacuaugaaaaccuuagaacaguauacuuucauuuccuccuaucauuuuugugcuguuguugccauauauuuuaaguguacauguuagaaaucacacaauacauuuuauuauuuuuacuguacacagaagauuuuaaucuccuuuaagaagauuaaaaacaaugagacaaauuucucuuacauuuaugcaccuauuuaucauuguggaaccuuucauuuuuugguagagcaaacuuuccaucugauaucauuuuugccuuuugccuggauaacuuccuuuaaucuuucuaugagaaagauguguuuacagugaauucugucuguguuugucugaaaagcuuuuacccuaccuucacuuaugaaauauaauuuaaaugcaaauaaaauuauaacuugauaguuuuuucuuuuaguguuuuaaagauaucauuucaucacuucagacucacagaguuuauaagaaaaagucugguuuuauucuuuuauacauaguacucugguaaguaauauaccuuuuuucucuggcugcuuuuaggauucuucuuuacaucacugauuuucaauaauuuuauuuuaaauaugacucaauguggcuccuuuaaguuuauuuugcauacaguuuauucaacuuauuggaucugugggcuuagaguuuccaucaaauguugaaaauuuucaaacauuauuuucucaacuaauuuuucuacuuucuucccucccuuucaggaugucaguuacacauagcuuaguggcugaguuggucacugcucacugaugcucuguucuauuuuuuuucaauccuucuucuuucuguacuucauuuuaguuucuauugcuagauccucaaguucacuaaucuuuucugcuucaguccuaucucuguuauuaaucucaucuaguacacuuuucauuucagcuaucauauucauuaucuccagaaguuccacuugagucauuuuuuucuuacacuucucuccucaugcucauguaucccuuuaugugcuugagcauuuuauaacacuguuuuauauauacauaauauaacagcuauuuuguaaacagcuuugcugcuaaaucuauugucucuguuucuacugauuuauuuauuuuucuccagguuauggcuucuuuacacacaaaauaauuuuuuacuguuuggugaacauugugaauuuuacauuguuaggugccagauuuuguuauauucuuuauaaccaggacauaguuaauuaauaugcagaucaguuucauuacuuugaggcuuccuuuaaacuuuguuaggauaauuccagaacaaucuuuuuucaaggccacauuauccccauuauuaaggagagacucuucugaguacucuuccagugccuuguaucuuacaauuuaggucucuucuuuucacuguugggaauauaaaacauuccccacucugugggagcucugagaaccgcugaguauugcuuuucaguggguccuuccccagccucacugugugcaguucccaccucuccaauacccugagcuacaaauccuagcaaauucaagcuaccugaaaucuaaacucugucuccucaucaagaacucucucccugcuuuguagucuauaaaccaccuucaaacacauagguggguaauuguaaggcucaccucauuuguuucucuuaucucagaauuuacagacauguaucgccuaauggccaacaacugaaaacaucuguuuuauauacuguguccauuuuucuaguucuuuacaguggaaaggauauucccaaaauaacaaaugccucuugaugagagacugaucguuuucggaaaauaucaauauaaagaaaaaaggcaccaaggacugugucucaagccuguaauccuagcacuuuaagaggcugaagugggaagaucacuugaggccaggaguucgagaccagccugggcaacauaacaagacuuggucucuagaaaaaaacauagccaaguauaguggugcacaccuguaguccaaacuacuuagaacuacuuagaaggcugagguggaaggauugcuugagcccaggaguccaaggcugcagugagcuaugauugcaccaucacaauccagccugggugacagacugagauacugucucuaaaauaauaauaauaauuacaugagcaagugcuaaauuuaaaaaaaaaaaaagagagaaaaugcaaguuacaaaaguugugaauuucuuacaaguaauauauuuuaaggguuccauuguguauaaaaaaauuaccuaugugaucuuggacuaguuauuuagacuuuuuagcccuaaaaucaucucaauucaaauuuuccucaaacugaagaaauuuucuucccccaauucacaauccucuacuuccucaucuucaauguuccuacauuacacuauuguaaauauccccuauuugauauuuugguuucuaguuuuaaacuauucaaauccaucuuucacucuaccacuagauuauucuauuuaaaacacaaaacaugucuuauucauguuugaauuccuaauaauuagacuggauuguuaagacaaaucucucuaagaagaucucuuuuaagaugaaaccaggcuaacaauuagagccagccauguagagauuaagaaccaggcagagggaucaaauaaugcaaagaagaauacaagaguaagcuuagugcguguggcaggcagaauuuuaagauggcucuaagauuccuacucucugauuuacacacccuguauauuaauccuccccucacaugucagcucaaucugugaauaauaugcaacaucacucuugugauuauguuauguuaccuggccaaagaaguuauguagauguaaucaagcuggguuagcucaaguuaaucaaaagggagaguauccuggcugagccagaccugaucagguaaggaucaggucugcucaccugaggucagaaaaauucaucugcuggcuuuaagaaaguuagcagucaugcacugagacagccauguggcuagaaucugagaccagccucaaguugaaagcaacucuccuccaauagucuacaagacaauagaggccucaguucuacaaccucagaagugaauuuaaccaaaaacacaugagccuggcagagaacaacugaacuucagaggagaccacagucuuaaaagacaacuugauugcagccuugugagaccauguacagaggaccuguuauuaguccauucucacaaugcuaucaagaaauacccaagaaucgauaauuuauaaaggaaagagguuuaauugccucacaguuccccauugcuagggaggccucaggaaacuuacaaucaugguggaaggcaaaggagaagcuggcacuuucuucacagggcggcaggacagagugagugcaagcagggaaaugccagaugcuuaaaaagccaucagaucucaugagaacucacucacuaucaugagaacagcauaggggaaaccgccgccauaaucuaauuaccuccaccuggucccaaucuucacucauggggauuauggggauuaaaauucaaggugagaucuggauggggacacagaggcaaauuauaucauuccaccccuggccccucccaaaucucaugucuuuucacacuucaaaaccaaucaugccuucccaacaguacccuaaagucuuaacucauuucagcacuaauugaaaaguccacaguccaaagucucaucugagacaaggcaagucccuuccaccuauaagccuguaaaaucgaaagcaaguuaguuacuuccuagauacaaugagggcacacacauuggguaaauauagccauuccaaaugggagaaaaaggagcuacaggccccaugcaagucugaaauccaauggggcaaucaaaucuuaaaguuccaaaauaaucuccuuuugacuccacgucucacaucugggucacacugaugcaagagguggucucccauggccuuaggcagcuccaccccuguggcucugcaggguacagcccccauacuggcugcuuccacaggcugguguugagugucugccgguuuuccaggugcacagugcaagcuguaaguggaucuaugauuccgagguuuggaggauggugacccucuucuugcagcuccacuaggcacugccccagugggaacucuguguggaggcuucaaccccacauuuuccuucccuacugaccuagcagagggucuucauaagggcucugccccuguagcaaacuucugcauggacauccaggcauuucccuacauccucugaaaucuaugcagagauucucaaaccucaauucuugacuucugugcacccauaggcucaacacuauguggaagacaccaaggcuuggggcuugcacccucugaagcaauggaccaagcuguaccuuugccccuuuuagccauggcuggagcugaagcagcugcgaugcaaggcaccauguuccaaggcugcacagagcaggagggcccugagcccacccuacaaaaccauacuuccucccaggccucuggaccugugaugggagggccuucuaugaacgucucugauaugcccuggagacuuccuccccauuguguuagugacugacauucagcuccucacuacguaugcaaauuucugcaucaggcuugaauuucuccccagcaaaugguuuuucuuuucuauugcauugucaggcugcaaauuuuucaaacuuuuaugcucuacuuccucuugaacacuuugcugcuuagaaauuucuuccaucagauacccuaaaucaucuuucucaaguucaaaguuccacagaucucuagggcaggagcaaaaugcugccagucucuuugcuaaagcauagcaagagugaccuuuacucuaguucucaacaaauuccucaucuccaucugagaccaccucagccuggauuucauuguccauaucacuaugagcauuuugaucaaagccauucaauaagucucuaggaaguuccaaacuuucccacauuuuccagucuucugagcccuccaaacuguuccaaccucugccaaaguuccaaaguugcguccaaauuuucaaguauccuuguagcagugccccacucucaguaccaauuuaggacccaguuaagcuaugccugaacuccugacacacagaaacugagauaacaaauggguguuuuuuaaaucaugaaguguguaguaaucuguuacacagcaauagaaaacucauggaauauguuuaagaggcaagaacaacaaaagccaguacaacugggguauggugggcauuuuaagauaaaaaaugggauaaauuguuaggagauuagguuggcgagauagaugagagucaaauucugugaaaauuuguuguuaaaagugggaaguuuuuuauaauuuugcuuguuaaguauauaagaaagucaucacugagauuuaagcaugggaagaaccugauuggcaauuuuuaaagaacauucuggaugcugugaguaaaauggauuguaggaggggaauaacagaagaaggaaugagacuaguuagaaggcuguuacaauaauccggugagaauugaagaaggcugggauaguggcaaaagaaguuagauguggucagauagcggucauauuuuuuaaaguggaguuaacaggaauuauuaauggaucagguugaggguaagaaaaagagaugaggcccagcgcaguggcucaugccuguaaucccagcacuuugggaggcugaggugggaggaucacuugaggucaggaguucaagaccagccugggcaacauggugaaauccugucucuacuaaaaauacaaaaauuagcugggcaugguggugcaugccuguggucccagcuacucuggaggcugaagcaggagaauugcuuaaacccaggaggcagagguugcagcaagcugagaucgcaccacugcacuccagccugggugacagagcaagauucugucaaaaaaaaaaaaaaaaggaaaagaaaaagaaaugaaucagggaugacuuuaaguuuuugacuugacgaacuaagcugaugguggguugucguuuauuaagcaggggaagucuaugggaggaaccaguuggaaugacgggauggggaaaagcauguguucuacuucggauaaguuguuuuaacugccuacucaucaccugaauggugauaucagguuagcagaugguuauacaugucucaaacugcaggcacaauucagaacuagaaguaacagagucauuggcauguaggcaguauguaaagcaaaaguacuggauguauuacuuugggcaaguguguuaauugaaaauacaagguuuucugugccuaaucccuggaaaauacaacugacauauuugagguacagcagaggaagaggaguuugcaaaggagacuuaaaaagagcagucaaggagggaagaauaaggaaaaauaguauaaagucauuuaaacaaacagaagaauguauuucaagaaagagaaaacaaucacacuuuaucaaauaaugcugaaaggaaaaaaauaaaauacauuaggucagagaagugaucauuggauucauaaucauggauauuuaaaugguagacuuaacaaaagaacuguuggaguacugguugugauggacugcccauuaaagcagagacaggacaaaaucuaaguguaaaaaaaccagaaacaauaaugacaguagauaucucuuucaaaauaugucacugugaaaggguucagagauugaagcuauuguguugugacagcuggggucaagagauuuuguuuuguaugguuggcgguaagaugggauauaucacagcauguuuuuagaaaguacauugguauccagcauacuauugcaauaaaauuaaagcugaccuuaucugauucuaccuaacugaauuuuaaugcuaaauaaagccaaaacuuuagccaguucaggauagucaucauauacaugauggcaaaaugaauguuaaaaaauaaacaacuacauugagagaagauaccaggcauccagaguuauucauaaguuaaaugacugguuccuacacacuggucuuucaacaaauauuuuuuggacuuuuuuuuuuuuuuuuugagauggaaucucgcucugucacccaggcuggagugcaguggcgcgaucucagcucacugcaagcucugccucccggguucacgccauucuccugccucagccucccgaguagcuaggacuacagaugcgugccaacaugccuggcuaguuuuuguauuuuuaguagagacaugguuucacuauuuuggccaggcuggucucgaacuucugaccucaugaucugcccaccucagccucccaaagugcugggauuacaggcgugagccaccaugcccagcccuuuuuuggacauuuuuauucaaaguugugaguaccaauaauuuucuauaaaagcauuagaauugucagacuaugagaugggcacgguggcucacaccuguaaucccagcacuuugggaggcugaggugggcagaucacuguguguggucaggaguucgagaccagccuggccaacauggugaaacccugccucuauuaaaaauacaaaaauuagcuaggcacagugguagguaccuguaaucccagcuacucaggagucugaggcagaagaaucgcuugaacccgggagguggagguugcaguaagcugagaucaugccacuacacuccagccugggugacagagugagacuucaucuaaaaaaaaaaaaaaagaauugucagacuauggauggacuuacccucuauuuuccaaccaucuguaauauuucuauauggaguuucaacaaaaaguaaugacauuaaacaugauacuguaaaagauaaauaaaaccucagcugaccaaagcaucauaaauguaauaucuuaaaauaauaagagcauaauuauauuaagaccuacagaauuauccaugucuagugaaacauaaaguaacaauuuuaagacuaaaauuguaaagaguuaaugguuuucaacaaacacauaccaaaaauuaauaauuaauuuuuaauccauagaauuuuagaccauaaaaagaucuuacauguuauuuugcucaaccuauuccuagugccaaacuucuuucuucagcaucucugggaaaucuaugcuucagcuugaaaauguccacuaagaagcucaugcuuucucaaggcaaguacaguggaacagcuuucauauauuaagcuaaaaccugccucucccaaacuuccacucauuaaucuuaguuuuguccuuggaaugcauacuuagaaagcucugaaauuaaaggaacagggucuuuacaaagcaaacuguuugcuuucaaacuuuuguuacuaggaauaucucaaagugggggggaaauagugcuucugugcuuaacaaaugagcucuguuuauaaucaaaaaaguaagguuuacauaaauuauuuauuaucaggaaaucccuaaauucagaaguagccuauagaaguugacguuuuaacaaauuacuaaaaucagcuuuuguuuuguuaucugauguggucaaaguguuaugcauggcuagauacaaauauagcaaaacuucaaacucacuuccucuuuucuucuaauuuaauauuuacugauuaaaucaaauuuuaauaugcacuugcuucugcaguagaacagauaucucauaaagacaaaacucccacugaacguagugguagucaucagugcucacagucuaaugugcacugcaaaaacauguagagaaaaauccauuaaacuacauuggcuauugauucuuuucuccugagaaguuccagccagaauucauugcuaucacugucuuaugcaugguggugccucacuaaugaaagauucagauuuuuuuaaagggucuaccuggccuaaauaagauaugccacuuaaaauuagauucauaauaaaccaaacaccgcauguucucacuuacaaauaggagcugaacaaugagaauacacggacacagggaggggaacaacacucacuggggccugucgggggaggguugggggagacagagcaucaugauaaagagcuaaugcaugcagggcuuaauacccaggugauggguugauagguacagcaaaccaccauggcauauguuuaccuauguaacaaaccugcacauccugcacauguaucccagaacuuaaaauaaaauaaaacuuuuuuaaaagaugguaacaauagacacuggggacuacuagagcgcggaggguggaaggggagcaagcauuuaaaaacuaccuacugggcacuaugcucacuaccuggguggagggaucacuuguaccccaaaacucagcaaagcacaacauacccauguaacaaaccugcacauguaccccuugaaucuaaaauaaaaguugaaauaaaaaauaaauuaaaaagagaaauuuuuuuuaaguagauucauaaauuucacaauuuauaaauuaauacauauaugguucguuguucaucucaugauaaaaucacuuggaaaaacuccaaaugucauuaggaagauaccuauaagaugauguagagucauuuuauggagucuacgauauauuguuaagugaaaaacaaaagcuucauaucauuccuacucgauuucaagguguacuauaaagcuacaauaaucaagacagugugguauuggugaaagaauagacaaacauauuaguggaacagaauaaaauccaaaaauaaacacauaccaauacgcucaagagaucuuugacaaaguagcaaagcaagucaauguagauagcguuucaacaaauggugcuggaacaacugaacauccacauguaaaaaaaaaaauuagacacaggucuuacacuuuucacaaauuaauucaaaauggaucauaagccuaaauguaaaaugaaaagcuauaaaacuucuagaagauaacaggaaaaaaaucuagauaguguuggguuuggcaauaacauuuuaggugcaacacugaaaacaugauauauaaaauaaaaauugauaaauuagacuucauuuaaacuuaaauugaaaaauucugcucugugaaagauacucuuaagagaaugaaaggacaagccacagacuuggagaagaucuuggcaaaacacauaucugauaaaggacugguauucaaaauauacaaagaacacuuaaaauacaacauaagaaaacaaauaacccaauuuuuaaaaugggcaaaagaucuuaacagcuacuucaccaaagaagauauacagaugccaaauaauugcaugaaaagaugcgaauaccauaugucacuagagaacugcaaacuaaaacaacaaugacauaccacuacgcaucuaccagaaugacuaacauauaaaacacugacaacaccaaaugcuggugaggauguggagcaacaggaacucucauucauuacuguggaagugcaaaaugguacagccacuuuagaaaacaguuuggaaguuucuuacaagcuaagcacaauccuaccauguggucuagucaucacacuggauuuauuucauuugagaauuuauccaaaugaaaauaaacccacagaaaaaucugcacaggaauguuuauagcagcuuuauucauaauuacccaaacuuggaagcaacuaaaaugucuuucagucaguggaacagauaaacaaacugugguauauccaugcaaugaaaaauuauucaguggugaaaugaaauaagcuuucaaagcaugaaaagacauaaagaaaccuuaaauuuauauuacuaaguaaaauaauccagucugaaaaggcuacuuacuguauaauuucaacuauaugacauucugaaaaggcaaaacuauggagacaaugaaaagaucagugguugccaaaguucugggggauaaagcaagggaugaauaaggagaccacaaaagguuuuuaggguagugaaacuauucuauauguuacuguaacuguggcuacaugacauuauggauuugucaagagccacagaacugcacaacacaaagaguaaaacccuauauaaacaaugaacuuuaguuaauaauaauguaucaauaucaguugaacaauuuuaacaaauauaccacauuaauguaagauguuaauaacaggagaaaugggagagguagcagguauaugggaacucuguacuuucugcuaaacuuuucuguaaaccuaaauuuacucuaaaaaguaaagucuauuaauuuuuuuaaaucuauaagcaaaaauguaugcauacauagcaugcuuuugauuaagaaaaacggggcagaaaacauaggaaggauaaaccagaaaaacguuagauuaccuauaugggguggguagaaagagcagaagguauaggaaagagguaggauuucucugaguauaccuguuuauauaguuuugaugacauauuaauauuuuauauaauaaaaacaaaacuaaaucaacaagaauguuguggaaaguccuuauaauuugcuaaaaacaaaaacauauaaaccuaauuauauaucaaauagauaacuauauagaauaaaauaaaaacaaauuaauccaagaacguuuugaauacaauacuguuuccacccucaguggaaauauucuaaggaccaaaauaaccgcaaauaaaccuugaauuucacuugguaaauuugguggcauugcugguauuguacagcaauuuaaguguguguguguccgugugugcauguguguugcacaagcacauguacauguguuaaaaaugaguaaauaggcgguuacacugacacuauugggaacugggauuuucaccaugaaagaaaggaaauacaaauauggauugaggaacagacagaauuuguggcugaagagaauaaauccaugacuuaagaaaaaaaaaugcuuucuaccauuaccuacuaaaagguucccgaagcaauaacacucuacagcaaacaauaaguuccuuugcuauauauuuaagccucggguuuaugaaucuaacauugcgucuuaucuguaguugggacaugcuguuucauucuuggaaaauuucuuuuuccucuuuuuuaccugcuuaaugcuuacucauucuuaauguuucagcuaaauaugacuauuucuggaauauaauaaauuaccaucgauuucucuccuuaaggccuaugaugacuucacacuacuuaauagauauccagauauacacacucugcccaugguuuucuuuaucagauugugcuggacuaucuuaucuagcuuguuuucuuccuacugcuguucugugugugugugugggugugcacgcacgugcgcaagcacaugugcgugcucuuuauuagcucuaacagauuuucuuauuuuucaaauuuauucauucacuuauuuuuucauucauucagauucauucaaugacacaggcagugugccagugagucucccaaguuccauucuauacuugggaacauuucauugccccccugccacccacuucacacagacacauacgugugugugcaugugugcacaugugcacacacacugcugaaauucuacuucuguaaauucuucaauuaauggaagagaagucaccauuuuuccauguguuuuuucuuucuaaaauugugccauccaugaaucuaccauucaaauaacagugauucuuuucauaaauaauuacuuacuuaauuuauguuuugcucagcucuaucucuucagugcugacuuucuuaagcuauaaaauccuggagaguaaaaauauaugccuuuucauccccuuugcccuuaguccagcaccugagaagccguuaagaaauaccaacaauaauaaugcauuaugcacagugguugcacaauaaauauugacagaaugaaaacaauacccuuaauaaaugugaaagaacagagucuucuuguauugcuguuuuaaauaucccguaacuucuggucaaaucuccuuacuugcuaaacgauacaaaaauuaaguaauuuguaagacuugcucaagauuuuauacuucaggauagaguguauauucaucaaugcaaguaacuaaaauguagaagaguaaaaugaauuuugauaaaguuauuccauuuuaauuucaacacacaggugcuggcacugauaaauguaaccugaagguuuaauucagagaaaucuuugccuucaagcauauuuaaaauaagcuguuugcauuuuccugcauauaauuauucuaacccugaaagcaccuuuuaaauauggauuacaaauccagcugccuuaaaaugaaaguaaaagguuuuccuuucucagucuauuuuguaaguuggaaauuaauguaacagaacuauuuugagcuuagagaguuaaaccuucugacuaaauucaugcuuaauuuuuuaauguauuugugaguuuaccaagguuugcacagaagacaacuuuuaaaauaucaaaaaaauuaacaaugcuucauuuuuuuaacauuguaauuuuuaaaauuagucaucucuccuccuagagggauacuucacaaaagaggcaucccuugaucaggcaggguuuacucagccaagugcuuggaaugaacccagaggaaccaaaagcccugauauuucugguauuuauuugcaagaaacaguagucuccccauacccauaggggugaguuccaagacccccagugaaugccugaaacugaggauaguacccaauccaacugccaucaauaggaacaugcuucuuuucauguauucuacucacaaacugaaagccuuugccauauugacuaaggauuuauuacacacuguggcuguaccuuuugcaguuugaggugcaacaacaaagcgagcacgaauuuuuuuuccuucuuuacaauuucaugaauggaagucucaucccuaccauagaucuuagcaaccucagcacauaauauuuuuuuucuuuauugagaacuuucaccuuuucacuuaaagcacuuuacagcuucuccuuagcauaucccaauugccagcaucauuacuuuuguagugguaccacagguaacugaaaccacgaaagugaaacccuggauaaaggggaacuacuguauucccauucuaauugcuaggauccuguuccuaacuggaaacuaacuuuagaauaugcuagagaauuuauguucugcaauucaauaaaacaugugauugcccuugacagucucaggucauugacuugaagcagaaaguuuugcuuaaugacuacagagcagucuuccaauccccaccugcugaacuggugcuuaucucuuacuuguaauaucuuguaaggaaugcaagaaaccuacaaacucuacuauucugauuauuucuacaaaggugaccuuuggugaguacguggucuaagucccaagaaacaacacauuauaguuuaacuuuguuaccacacuucaauaauuguuucucaaccugguauauagaaauucuaaccaggcuccugauccauuuugccuauuucauaucuuagaaucucuugguugugccaccacuuccugacaccaguugagacacuuugggguugcaaguggguuugcacuuugggguugcaaaauccaacucaaacuagcuuaaucauaaacuggaauguauuaucucuuggaauccagggaaaugcuaaacaauaguauauagaugagccucaauaaaaaugaaccaacaacagauaugcugcugcugcuuuuuuuaaaucuuguauuuuuuuauuuuuauggguacauaguagguguauauauuuaugagguacaugagauacuuuuauacaagcauacaauguguaauaaucacaucaggguaaacgagguauccaccacuucaaacauucaucauuucuuugugcuacaaacauuccaauuguauucccucaguuauucacaaauguacaacauauuauugccgacuacagacacccuguugugcuauuaaauacuagaucuuauucauuguaucuaaccauauucuuauacucauuaaucauuuccccauccccgcccccaacacuacccuuucccagccucuggucaccaucauuuuacucucuguccccauaaguucaauuguuuugauuuuuagaucccacaaaugagugagaacaugcaaaguuugucuuucugugccuggcuuauuugacuuuauauaacguccucuaguuccauccauguuguugcaaaugauaggaucucacuuuuuaugucugcauagaacuccaucauguauaugugccacauuuucuuuauccauucaucuguugauggacacuuagguugcuuccaaaucuuggcuauuaugaauagugcugcuguaaacaugggagugcagguaucucuuugauauacugauuuccuuucuuuugaguuuauaucuagcagugggauugcuggaucauaugguaguucuauuuuuaguuuuuugaggaaccuccauauugucuuccauaguggcuguacuaauuuacauucccaccaaugguguaugaguuuucccuuuucuccacauccuugccugcauuuguuauugcuugucuuuuuaauaaaagccauuuuaacuggggugagaggauaucucauugcggauuuauuugcauuuaucugaugaucaaugauguugagcaccuuuucauauaccuguuggccauuuguaugucuucuuuugagaaaugucuauucagaucuuuugcccauuuuuaaaucagauuguuguaucuuuuuccuguugaguuguuugaguuccuuauacacucuaguuauuaaucccuuguuauagggguugucugcaaauauugucucccauucugugggucaucuauuuacuuuguugauugcuuacuuuccuaugcagaagguuuuguuugauugccuuuuuuuuauuugagacagcgucuugcucuaucgcucaggcuggaguguagugguacaauuauggcucacugcagccucaacuucccaagcucaagcaauccucccacuucagccucccaaguagcugggaccauaggcaugcaccaccaaacccagcuaauuuuuuuuuuuuuuuuguagaggcagaguuucccuauguugccuaggcuagaagcuuuuuaacuugaugugauuacauuuguccauuuuugcuuugguugccugugcuuugggguuauuacucaagaaaucuucaccuagaacaauguucuagagaguuuccccaauguuuucuuuuaguaguuucauaguuucaggucuuagauuuaagucuuuaauccacuuucauuugauuuuugcacauggugaaagacagggucuaauuucauucuucugcauacagauauccaguuuucccagcaccauuuuugcaauuuagauuucauucucuuucauuauaaauuuuguuucuccacaaggcaagaaacauaaccaucaaacaucuaaguuuuauaucuuaaaguuucuuuggccauuaaaggaaacauugacucucuuucucuugauuccaguuuuaaauuuccugaaaauaauucugauuggccugacuugaauuagaucaaucugaaauauuccauuguugagauggcauaaaguggccaacuguccugguuugccugaaacuaaaggguuuccugggauacaaaugcauugacucugauacuacuguugauuauuuguaauaguaaaugaaacaucaugucuaauguauucugugugcuucaaaucuuuuuaaaagaaacugaauuaacuaacuggcauccauugcucuucucaaaaauguuuuuauauuuugacugaaacccaccauguguuaugguuaucuccuuucuuuacguuucaguaucccugaaacauauuauccuguuucacgccucguaucuuuacauaugguauuuccaccccucccuccuuauucaugugucauaauccucuucauuuaaacucagcucagacacugcuuuugugaagucauugugaauccuguucuccuccccugggagaguuagucauucccuguuuuguucucuacucccaggauauauuucuguacuugucucauaauucuguuuuauaaugauuuauuuacaaauauaucucaucacuauccuauaagguauaugaggccacaucuuuauauucccagugccuagcgcaaagccuggcauaauggcaguauccccauaaacguuugauaaaucgaaaaaucuaaaauaggaauauuuuaaauuugguuuggggcaucagguaucauguaccuauuauuucuaugaucagucucugaauaauagccaguauaucuggcauauuuguuaacauuuaaauuacaaaugauagcguaucaagaauaaugugauuacuaaaaccaguaacgugauuugggccuuuaaagaaguuaauuucaagcuugacuuugcuguaggcccaaaguuuauaacuuguuccuaaauagaaguuaaaugauaccaaaauagauguauaaauaagaacagaaaguaugaacauaaucagcccuguucucugacagguggguuggaggcugaggaugcaucaaacaguaaggaaaguccucugugggcuaacgugggagggauaauuuggcuuccucucuccacaggcagauggaggccuuuucccccugcauaguuucugagaaugcaaugaggaaagaugauugggaugcucauguggaacaagcauacuauuuggcuuacauuaaaaaauagaaugaaaugaguaucccuagggagaacuaacuuacccaagacacuucaacauuucuagacucauuucucugaaacagucuagaaauagaaauauauacacauauuagacuacaucuagaaauguauuuguauauguauuucuagacacacacauacauacacauacauuacauaauauaugcauacacauacauauacacacacacacacacaaacucucuaaugaaaacugugccaauuucaaaagugaagcuaaauuauauuucaguuaugcucccuugcaucacaaaaugaggcucuccagcuuaauauuggcauucccaagccaggucaagaaaguaggaacugauaagcugucugguauaauaguucucuagcuaaaucucuagaaaggugcugcaucugacauuucuucaaauuagaggaaauuucauaagacuugguagggaaaaauaugucagaugacagauauguauaucuucuuucacuuuugcccaaaacgucauuaaaaugauagaaauauauuuguaaaggcauaaagacauaaagacaagcagaacaagaaaggaaacuacaguaacaaaauucuggaugcuauaaaguaguuacaugacaaaugacuaagcagacuugagaacuggauccaaagcuagccauagaaaaaacuaaaaaucaaccugguaagacuacagaggacucaugaauuccauaccagauaugucugaaagaauaggugaauaaaaaggcaaaaauagcaacuaugugaaagaauauuuuaaagcaguuagauucccauaugccuuucucacucuauagccuggugacuauccgucccucaaucuugcaaaacacugaagauuucuucucuuagaagaguaaaacaguucucuaaacuaaucacaguuuaggguaugguaagauaaugaaaauaggugauugagaaaacagguauacuggauguugacauuccugugugcccucuuuccuuaaacagcccuaagaacuucccauuaggagcuuaaaagagggauuuccuaggauguuccggucaaaaggaaagaucuaaagaugcuguugucaagacuucuccaacuaaacggaccaauggaaucaaccuaaagcaaagcuuauagugacaauggcaucuagaagacaauauggucauuguuuuaauuucucuagggaauuuauucucaacacuagaauuucacauccagucuaugaagcaagagugaggacagaauaaagacauuugcaugaaauuacugggagaugugcugcauaaaacaagaaaaggcauggcauacagaaaucaagauauccaacaaaggaaagaggcaauaaaaauccccaaaugauggagaagaauugcaagguugauaccuaucagaaggaguagaaggugaccaguccggauuuaaaugaauggaaaggcucaggugagauucuucagagacaugaagcauauagaauaccugauacacauaaacauguuaagaaaagaugaaucuggaauuguguugacuauauauacauagaaaaucaaucacaauuaggaaagacaauaauuaauccuaggggaaauaaaacauuguaauggaaaggaagaggaaucaggguuuagccuauggaucaguaacauuauaaauaaugucugucgacaaacauaacaaguaaauagagaagacuaaucuaacccaaauuuugcaauuaauguguuaaagagauagucauggaaaacaugugugugcuugugugggguacuguuauaguaagcgguaggaaagagaggaaugccauauuccauagugggaugucaauagauaaugucuaaaacugaaacauuaaaaaggagcaaaacaaauagauuagagacauaaagauaaauacccagauaacuagauaaaagagaugaagguguugggaggaagagaagaagaugguugggguacugcuuuuuaaaauaauaauaaauaauauauaaauauuugacaauucaaguaaaauccucuaaaacuuauauaaucuugacuuuaugauauuauauaauuuaccuaaauugaaugcaucaauucucacccauaauuacuuuuuguaagcucaaacauuaagaauuuggcaaugucuuauaacucgcuucuguguuagggaccuauggcagaaaaacucugaaauuacccccaauuaucccuguuucucaugccuuuguguaauccccuccccuugaguggaagcagaaccucugguuuguuucuagcuaauagaauaugacaaagacaauggcauguuaauuccauaguuaugucacauaagauugugacuuccauuuugcaaacauacccucuguugauucucucccuuucuggcuuugaugaaguaagcuaccauauggaaaggccaugugguaaggaacuaagggaggcuuacaaacugaggcucucggucaaggaauugaaagcauucagcaaggaacugggguccuccauugacaaaccacaaggaacugaauucugccaacagccaugugagcuuggaaccagauccuuccccagucgagccacagacgaggucccauuccugggugacaccuugauucuagucuugugagagaacaugaaacacaggacccaagccaugcuugaauaccugacacacgaaacugugagauaauaaauauuuugcauaaggcacuaaauuugugguaaaauggccacacagcaauagaugaauaaaggaucuaaccaaaagagaccaugauuugagcaccucuccaacucagguguuacaaaacaaagauuguugaguucugcuugucagagguaugaauucugacugauugcccaagccuccaguuuguuugcaucauccagcuacuuaagcugacacugcuacaccuaagguucagcacggcaaccucagaugacuucauucugggcuacgucauccagaagucauaaaauuaucucccaaauauuaaagaauuuaaacaaauuacuaucuuuagcagugccaaucaaaugucacccaagagguaaaguaauauucacuucaguauuuuagagggaaaagucauaagagguaacacauaauagaaaucuucuauuuaauaaaauguuaagaguagaugggaaaaaucaaguuuuucacccucuaaaaagcauacauucuaauuacaacacauuaaauauuuaacaaauccugaguucuagguaaauggaaaggaaauuuccuuugcuuuuaauuuagaauaaaaggugauauguggguggugaaauggugcagcuuacagugccuacauuauuguacagaaagaaagggcagcagggagcuagaauuauagaagcaggaaaaaaaugguaugacaaccagguaggcagcaauagccauuugacucucuaccuaccagcucucauaggcuucgcugucuuagaguuauuauaacuauauugcuaaaggaaaaaaaaagugugguuauuuguuacuuagcuguccuuaucacacugacucagaaaucagguguaugugugggagaauuuucaaaagaaaauccacauacagcugugaaucacucaccugaagaacaaugagccaaaugggcaaucacugagacaaacugucacuuaucaaaacucuauaagcaaugcggagguuaaccugggggucugaaucugucagugccaaguuucuuccagcugucacaaucagacaagcugccuccaucauaaaauaaugcaagccaaauucaacugagugggacucaaagaaacaucugaaauucaacaacagcagccuugccaucuagacuauuuugugacaaaguugaugacaagggguuggaaaugacagaauacaucaguauggaagucucucuuuaaugacccgaugucaugaaugaagcaugaaggacaagugacuaaacacauaucauucuuauuuaauaccauauugaggacuaaggcucacauuauccucuacagguacugcuuggauccuguauuaguuucuuuugcugcuguaacaaauuaccacaaauuuaguggcuuaaaacaauacaaaugcauucucuuucagcucuggaggccagaaauaaaaagucaguuucacugggcuaaagucaaggugccacaagggcugccuccucuagaggaucugggaauaaucuguuucuugacucuuccagcuacuaguggcuaugcuauggguauuccucauuggcucuggcucauggccccuuccucccaucuucaaagccaacaguuuaguaucuucuaucauugcauuuccuuauucuuucuguagucuauucccccucuaccucccucuuauaaggacaguugugauuacauuuaggguccacccagauaacccagaauuauuuccauaucucaaaauccuaauucacaucacaucugcaaaggcucuuuugcuauaaaagguaacauucacaguuuccaggaauuccaaccuggauauuuuugggagcuauuauucagcauaccacagguccugucucauaaauguuuuaauuggaagcuguucgucugugguaaagaguuuauuacucauauacaaagccaucuaaaauacaauaaauguaaauuaauuagagauugaaaaucaauaguauuuugacuccuaaacacuuuauuaauuguucugggaaauuuuugagccauuucucuugguaaacauaauguaaaaaaacuaaagagcagauuuuagugggucaauauuaucuuggcaaucucaugaauacugcugugugugugugcacgcacacaugcacacauaagcacacgcaagcuugugagggucaggagauuggauaaagguauacuaaaagugaacacuuaaagaauucuaaugauaccugcaugcuguacucauggaaugauucacacuauaacaacuaugggugcuggaauguacuucaguaagcaucaggcaauuuuaauucaaaagacucugagcagauuuugaagcaguugcucugacaccugaggguguaaccauguuugaaggugugugggauguugagaggagaaggaacuaacuuuuauuaaauggcuacuauguuucagguacagaguuacagguuuuacaaauuuuaauguuaauuaaggcucacgacaacagaugcugcagguauuaaaagaagauaauaauacccagagaggauuagguaacuuuuccaaguuugccagcuagcaagugguauagcuagacccacauuuuuugaaaucuaaauauccauaaugggguuuuagcauguuagagcagauauaggagaggucaagagucaagaaaacacaaugguucuuucagaagagcucuggggaaaaaaggaaugagacaaggggaacaacauuaucacacacugcaccagcugacuauagugguaggucauaaugacugcaaaacagugugcugggccccauuuagugaugacaucacaauacauaacucuaagcaaauaauguuucuacuucugauuccuauuucacugcuuugacccuccaucacuuaccugggcacagaguauucaugguaucacuucuccccauaaaauggguuugacaaccaagcccaauuucuuacuucauccucagauguagccuuauaccuuuaaaugaacagagauuaauugcauagauuuuccauaauggggcucauucauuuuccguauuauaguaucuacuuucuaaagcugauuuuacugagaucuaauuuuccagcucaugccacuauagaaaugacuguuaaaaacuugauccaacaggaaucugagucauugcuacaaugggaaaacaucuguaccauaaagaagacaagauugucauuucauuagaauuccucuugacuuuaaaccauuaaucuuugucaauaaugggauauucauuugcagcucacuaacuggaauaaaacugaaagugauaccaucaagauauacauaauucuuugauaaaaccacagcuuuaggguccaugccuccaaggauaauuaaagaaauagcuguugguguucugagucugcuugaguaaccuauaguuuaugggauaaaagagauagauuaagacagggcgaauccaggccaagacuucacugagaucucaagucuauguauugugaacauauguuuugugggggaaaugaauuagguaagacaugucaugaaacgaaggacugagagucaaugugguuuuuucuuuauaauaccuucaguagcaaaaauuccuuuccuuauuuauaggcauccuuucauacuuugccuuuaucauagagaagaauauaucucugguccuuuuuagucaauaucuaugaacagcugaaaauacaaugaaaguaagaauugcuucccaaaguuccuguuugcauuuccguuuauuuacauauguuccuuuagaccuauauagacccaaaacaaccugagauaaaugccacucauaacuguaucccucaggggagcauauaauuaacaaaagcccauauauuugagcuuaacugauuaaucauuuucccucaacucuuuccauuauaauucaguuugcuuuguguuaauuccuuuuuuuaaauaaucucucaacuccuccuaucacccaggcugaaaaacccaggaaucaccaaagacccucucccucaacuccugcagccaaagcccaguccaacagaaucuauccaacuuccuuauuucacuuuuccagcucugauuggauuuguaucuauaauaaaucaaaaagaggucaacuaagaacaaaacuaacaucauuagaauaaaaucaccuuauaaacuggaaugcaaggugcuaauguuauuacuuuucauucugauaaaaucaccuuauaaacuggaaugcaccaugcuaauguuauuacuuuuaucuuuuuuuuaguuuguacugcacaucacaguuuuaauuuuuuuaacuuuuaaguucaugguucauaugcaaguuuguuauauagguaaauuugugugauguggguuuauuguacagauuauuuugucacccagguacuaagucuaguacucauuaguuauuuuuccugauccucuccacccuuccagccuccacccucugauaggucccaguguauguuguuucccucuaugacuuaaacaaaaugacaaaaaagagcaaacaaccacauuuaaaagugggcaaagaacgugaacacuuuccuaaagaagauauaccuguggccaacaagcauaugaaaaaaagcucaauaucaaugaucauuagagaaaugcaaaucaaaaccacaaugagauaccaucucgcaccaaucagaauggcuauuauuaaaaagucaaaaaaauagaugcugucaagguugcagagaaaagggaacauuuauacacaguuggugggaauguaaaauuaguucaaccauuguggaagacaguguggaaauuccucaaagaucuaaagacagaaauacaauucaacccaguaaucccauuacugcauauauacugagaggaauauaaaucauucugucauaaagacaugcacacauguguucauuacagcacuauucacaaaagcaaagacauggaaucaaacuaaaugcccaucaaugauagacuggauaaagaaaauaugcuaccuauacaccauggaauacuauccagucauaaaaaauaaugagaucauguccuuugcagggacauggcuggagcuggaggccauuauccuuagcaaacuaaugcaagaacagaaaaccaaacauugccuguucgcacuuacaagugggagcugaaugaugagaaugcauggacacacagaggggaacaacauauuauuuuuaucuuuacuugaaaaguaugucuugauuuccuccauauaaaauucaagaccuuggggaugcagacaaaauagguuguuucaugugggguuuaugauaggcugaauaauagcccuuucaggauggcuacauccuaauaaccagaaccugugaauauuuuaccauaaacacacaucacaaauggaccuaugaagcuacaauuaagguuccugagagugagagauuauuauggauuaucuggauagacccaauguaaucacaagaguccuuaaagaaggaaaaaagggucagagucagacaagguaaugagaagagggcaagggccccaauagucucaaccccuuauaacauacauucaaauacaaaauaccaucuaaaucucaucagcuuaaaagucccaaaccuuaucaucuaaaggaucuaugggugaggcucuggauauaaucuauccuggagaaaaauaccucuccaucuguggaucugugaagcuagaaaauaaguuaucagaucaaaaaguacaaugguggcacaggcauaagauaaucaauauagacauucucauugggagaaaauagaaggggaaaaaggggucacuauucccaugacauuuugcaauccaacugggaaaauucuaucauguuucaaaacccaggaauaauccucuguggcuggaggguccauccucugggcccguggcucugccaugaccucagaguuauccuucuuuucaugaaggguaaugugucuaaaccugaguuauuuuauuagccuguuuucuaacuggagaauuuuggaagucaaacaaacuucuaucauuuuguucuuucucugucucuuucaguccaagcuggcaguguuucugcugauacaacauucucaaaaacuuugugggucucccacacauguuacagggaguaaauccaucaaacaagaggcucuuccacaaauauaugcaggauaaucccauuuuuauuccuggcuccuauugagaucugugaggggauccaugagucauauacuuaaucuuuucaaacacuuuucugugugauuaaaauacugaccuuaucuaaaaucguuccaaggcacaagcaaaagacugcucagccaaaccuuuggcauucucuccagagcauacuuucuuguaaucaaaucuucuaacuuuagcaguuuuugaaagcugaauagacugagaauuuccuaaauuaucaaguccuaguuccuuuuuguuuaacaguucuucccuuaaucuaugucuuuccucucacauuuuacuauaagaaacaagaaaccaagccacauuuucaacaguuugcuuggauuuccaagcaaauuuccucggcuaaaucuccacgcucauggcuuagaaauucuauuucccacaugacugcagaacaaaauucugcugagucuucugccaccaaauaacaaagaacccuuaauuccaucugggccauuaugaggaguuccuuuaguauuccuauuucuauaguuuauuuauaauagcuuuaauauucucuaagacaauuuaauuuuucucuauuauguuccucacuuccuucugagcccuuacuagcagaguccuuaguaucuauauuuccacuagcaaucuguucacagaaaucuaggcuuuucuaucaugcuccucaacauucuuccagccucuucccacuggaaaucacaaccacauuuuuagguauuuguuagcgcauaaccucacuuccaaaucuauguuagcuuccuacuucugcuccaauaaauucucacuaacuuaguggcuugaaacaaugcacauuuaucuucuuuuucuggagguuagaaaucuaaaauagauuuugaaauguacugacauuuaugagucuuacaugacuaaaauuaaagugucauaaucuucauuccuuauggauacuuuagggaaggauccauuccuugccuuucccagcuucaaaaggccgcccgcauuccauggcucauggcuacaucacuuggaucuccgcuucugucaucacaucucuuucucucccucugcuucugucauggcauugcuuuuuaugacacuaccccucaugccuucuucucauaagaacccuugugauuugucuggacccacagaaguaauccaggauaaucucaagaacauuaacuuaaucaccugugaagcccuuuuugcuauguagucauaccucauuuuauugugcuuugcuuuauugcucuuugcacauauugccuuuuuacagauugaaguuuugucacaacccugcauggagcaagccuaucagcaccauuuuuccaacagcaugugcucaccucauggcuuggugucacauuuugauaauucucacaauauuucaaguuuuuuauuauuauuauauuuuuuguggugauuugugaucagugaccuuugauguuacuacuguaaucacuugaggcaccaugauccacuaucacauagaauggugaauuuaaucaauaaauguuguauguguucugacugcuccaccaaccagccuuugcccugucuuguucuuucuccuugggccuccuaguuccugagacacaauaauauugaaauuagacugauaaauaacccuauaauggcuucuacuguuccagugaaaagaagagucauacaucucauuuuaaaucaaaaacuacaggcccagugcagugguucuaccuguaaucccagcacuuugggaagccaaggcagacagaucacuugagcucaggaguucgagaccagccuggccaacauagugaaaucccaucucuauuaaaaauacaaaaaaaaaaaaaaauuagcugggcaugguggcagguuccuguaaucccagcuacucgggaggcuaaggcaggagaauagcuugaaccugggaggcggggguugcaauaagcagagauugcaccacugaacuucagacuaggcaacagagcaagaguccaucuaaaaauaaaaaauaauaaauaaauaaauaaaaagcuacaaaugauuaagcuuggugucaggccucgagcccaagcuaagccaucauauccccuguaaccugcacguacacauccagauggccaguuccugccuuaacugaugacauuccaccauaaaagaagugaaaauggccuguuccugccuuaacugaugacauugucuugugaaauuccuucuccuggcucauccugacucaaaagcuccccuacugagcaccuugugacccccaacuccugcccaccagagaacaauuccccuuugacuguaauuuuccuuuaccuacccaaaucuuauaaaacggccccaccccuaucucccuucgcugacucuuuucggacucagcccgccugcacccaggugauuaaaagcuuuauugcucacacaaagccaguuugguggucucuucacacggaugcgcaugaaauuuggugccgugacucggaucaggggacccuuggagaucccuugggagaucaauccccuguccuccugcucuuugcuccgugaaaaagauccaccuaugaccucggguccucagacccaucagcccaaggaacaucucaccaauuuuaaaucggguaagcagccucuucuuacucucuucuccaaccucucucacuaucccucaaccacuuucucuuuucaaucuuggcaccacccuucaaucucucccuucucuuaauuucaauugcuuucauuuucugguagaaacaaagaagacacauuuuauccguggacccaaaacucaggcaucagucacagacuugggaagccagccuucccuucauguuuaaucauugcagggacgccucuccauuuacccacguuucagaggugucugaccacgcagggaugccugccucgguccuucacccuuagcagcaagucccgcuuuucugggggaggggcaaaaaccacaaccccuucucucccugucucuaccccuucucugcuuuucuggggugcaagaaccccccgaucccuuauuuccgugccccgaccucuuaucucugugccccgaucccuuauuuccaugcccugaccucuuaucucugcaccccaauuccuuauuuccaugcccugaccucuuaucucugcgccccgaucccuuauuuccacaccccgaccucuuaucucugcaccccaaccccuuauuuuggcgccccgacaccuuucccacuuuucuggaggguaagaaccuccgaaccucuucccuccaugucccuacucucucuuuucucugggcuugccuccuucacuaugggcaaccuuccacccuccauuacuccuucuucucccuuagccuguguucucaagaacuuaaaaccucuucaacucacaccugaccuaaaaccuaaaugccuuauuuucuucugcaaugccgcuugaccccaauacaaacucaacagugauuccaaauagccagaaaauggcacuuucaauuuuuccauccuacgagaucuaaauaauucuugucguaaaaugggcaaacggucugaggugccugacauccaggcauucuuucacacaucagucccuuccuagucucuguucccaaugcaaaucgucccaaaucuuccuucuuucccucccgccuguccccucagucccaaccccaagcgucgcugagucuuucuaaucuuccuuuucuacagacccaucugaccucuccccuccucgccaggccgagcuaggucccaauucuuccucagccucugcuucuccacccuauaauccuuuuaucaccucccuuccucacaccugguccagcuuacaguuucauuccgugacuagcccucacccaccugcccagcaauuuacucuuaaaaagguggcuggagcuaaaggcauagucaaaguuaaugcuccuuuuucuuuaucccaaaucagauagcauuuaggcucuuuuucaucaaauauaaaaacucagcccaguucauggcucguuuggcagcaacccugagaugcuuuacagcccuggacccuaaaaggucaaaaggcugucuuauucucaauauacaucuuauuacccaaucugcucccaacauuaaauaaaacuccaaaaauuaaauuccggcccucaaaccccacaacaggacuuaauuaaccucuccuucaagguguacaauaauaggguagaggcagccaaguagcaacauauuucugaguuacaauuccuugccuccacugugagacaaaccccagccacaucuccagcauacaagaacuuccaaacgccuaaaccgcaguggccagguguuccuccaggcccgccucccccaggagcuugcuacaagugccagaaaucuggccaccaggccaaggaaugcccacagcccgggauuccuccuaagccgcgucccaucugugugggaccccacugaaaauuggacuguucaacucaccuggcagccacucccagagccccuggaacucuggcccaaggcucucugacugacuccuucccagaucuucucggcuuaguggcugaagacugacacugcccgaucgccuuggaagcccccuagaccaucacggacgccgagcuuuaaguaacucucacaguggaagguaaguccguccccuucuuaaucaauacggaggcuacccacuccacauuaccuucuuuucaaggccuguuucccuugccuccaaacuguuguggguagugacggccaggcuucuaaaccucuuaaaacuccccaacucuggugccaacuuagacaauacucuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccauguuagccaggauggucucgaucugaccucgugauccgcccgccucugcuucccaaagugcugggauuacaggcgugagccaccgcgcccagccgacaauacucuuuuaagcacuccuuuuuaguuauccccaccugcccaguucccuuauuaggccgagacauuuaacuaaauuaucugcuucccugacuauuccuggacuacagcuguaucucauugccacccuucuucccaauccaaagccuccuuugcguccuccucuuguauccccccaccuuaacccacaaguauaagauaccucuacucccuccuuggcgacugaucaugcaccccucaccaucucacuaaaaccuaaucacucuuaccccgcucaaugccgauaucccaucccacagcaugcuuuaaaaggauuaaagccuguuaucacuggccuguuacagcaugggcuuuuaaagccuauaaacucuccuuacaauuccccuauuuuaccuguccuagaaccagacaagccuuacaaguuaguucaggaucugcgccuuaucaaccaaauuguuuugccuauccaccccauggugccaaacccauauacucuccuaucuucaauaccucccucaacaacccauuauucuguucuggaucucaaacaugcuuucuuuacuaugccuuugcacccuucaucccagccuuucuucgcuuucacuuagacugacccugacacccaucaggcucagcaaauuaccugggcuguacugccacaaggcuucacagacagcccccauuacuucagucaagaccaaguuucauccucaucuguuaccaaucuuggcauaauucuuauaaaaacacacacgugcucucccugcugauuguguccgacuaaucucccaaaccucaaucccuuacaaaacaacaacuccuuuccuuccuaggcaugguuagugcagucagaauucuuacagaagagccaggacugcacccuguagccuuucuguccaaacaacuugaccuuacuguuuuagccuagcccucaugucugcgugcagcggcugccgcugcuuuaauacuuuuagaggcccuuaaaaucacaaacuaugcucaacucacucucuacaguucucauaacuucuaaaaucuauuuucuuccucacaccugacacauauacuuucuguuucccggcuccuucagcuguacucacucuuuguugagucucccacaauuaccauuguuccuggcccagacuucaauccagccucccacauuauuccugauaccacaccugacccccaugacuguaucucucugauccaccugacauucacuccauuuucccauauucuuucauguuccucacccugaacacacuugguuuauugacggcaguuccaccaggccuaaucgccacucaccagcaaaggcaggcuaugcuauaguaucuuccacaucuauuauugaggcuacugcucugccccccuccacuaccucucagcaagccgaacucauugccuuaagcccucacucuugcaaaagcacuaaaagucaauauuuauacugacucuaaauaugccuuccauauucugcaccaccaugcgagagguuuccucacuacacaaggguccucuaucauuaaugccucuuuaauaaaaacgcuucucaaagcugcuuuacuuccaaaggaagcuagagucauucacugcaaaggccaucaaagggcaucagaucccaucgcucaggacaaugcucauacugauaagauagcuaaaaaagcagcuagcauuccaacuuauaccccucacuuucaguuuuucuccuucucaucuggccacucccaccuacucccccgcugaaacuuccacuuaucaaucucuucccacacaaggcaaaugguucuuagaccaaggaacauaucuccuuccagccucacaggcccauucuauucugucgucauuucauaaccucuuccauguagguuacaagccacuagcccaucucuuagaaccucucauuuccuuuccaucauagaaaucuauccucaaggaaagcacuucucaguguucuaucugcuauucuacuacccuucagggauuguucaggccuccucccuuucccauacaucaagcucggggauuugccccugcccaggacuggcaaauugacuuuacucacaugccccgagucagaaaacuaaaauaucucuuagucuguguagacacuuucacuggauggguagaggccuuuccuacggggucuaagaaggccaccgcagucauuucuuuccuucugucagacauaauuccucaguuuagccuucccaccucuauacaguccaauagcagaccagccuuuauuagucaaaucagccaagcaguuuuucaggcucuugguauucaguuaaaccuuuauuucccuuacaguccucagucuucaggaaagguagaacggacuaauggucuuuuaaaaacacaccucaccaaucucagccaccaacuuaaaaaggacuggacaauacuuuuaccucuuucuuuucucagaauucaggccuauccucggaaugcugcaagguacagcccauuggagcuccuguauggacgcuccuuuuuauuaggccccagucucauuccagacaccagaccaacuuggacugugccccaaaaaacuugucaccccuacuaucuucugucuagucauacuccuauucaccguucucaacuacucauacaugcccugcucuuguuuacacugccgguuuacacuguuucuccaagucaucacagccaauaucuccuggugcuaucccaaacugccacucuuaacucuuaaaguaaauaaauaaucuuugcuggcagggcuaugcugaaccuccuuaggcacucucuaauuagauguccuggguccucccaauucuuagaccuuuaauaccugcuuuucucuuucucuuauuccguucaguuuuucaauucauacaaaacuauauccaggccaucaccaauaauucuaaaugacaaauguuucuucuaacaaccccacaauaucaccccuuaccacaaaaucuuccuucagcuuaauaucucccacucuagguucccacgccgccccuaaucccacucgaagcagcccugagaaacaucgcccguuaucucuccauaccaccccccaaaauuuucgucgucccaacacuuuaucacuauuucauuuuauuuuucuuaauauaagaagacaggaacgucaggccucugagcccaagcuaagccaucauauccccugugaccugcacauacacauccagauggccgguuccugccuuaacugaugacauucuaccacaaaagaagugaaaauggccuguuccugccuuaacugaugacauugucuugugaaauuccuucuccuggcucauccugccucaaaagcuccccuacugagcaccuugugaccucccacuccugccugccagagaacaaccccccuuugacuguaauuuuccuuuaccuauccaaaucuuauaaaacggccccaccccuaucucccuucgcugacucucuuuucggacucagccugccugcacccaggugauuaaaagcuuuauugcucacacaaagccuguuugguggucucuucacacugaugcgcaugaaacuuggugaaguauguaugucaaaagcugagauaggcuaaaaccuaggccucaugugccaaacaguuaguaaaugcauuauguaagaaauacauuucaaguugugaaugcaaaggaaaaguucuugaaggaaauuaaaagugcgacuccaguggacacauaaaugauaagaaagggaaacagccugaaugcugauauggcaaaaguuuuagugcucuggaaagaucaaaccagccacaacauuuacuuaagccaaaugcuaauccagaacaaggcccuaacucucuucaauucuaugaaggcugagagaggcaaagaaacugcagaagaaaauuuugaagcuagcagggguucaugagguuuaaggaaagaagccauuuccaugacacaaaagugcaagaagcagcaagugcugauggagaagcuguagcaaguuauccagaagauccagcuaaauugauaaaggugacuacacuaaacaacagauucucaauguagaugaaacagccuucuauuggaagaagauuccauuuaggacucucauaaccagagaggagaagucaacgucuggcuucaaagcuucaaagaacaggcucacuguuuuguuagguuguaaugcagcugguaacuuuaaguugaagccaaugcucauuugccauucugaaaacacuaaagcuuuuaagaacgauguuaaauguacucugccugugcucuauaauaaaauaauaaagccuggaugacaguacauuuguuuacagcacaguuuacugaccauuuuaagcccacuguugagaccuacugcuuaaaaaaagauuccuuucaaauuauuauugcucaucgacaaugcaccuaauuacccaagagcucugacuggagguguacaaggagacuaauguuuucaugguugguaacacaacauccauucugcagccaauggaucaagcaguaauuuugacuuucaagucuuauguaagaaauacagggugggaccaagauggccaacuagccaacaagaagcagccaccgucagaggcucccaucaaaaagaaccauaauagcaugugaauccugcacuggcaacugagguauccagguucucucaucagaacugacuaggcagcuggugugaccuacagagagaaaggaagcgcaguggugcagggggcccaccugagagccacacagggcagguggguccccacccccccgccaagggaggugaugagugagugugccauccagccugggaaaccaugcuuuuuccacagacugugcaaccuccugaucagaagaucucacucaugaaaucacaacaccagggccuaggaucccaaccacagagcccugcagauucucaaaagccucucagcuagacucugcuuaagccugcugaguucccgguggggaggggcgacuagcaccacaguugcggcugccuguuguuuaagccauuugagcucuuugggggaggggcagcagccagcacugggacugauagcugccuaacacacuaagcucccugggcaggggaaggguggcagccaucucuauagcuccaggcuacacuuuuccccugcuggagccaggaaggcuugguuccgagaggggucccccgcagcacaacacaccggcuguggcagacuguggccagagugccucuucaggccugacacugacccaucccuccucacugggaggggccucccugcaggaacuccaacuccaggcaggggcucaggcacaaagcucugaucucccuggccggagccacuagggguaggggugaccacagucucugaggaccagcagacuuagccuuuccuccugcuaguucugagaaaucugggcagcccagaugaguggguuuccccucagcaaagcacucccccuccaccaagggauagucaaagagcuucauuaaacggguccugcucccuguaccacccaacuaggugagaccaucaaacagggguugucagacauccuauacaggagugaucauacuggcaucagaucggugcuccucgaggucagaguucccagaggaaggaggaagcacccaucuuugcuguuuuccagccuccuugagugacuggcuccaggcacaggagcgagccagaugaauagugccugaagugaaugcccagcaaaccacaacagcccuacagaagaggggccugaccauugaaagaaaaacaaacagaaagcaacaacaacagcaucagcaaaaagugucuccccaaaaaaacccaucaaggauaggcagccucaaauaucaaaacuagacaaauucaugaagaugagaaaggaucaacaaaaaaaaaaacacugaaagcccaaaaggccagagugccucuucuccuccaaaugauugcaaugccgcuccagcaagggugcagaacugggcagaggaugagauggacaaauugacagaaguaggcuucagaagguggguaauaucaaauucugcuagcuaaaggaucauguucuaacccaaugcaaagaagcuaagaaccuugaaaaaagguuacaggagcugcuaacuagaauaaccaguuuagagaggaacauaaauaaccugauggagcugaaaaacacagcggaagaacuucgugaagcauacagaaguaucaauagccgaaucaaccaagaggaagaaaguauaucugaguuugaagaccaccuugcugaaauaaggcaugcagacaagauuagaggaaaaagaaugaaaaggaaugaacaaaaccuccaagaaauauaggauuauguaaaaagaccgaaccuacaauugacuggaguaccugaaacagacagagaaaauugaaccaagcugcaaaacacacuucaggauguuaucuaggagaauguugccaaccuagcaagauaggccaacauuaaaauucaggaaauacagugaacaccacuaagauacuccaugagacaaucaaccccaagacacauaaucauuagauucuccaaggucgaaaggaaggaaaaaaauguuaagggcagccagagagaaagaccaggucacccacaaagggaagcccaucagacuaacagcagaccucucagcagaaacgguacaagccagaagagagugagggccaauauucaacagucuuagaaaaauuauuuucaacucagaauuucauauccagccaaacuaagcuucauaagcaaagaagaaauaaaauccuuuccagacaagcaaauacugagggauuucaucaccaccaugccugccuuacaagagccccugagggaagcacuaaauaugaaaaggaacaacugguaccagccauugcaaagacacaucaaaauauaaagaccaaugacacuaugaagaaacugcaucaacuagugugcaaaauaccaagguaguaucaugaugacaggaucaaaaucacauauaacaauauuaaccuuaaauguaaaugggcuaaaugccccaguuaaaagacacagacuggcaaauuggauaaagagucaagacccaucagugugcuguauuuaggagacccaacucauggucaaagacauacauaggcucaaaaugaagagauggaggcaaguuuaccaagcaaaugaaaagcaaaaagaaagcagggguugcaauccuagucucugacaaaacagacuuuaaaccaacaaagauaaaaaaagacaagggcauuacauaaugguaaagggaucaauucaacaagaagagcuaacuauccuaaauauguaugcacccaauacaggagcacccaaauucauaaaacaaguucuuagagaccuacaaagagacuuagacucccacacaauaauaaaaagggacuucuaacacccuacugucaauauuggacacaucaaugagacagaaaauuaacaaggauauucaggacuuaaacucagcucuggaucaaguggaccuaaaagagaucuacagaacccuccacaccaaaucaacagaauauacauucuucucagugcauggcauuuauucucaaauugaccacaaaauuggaaguaaaacacuucucaguaaaugcaaaauaacugaaaucauaacagccucucagaccacagugcaaucaaauuagaacucaggauuaagaaacucacucaaaaccacacaauuacauggaaauugaacaaccugcuccugaaggacuccuggguaaauaaugaaauuaaggcagaaaucaaguuauuugaaaccaauaagaacaaagagacaaugugccagaaucucugggacacagcuaaagcaguguuaagaggguagcacuaaauccccauaucagaaagcuagaaagaucucaaaucgacacccuaaccucacaauuaaaagagcuagagaagcaagagcaaacuaauccaaaagcuagcagaagacaagaaauaacuaagaucagagcagaacugaaggggauagagacacaaaaaacccucaaaaaaaucaauaaauccagcagcugguuuuuugaaaaaauuaacaaaauagguagacugcuagcuagacuaauaaagaagaaaaaagaaucaaauagacacaauaaaaaacgauaaaggggauauuaccacuuaucccacagaaauacaaacuaccaucagagaauacuauaaacaccucuaugcaaauaaacuagaaaaucuagaagaaauggauaaauuccuggacacauacaucaucccaaaacuaaaccaggaagaagucgaauccauaaauagaccaauaacaaguucugaaauugaggcaguaauuaauagucuaccaaccaagaaaagcccaggaccagaaggaaucacagccaaauucuaccagccaaauucuacaaagaggagcuggugccauuccuucugaauaugauccaaacagugaaaagcagguacucuucccuaacuaauuuuaugaggccaucaucauccugauaccaaaacugggcagagacacaacaaaaaaaagaaaauuucaggccaauaucccugaugaauauugaugcaaaaauccucaauaaaauacuggcaaaccgaauccagcagcacauuggaaaacuuauccaccacaaucaaguugacuucaucccugggaugcaaggcuaguucaacauacacaaaucaauacauguacuccaucacacagacagaaccaaugacaauaaccacacgauuaucucaauagaugcagaaaaggccuuugauaaaauucaacaugucuucauauuaaaaacucucaauaaacuagauauugauggaacauaucucaaaauaaucagagcuauuuaugacaaacccacagccaauaucauauugaaugggcaaaagcuggaagcauucccuuugaaaacuggugcaagacaaggaugcccucacucaccacucccuuucaacauaauauuggaaauucuggccagggcaaucaggcaagagaaagaaguaaagcauauucgaauagaaagagaggaagucauauugucccuuuuugcagaugacaugauucuacauuuagaaaacccagcaucucagccccaaaacuccuuaaacugauaagcaacuuuggcaaagucucaagauacaaaaucaaugugcaaaaaucacaagcauuccuauacaccaacaauagacaagcagaggaccaaaucacaaaugaacucccauucacaauugcuauaaagagaauaaaauaccuaggaauacagcuaacaagggaugugaaggaccucuucaaggagaacuacaaaccacugcucaaggaaaucagagaggacacaaacaaauggaaaaacauuccauccucauggauaggaaaaaucaauguugugaaaauggccauucugcccaaaguaauuuauagauucaaugcuauucccaucaagcuaccauugacaaucuucacagaauuagaaaaaacuauuuuaaauuucauauggaaccaaacaagagcccauauagccaggacaauccuaaucaaaaagaacaaagcaggaggcaucacacuaccugacuucaaacuauacuacaaggcuacaguaaccaaaacagcaugguacugguaccaaaacagacauauagaccaguggaacagaacggagaacucagaaauaacaccacacaucuacaaccaucugaucuuugacaaaccugacaaaaacaaacaauaggaaaagaauuuccuauucaauaaaaggugcugggaaaacuggcuagccauaugcagaaaacugaaacuggaccccuuccuuauaccuuuuacagaaauuaacucauuaaagacuuaaauguaaaacccaaaaccauaaaaacccuagacgaaaacuuaggcaauaccauucaggacauaggcaugggcaaagacuucaugaugaaaacaccaaaagcaauuccaacaaaagccaaaauugacaaaugagaucuaauuaaagagcuucugcacagcaaaagaaacuaucaucagagugaacaggcaaccuacagaaugggagaaaguuuuugccaucuacccauuugacaaaggucuaauauccagaaucuacaaggaacuuaaacaaauuuacaagaaaaaaaaauccccaucaaaaagcgggcaaaggauaugaacagacacuucucaaaagaaaacauuuauguggccaaugaacacaugaaaaaaagcucaacaucacugaucauuagagaaaugcaaaucgaaacuacagugagauacugucucaugccagucagaaugguaauuauuaaaaagucaagaaacaauagaugcuugggaggcuguggagaaauaggaacacuuuuacacuguuggugggaauguaaauuaguccaaccauuguggacgacaguauggcaauucgucaaggaucuagaaccagaaauaccauuugacccagcaaccccauuacuggguauauauccaaagaauuguuccauuauaaagacacaugcacacauauuaucacugcagcacuauuuacaacagcaaagacauggaaccaacccaaaugcccaucaaugauagacuggauaaagaaaaugcgguaaauauacacgauggaauacuaugcaaccauaaaaagaaaugagaccuuguccuuugcagggacuuggaugaagcuggaagccauccuaacuaacuaacuaacaggaacagaaaacuaacacaggaagagaaaaccaaacaccgcauguuuucacucauaagugggagcuaaacaaugagaacacauuuagcggacaacagcauaguguaaauacaacuuuuauaugcacuuggcaaucaaaaaauucaugugaguugcucuacugcaguauucgcuuuauugcaguggucuauaacugaaucuguaguaccuccaagauaugccuguguaaagcaacauauucacaguucuguguauuacaauaugaacaucucugacaugaaaauaugcauaaauuucucacauuuuauaagaaguuuuuauucaucuuucuauuugaaagacgcuuuuuccgaguauaaaauucuagaucaacagcuaauuuuuggcaccuuaaagacaguccauugucuuucugggucacaaagcuagugguaagaaguccaccaucacccucaucuuuguuccucuguaaguaaugaaguuuuggaguaaugaaguaguuuguaaguaaugaagucuugaaguuugccauuuuuuuucuucuggcaauuuaaauuuuauaguugagguucuuagagugaacuuuucauuucaguaauuguacuuuugaacuccagaauuucuauuugauuuuuuuaaucauuucucucuauugauauucucuauuugaugcaaaauuguuguccuaccuuccuuuauuuaaucauaguuuccuuuaguucuuugaacauaucuacaauggcuacuuucuagucauuuucuguuagucugauuucugaccacugucugccuacuguacuuacaaaguaugggucauauuuucuuguuucuuuucacgccuuguaaauuucuguugguaacuggacauuuuagguaauacaucauggcaacucuggguaaacccaccccugcucuaagcuuguuauuauuuguuuuuuguuuaaugacuagcuggacuauuuuagugauguucacugucauccucaucuuugauucucuguaaguaaugaguauuuuucccuuuuugcauauaaguuugucacuguaucacuagauuucaguaaacugaauaugacacaaauaugacuauuuuccaccugcaguguuaaaucuuuggugcugcuccucaaggaguuguagcuuugugcauguaugcucacauauggucacuaguaugacagugguuuuggcaggacucuuuuugucacuuucucugaccacguccaacuguuaagcuauacuaagugccagcugauuuauguacugcuuucaacaauacuguggugcuuaaauuguucuauagacuaauccaucaaauucggguuccuuugaaggaguaguuccuacauuguuugagauuugcucuguugaggagcucugaccacagaugggcucccacaagcugucucuuuccaagggucucugcuuuucccuccaggcaaaaucucaagucaagucaaguugagucaaggcucuggaacuaggguggcagacaauugcacacucucucuaaaugacacccucacuuuaagagcugagugcucauugggggccagagaggguagaagaugaacaguagccuccaacuuuuuuggcuaguuucauccagaguacaacacucacuuuacagacuaaggcaaggacaaucagaaccccuauaucucagcagugccaaacccaagguaaagacugcaucucaugaguggggagcugugcagaagagaacucuacuucagaacuuagccucaucaauagguagcuguggcaagaugagaaaagcugauauccuuccauaggauuacucucugucugggagcugagaauagagagagccuuguguuuugggcugcacuaguuuggaauaaaguuuccaucucacuaagcugggaaaggggauaggagggaaagggucucaguuccccauagagucuugcuguucuuaccacaauacagauuuucuggaauaaacguuucuucaucuacuuauuauuuaaauguccguaagacuauuuccagagacauuaaaugguauguuguuggguauuuuuguuuuuguuuuuguuuuguuucuuuuguuuguuugcuuguuuuugagauagaguuucccucuuuuugccuaggcuggagugcaauguuguuaucuccgcucacugcaaccuccaccucccaggcucaagugauucuccugccucagccucccucccaaauagcugggauuacaggaaugcaccaccacaccuggcuaauuuuguuuuauguuuauuuguuuguuuuugagaaaaugucucacucugucacccagacuggagugcaguggcacgaucucggcucaccgcaaccuccgccucccaggcucaagcgauucuccugccucagccuuccaaguagcugggauuagaagcgcacgccaccacacccagauaauuuuuguauuuuuaguagagacgggguuucaccacguuggccaggcuugucucaaacuccugaccucaaaugauccacucgccucugccucccaaagcgcugggauuauaggcgugaaccaccgugccguguguguguguguguguguguguguguguguguguguguguguguuuuaauuaucuucaccaguuuuucuggagaaagagucugcugagcuucucaugcuauuaugccagaagucccucccagucaauuaacaaaaguggcaagguaauucaaugagaauacuagagucuuuuucaaaaaaugguucuagacaaugaauaugggaaaaaugaaacucaaccuuuccuuauaccauaugcaaaauaauuuggaaugaauuacagccuaaaauaugagucaaacuauuaaacuucuagaagaaaacacaggaagaauuauuuguaauuuugggauaggcaaagauaucuuagcuaagacacaaaaaacaugaaucauacacacauaaaaacuguaaaacugggcuucaucaaaaauuuuuaaaguuuguccuuuaaaagauacuguuugaaaaauuaaaaggcaagccaaagacuacgagaauaacuuuaaaaccagaaaucugaugaagaacuuguuuuugagauauauaaagaauucguucaacugaauaauaauauagacaauccaauuuaaaaaugggcaaaaguuugaacagauacuucaucaaagaagauaugaaaaauggcagguaaauaaaugauguucuauaauauugguagucuuuaaggaaaugcaaauuaaaaacauaggauugcacuauuuaccuauuaaaauggcuaaaacuuaaaagacugaugauauauauagcaaggguacagagcaacuguaauacuuauacauuacugauuggaacuuaauacgguacagccacuuuggaaagcaguuuggcaauuucuccaaaaguuaaacacagacauaacauacagugcaguaaucccacucuuacauguuuacccaagagaaauaaaaacacaaagacuuacaugcaaagauucauaacuuuauuaauuacagccaaaaucuggaaacaacccaaaagucuaucaacaggcaaauggaaaaacauguuguaguauagccuuacaauaaaauacuacucagcaacaaaaggaaugaaaauaucagugaaagaagccaggcacaaaagacuguaugauucuauuuguaugaaauucuagaaaaaaaaauuauagugauagaaaacaaaugugugguugccucagggugggacuguuguguggaaauuggccaaaggggcaugagagaucuuuggaagaaugaugaaaauauuuuauaucuuuauuaugguuuuaguuacauuacuauacauuuuucaaacucacccaaaugaauccugaaugaauuuuauuguauguaaauuauaucucuaauuuuuuuaaaaaggucaauagaagcaauguauuaaauaguuuaauaguagagaaagaucagaaagaucaagacagagacacugucuucauguauauuaacguacuggauaucagagauucugaaauuauguuagauaucaagugaaaauauucuuuugucaaucauuuucauucaguuauaagaccaacauuuaucuuaagccagauuugugaaaauucaauguaaaaauaauuaucauacuauuucacaagaguguuauuguuccuugcucauuaaaaaaaaaaagagcaagagcuuguugagaugucauagcuaacaaagcuauaauaaacugggauuuuuuucagcaaauguuugcuucccuuuccucuuugggucaggguauacuuuccacucccacugccuuuaugcuuggccaugcgacuugccuuggccaauggaauaugagcaugcaggauaucugcagaauuuuaaauguguuugccuggcuuagcuugcacuugaacuccuauaaucaacauacaauuacaacauaggcaaccagugccucguuaggcuggaucaaagcgugaagcuuaaggggcaaaccugaacuuaccucaaagccugaaacugaacuacagcauaaagcagagccacuuaugagugagaaaauuaaaagcuugccaugauacgacaauaaauuugguggagguuuguuacagcauuauuauggcaagaguugacucaugcaaagcuaacauuugaggagaaauuacaauguucuaggcacugagcuacaaacuuuacauauauuacccauuuaauuaucacaaugacucuguaagagaaaacauuuuacauugucuuucuaaaauacaugaugaaacugaagcacaaauaggauaauugcauuauccaaagucucagagcuaguaaguaaccaaguaggguuuaaacccaggauguuauaauucuaauacucacccaaugcacuaauuaucaagaucaaauugaauuuuuaaauucuauucuucuaguugggguguuaaauaaugguuaacacucuucaaucuccauaaacccuuuucuucucuuccaccuaaccugcccaucuucauaccuguaucuaaacaaccaucuguuuacuguaccccaacuauuggguugucaguagcuagaaaaguacgcugccuugacuccauuacaagguuagcugauggacuuuccauauagcuuugcaaaauugugcuuauucauguugauuccauuuugcauuccccacaauagcuguuccaaaccuuaaucaccaagauaagcccuaauuucaauaucacuccucacucucagaggcucugccuccaauuucucagcgaaugaauauuccaugaggcauuacauuucucaacuuuuuuccucucugccuuauaccuaucuuuaccucucuuuacuccuugcucuugugucucaaaugacuaauucuacccccauauucuugucuuucuuccuucccauaccuuguucuacagauuuaacaucuuccuuuuuuucucucuacuagaaaaccuacauacucauuucucccacaucuuuuuuugcucuuguugcccaggcuggagugcaauggcaugaucucagcucacugcaaucuccaccucccggguucaagcaacucuccugccucagcacccccgaguagcugggauuacaggcaugcgccaccacgcauggcuaauuuuuguauuuuuaguagaaaugggguuucaucauguuggucaggcuggucucaaacaccugaucucaggugauccgcccgccucagccucccaaagugcugggauuacaagcaugagccaccaugcccagcccuauuucucccacaucuuaagccaacuuucccacaaaccugaugccuccacaaaccaccaacucaucuuucucccugcuuucacuguuaaacuucuugacaaaguaggugcuguaucagcuaucuuuacuuuuucaccuccaagucacuccuuaauacauuacaggauaaguuccccuucugugaacuuuaccaaaauuauucucucaaaggacacugacaguuuccaaauugcccaagucagugaucuccucucaguuaucaucuuaaccaagccuuucucuaguuuuaaaugacacuguugacuacauacaucaacuccaucccuccagacccacccugcaccucauuguuccuccuucuauguucucuauuaugguuacugguaccauucagucacccagccuagaagucuuaaggucaaucuagucuuuuucucucucacaucauagccucuuaacaucuccaauauuauuuuuauuacuauuuugcucuuauaaucucucaguuggacuauucaaaaagucuucuaagauggaaguugauagcaauaaacaccuacaucaagaaacguagaaagauuucaaauaaucagucuaaugaugcaccuaaaggaauuagaaaagcaagaauaagccaaaucccaaaguuagcagaaggaaagaaguaauaaaaaucagagcagaaauaaaugaaauagagaccacaaaaauaaaaaagaucaacgaaaugaaaaguuggcuuuucaaaaagauaaaauugguaaaccacuagcuagacuaaccaagaaaaaaagagaaguccaaauaaauaaaaucagaaauuaagaaauggaacaucacaaccaauaccuuagaaauacaaaauaucaucagagacuauuauuaacagcuauacauaaacaaacuggaaaacccagaggaaguggauaaauuccuggacauauacagccuaccaagaauaaaucaggaagauacagaaaaccugaacagaccaauaauaaguaaugaaacugaaucuguaauaaaaagccucccaacaaggaaaggcuuggaccagauggcuucacugccaaauucuaccaaacauauaaagaagaacuaguacuaauucuccucaaacuauuccaaaaaaauaaagaggagggaguucucccuaacucauucuaugaggcuagaauuacccugauacuaaagccagacaaggacauauaccaaaaaaaaaaaaaaaaagaauaucccugaaggacauagacacaagaaucuucaacaaaauacuagcaaacugaauaucauagcacaucaaaaagauaacacauacaccaugaucuaguugcauuuaucccagguugcaaggauguuucaacauaugcauaugaauaaacauaauauaucacaucaacagaaugaaggacaaaaaugauaugaucauugauagauacagaaaaagcauuugauaaaauucaacaaugcuucaugauaaaaauucucaacaagcuagcauagaagguagauaucucagcauaauaaaggccauauaugauaaacccacagcuaacaucauacugauggggaaagcauuuccucuaagaacuagaacaagacaaagauuuccacuuucaacacucuaugcaacauaguacuggaaguccuagccagagcaaucgggcaagagaaugaaagaaaaggcguccaaacuggaaaagaaguaaaauugucccucuuugcagacaauuugaucuuauauuuagaaaaaucaaaagaaaccaccacaaaaaaaaacucuucaaacugauaaauucaguaaaguugcaggacgcaaaaucagcacacaaaaaucaccaguauuuuuauacaccaaaaaugacauagcugaaaaagaaaccaagaaggcaaucuuauuuacaguagcuacaaaccaaauaacuaaaaauaaauuuaaccaaggaggugaaagacaucuagaaggaaaacuacaaaacacugauaaaagaaacugaagagggcauaaacaaagagaaagacaucccauguucacagaucagaggaauuuuauggcaaagaauucaaaagcacagacaacaaaaacaaaaauagacaaauggaauuacauuaaacuaaaaagcuucugcacagcaaaggaaacaaucaacagaguggagagacaaccuauugaaugaaagaaaguauuugcaaacuauucauccaacaagggacuaauauccagcauauaaggaacucaaaugauucaacaauaaaaaaucuaauaaucccauuaaaaauaggcaaaggaaaugaauagacacuucucacaagaagacauacaaauggccaccagggauauggaaaaugucaacaucacuaaucaucagggaaauguauauuaaaaccacaaugagauaucaucuuaccccaguuagaaugacuauuauuaaaaagacaacagaugcuggugagaaugcagagaaagggaacuuuuauaugcuguugauaaaaauguaaauuaguacagcugcuauggaaaacaguauggagauuuuucaaaaaacuaaaaauagaacuaccaugagauucagcaaucacacugcugguuauuuaucaucaaaggaaggaaaaucaguauaucaaagggauaccugcaccuucguguuuauuacagcacuauucacaacagcaaagacauggaaucaacuuaagugcccaucaacggaugaauggauaaagaaaaugugguauauauacacagugaaauacuuguuguccauaaacaaugagauccugucauuugcaguaacauggauggaacuagaaauccuuauguuaagugaaauaagcuagacauacaaagacaaacauaauaucacauuuucucacucauauguaggagguaggaaaugcaaacuuaaucaaguaauggcuuuccucuccuucccacuucuuuuccccaugcuuaaaacccuucaguggguauuccauaauuauccauugccuagaggauaaggacaaaauguauuauugggaauaaaagguguuuuuuggccaccucuacagcaucaacuccugaucaccuccccauaccaugucuuuugcauccuugaaauuuuuccaccuuguucccuucaacaucacuuuuuccuauuuccccccuaccuguauaauaccuuucaguuucuuucucaaguucuuagauccucgggucuuuguuuuuucuucucuuuuaguucuagcaauucaauugcccugggcaaucuugucccuucugaucaaccucauuguguccaauuaccaacuauucaucaauaguuuauuaauuuuaaucuacagccuccaacuucuauccuaagccauagucccauagacauucuaguauugucaauaauuacagcucauuuauugaaaaacugcuacaugccagcaauugcauuagaugugugcuagaacacauaucuauuaaauaaacauguucucauuuaaucauuacagaaugcuguaaagcaggcacaacuguuccuucuuugggaugaacacagacauggaauuuauauaauguucccaguaucauauagguagaaaguacugaagcaggaauuuaagcucagauuggcaaaagaccauuucacuaagauauucacuacuuuuuaccaaacuccuucaaaugcacauauucuucaguacuuauuuuauuauuuccaaacccaaaucacuccuccaucuguuauucccacauucacucauagcauuacuauuaccaggaacaauacagaagucuuccaagucacauuuaacuccuccaucuaacuucuccauauuuguugggucacuaagccacauucuaugucugaaaaagcucuugaaucucccucuuuuuauuguaguauuucaguagcugucucacaguucuccaguuucugccccuguaauuaucuuccauuucuuugagaguuugcuuucuaaauaaaucugacugacuucuagauaagaugacugaauaugcacaauucucuucucuacuuccuaauauuccaauuaaaaugaucagugaaaccauuaaaaacuagaguaaccaguacuacaaagaauaacauucucacaucacagaauugaagaacuuuuguaaguuuaggccaacagaacuuuauugaaggaaggauuggcccaaaccaagacucacuaguuaagaaguaacuugucuggaaaguaaauaaagaaaaccaacagaaucccacaaauaugcucacauuuggagaugugaggcuggaggugaaagcagacugugaagcaaguaggugauuccauauuauauuguggcuuagaguucagguggacauuugauaccaacucacuguguccuuuaagcuguaagggcauauacuaauacuaaguacucuguggaauauuaaguccucuaguggaaggccaucuuccacuagacuuaggcaaagguuaggaauuacuucccucacuccauucagggaggguauucacauacacuaucaucuuucuccaaaaucucuccccuaaucucccaucuccuaacuuucacaaccuccaugucuuuaagggaugcaaaugcugucugacuaauucuacccuaacuuuauaaauucuaaaccacuguggccuucaaccccacuuugaaguauggcaucuaguaucuuggggcuucaaaagaaacuuccauuuuaauauccuuuuacauuaauacucuggauaauguuucuaucugugauuugauggggaggguuuuuuuuggggggggcggggccaaaaaaaaaguacucaaagcuaaaaaaaaacuccauccaagauccuuugucuuuaaauaccauuugaaguuagacuaguggauucaaauccugacuccagggacuaacuguauaagcuuugggaacaaucuaagcaucuuaaguuucaguuuuauaaucauauaugaauaaugacaggccuucguagaauuuuguaaaaauuaaauaacauguucuaaacaaaacuaaaaauauuucuagcggcccauaaugucccagaugaaaacugccccuuccacgucucuuugaccaugucaucuccaugucaucucuaugucaucuccgccucacucaugccaaucacuguuccaccucaagcguucugcugccacuucuuuuuucucccccuggaauauucauuccucagauaguugauggcuaacuguuccaccugcuucaggucuuugcucaaacacaaccuucuccauccuucucugagcauuccauguaagccuaagccccuuguuuuacuucugcccuucccucuaucccuucccugccuugauuugcuccauagcacuuaucaucuuuaucauacuacauauuuucacauuuuuacuuuaccuucugucuccucccacuuaaugugggauccacuaagaacauuaccuggcacauaagaacuagucgguagccaggaacaguggcucacaccugcaauccagcacuuuuggagacagaggcaagagaaucacuugagcccaaguguucaagaccagccuggguaacacagugagaccccaucucuacgaaaaaagaaauuaauuagcuggccaugguggcacacacuuacaauuccagcuacuugggaagcugagggggaggaucacuugagcccaggaaguugaaacuagagugauccaugaucacacaacuguacuccagccugguuaacagagggagaccgugucucaaaaacaaaaacaaaaacaaaaaacaaaaaacaaaaaaacuagucaauaaauacaggcuacuguuguaauaauaaauauuauaaugcagcaccucugugaaauauuccaggaaucagaccugacugcagcauuguuccuggcuuacacacagcaugucaggcaaaaguguaugucagacaagaaaaaggaucugcucauaugaaagcauaggguaaaaucacaaggaucaaugaggguaaguuaaauaguaucccauaacaucaaguuaaauuaaaaauuaggagaaauggggccagcaagauggccaaauaggaacagcuccagucugcagcucccagugagaucaaugcagaaggcgggugauuucugcauuuccaacccagguaccuggcuuaucucacuggaaaugguuagacagagggugcagcccauggagggcaagcugaagcuggguggggcauccccucacccgggaagugcaagggguugggaaauuccuuccccuagccaagagaagccgugagggacuaugccaugaggaacagugcacuccggcccagauacuacacuuuucccacuguuuuuacaacccacagaccaggagauucccucuagugccuaugccaccagggcccuggguuucaagcacaaaaguagguggcaauuugggcagacaccuaacuaggucaggagaucgagaccaaucuggcaaaauggugaaaugccauuucuacugaaaauacaaaaauuagcugggugugguggcgcguacauguaaucccagcuacucgggaggcugaggcaggagaaucacuugaaccaggcagucugagguugcagugagccaagaucacaccacagcacuccagccuggcaacagagcuaggcuccgucaaacacacacacacacacacacacacacacacacacacacaucaggaaacaacagaugcuggagaggauauggagaaauaggaaagcuuuacacuguugaugggaguucgaccauuguggaagacaguguggcaauuccucaaggaucuagaacuagaaauaccauuugacccagcaaucccauuacuggguauauacccaaaggauuauaaaucaugcuacuauaaagacacauucacauguauguuuacugcagcauuauucacaauagcaaagacuuggaaccaacccaaaugcccaucaaugauaggcuggauaaagaaaauguggcacauauauaccauggaauacuaugcggccauaaaaaaggaugaguucauguccuuugcagcgacauggaugaagcuggaaaccaucauucucagcaaacuaacacaggaacagaaaaccaaacaccgcauguucucacucauaaguggaaguugaacaaugagaacauauggacacagggaggggaacaucacacacuggggccugucgagguggggggcaaggggagggauagcauuaggagaaauaccuaauguagaugagagauugaugggugcagcaaacuaccaugacacagguauacccauguaacaaaccugcacauucugcacguuucccagaacuuaaaguauaaugaaaauaaauaaauaaauaaagcuaaauuuaaaaaaaagaauaagaucauguccuuugcagggauauggauggaccuagaggccauuauccuuagcaaaguaacacaggaagagaaaaccaaauaccauauguucucacuuauaagugggaacuaagugaugagaacacauggacacauacagcggaacaauacacacuggagccuauuggaggguggaaggugguaggaaggagaggaucaggaaaaaaaaaacuaauggguacuaagcuuaauaccucggugauaaaauaauauguacaaacccccaugacauaaguuuagcuauguaacaaaccugcacauguaccccugaacuuaaaagaaaaaaaaaaacaguggaggcaauugcaaagacaauaaaugauguauuugauuacauuaaaaauugaaauaucaaaacauucccagaaaaauuaaaaagaaagaaaaccaaagcagaguauucacacacaaaaaauauaauuuuuuaaaaaaucuagauuuuauaauuugacuuaagaaacaacauaacaaagacugguauggaagaugcaaaauuuuuaaaucuaaguaugucacuguuuauuaaaguaguaaaaauaagaguaagugaaauauacauuaaaaugcacacuagaauuuggcugggugcagugaaucacgccuguaaucccagcacuuugggaggccaaggcaggcagaucaugaggucaggaguucgagaccagccugaccaacacggugaaaccccgucucuacuaaaaauacaaaaaaaaaauuagccaggcgugguggugcacaacuguaaucccagcuacucaggaggcugaggcaggagaaucucuugaacccgggaggcagagguugcagugagccaagaucgcaccacugccauccagccugggugacagagggagacucugucucaaaaaaaaaaaaaaaaaaaaugcacacuagaauuuaaguuuuuauucucugguugcuuuuauuucaauuacuaauguuagaagcuauuuuuuagcaaauccucacaacuuuguacuuuuccaggcaauggccaucaauaucuuccuuucucuaaacuggccaagaaaucuugauaacaaauuauuuugaccucaugauauuauaucagcuaccucuaagugcuuucucuaguuuauagccuagcaggcagaaacucugccuuaauuauucacauaguaucugauuuaaguaaccuauuauaugcauauacuuaauuauaauaaauuguaucagggucucucaacaaaaugaacuucuauuauuguaagccuacagauauagggaaagacuuuugucucaagcacgacaaaaucuagagguucaccuaaaauagagauuaaagaaaaagaccuuucaguuccuauggcuauuguuucauuaauuuuagcauacauguaauuuaccaauaaucuaauguagucuauuuuuuaaaugauuuuuaaguauaacuuugucuccauuaugaauauauuuuuacaaguuacuucuaaaacuaagucuauuucuaaaaccacauuuuggaauggcaagucaucuuuucucucagaaugaaaucuacaacauaacguuaaucuuuuaaggauagagaggaagagaggauuaauaaagcaaaucuuauuccaguacaaauaggaaucuguauguggcuggagagguaccuuuaugcugaauaauuuucaaguuauauguaacuuuauucugcgguuuucuauuccugugggacugugagagcaggugaaauauuugucaccaaccauaaaaaauuaugaacuaaaguaauaacacuacaauaacuaagcucgucucuaacagauguauucuguggaaauuucccaagacaacagccuuagaaaauggaguaguguuaauuucaacuaaaguucuccauauugaacuaugucuuacaggucuaaaguucugaugcaucuuuaaauaauggguuuugaaaaaagcuucauacaucuugauaacuuucucggcuuuaauuguguugauucuaacaauccuaaugagaaaaauuaaugccuaaagccaauggugauaccagaaagauauuaaaauacagcuggcacucuuuauccauggguuccacgucugcagacaagaagggucaacuaaggaacuugagcauccauggauuucaguauccuuuggguuccugcaaccaacccccugcagauacugaaagaugacuauaucuggaacauacagauuaaaugagauauugggaauaacaaaagagggagaaaugaaggggaaagguuucaagugaauuaauucuuacuuaaaaaauucauacuaauagauuaauuucuccuuuuugagagucaaucacaugauaagucaauguaauauuuuucaauauacacuaaauaguauagaauuuggugaggcacaaauucccugaacuggaucaacagaaguuucuuauuuaaaguacaagaccaucauuaaaaguuucacuuacaacuguaaaccccaagaaagaacagaugcucugaagcauucuucacacuguccuuaagucccuauguccaccucuuccucugcauucagauuaacuucugaaggaaauccugaaaucaagcaaauauaacacuacagcuacaggcauucuuuuuuuacucugcuuaguuccucuuucuucaguacuaaaauuaaagcuauacaacugccuuagcagccugaauaaauguucuaucuuugaaggauuagaaaccugcaaauggaaaaggcguuacaaacaaaacaguaacuuaaaaagauacuucaggccaggugcgguggcucaugccuguaaucccagcacuuugggaggcugaggcaggcagaucaccugaggucagaaguuugagacuagccugacuaacauggugaaacccugucucuauuaaaaauacaaaaauuagcugggcgugguggcacaugccuguaaucccagcuacucaggaggcugaggcaggagaauugcuugaacccgggagauggagguugcagugagccaagauugcgccacugcacuccagccuaggugacagagugagacucugucucaaaaaaaaaaaaaaaaaaaaaaaaaaucaguaguaucuuuaggagcccaagaagccauccuaacgaaaaaaacacaaaugcuuauuaaggggauccugaugaaaagacucaggauguucaaagucuuaaauuuguuuuaaaaaccuucaaaguauaaauagcuauucuaauaucuaauucaauaaacaaagagaauaaggaaacauaacauaacugaucacuguaauugugcauaagugcacaugcauaaagaaccaaugauuaaagacagaaguaacagugauguuaagaaacauugauguugcaacauaacaaacuaaugagaagcauaagaacaguaaacauugggcaaauuugucucaagcucaucuucaucagauuucagcuuacaguauccuaucuacucggaaguccuuaauaguauauaaaaauaucucuaagcacuucaaaaaacaacauuaagaagagcaaaauauggugguuuuauucauguggcuucucauuuauugaaaauucagggucuccaugcuugcaauuugcaaacaacuacaaacagcagccucaauuuucuaucuuaucacuugggaaaaagcacuaaaaucauuuuuaaugguuuauuuuguaagcacaaauuguaagcaucagauugugaaaguaucuugaugcuauaaacaaacaguaaaauuacaauuuacaauuuaauuaagaaaacaaaaaauauaaccugucauuuuauuauuuuuaaaaaucuaauugauuuaaauuaaaugccauguuucauuugucauauaagaaaauauaaauucaccuuucauauuaauaauuauacuucaauuauauuuuaugauacaauauuuaacuacugaucuaaaauauauauuuucuuauuuuuaaaauacauuccauaaauaaaagacaaugauuuucuaaauauuuaaugguguucaaaaaaacagaaagaaccacauuaauaggaguucaugagccauauacgguuggaaaaauaugcucuuagauaagccugauuauucccacucuaccaguaauaacaaaaagacucaguuauguaaguaauuuguguccaaguuuacauaacuggugagcagcaacacuaggguuuaaaccagggccguguaacucucagcuuauucuaugaaaucaugauaucaaugaacaaaugaaugaauuuuauuuccccaagguuucugaauaagaagcuauuuccacacacuguuagguggcuucauugugccaucaauaauaacacagauacaauuaaggaaauaauucaguguaacaaauauuuucucuagucccuauccaaguguuuaguacucaaaaaugaaaugcucauguauuagcaaucuggcuaucaaccaauucaaauuaaaauuccauuuaccaaugucaucaauuacuuccuaaugucaacucuuuugcaguuuucauugcuuguggccucagcagucagucauuuucccucaaauauucucauuuaguuccuguuauguuacauuacccugaauuuuuucuaccucuucauucccuugcuucuauacaaucauuguaaugacauaaguacaaauauuaacaaaaguauaucagugcaacaaaaaauaugacagaguaaguaacauuaacuaggacagagagagguauaaacuucuagaucccaaaauucucacuaagggauggauggcuguaaaugacuguauuggaaagucacaucaguucagaccucaggaggcaguauugucccaucugggcauagucuuacauacagaagcaauccagccugcaucugagacagguguauuuuuuucuaacuucaaguuguauaacauguaacaugacugcaagaguacuauacauaacacauucaagcaguuuuuuaaauccuuaauccucacccucagacucucucuagucugauaaagccuagucccuauaaauuacuaaauucagugucauggaacuggaacuacaaaucccugggagucaugcuauauaaucuauucuaauuucuuucauauaccccauauucccuauauucuucacacucccaaaaaugggacccuucaaaggcucaggucugaaccccuuucuccuccuucaauauaucaagcuuauaccuuuguguuuauaauuccacaaucaaaucucuugcccuaaaagcuuucccaagcuccuuuuucaaaccucccccugcuaggcaucaccaccuuggaauuuugcagucaccucaagguuaacauguuugaaacuaaacuuauccucuuucuaacacagccaguuucccuucuuguuuucugaguugcagaagagagugaucccugguuuccucucuucucccucucuccugcaaccuauagccaccaagucuuguaaauucagccuucauaaguuuccuuccugaccaccccaauccucaucucagcccuuuuucccagagaaaugcaacuguuuccuaacugauuucuacacaaacugucucuuccucucccucugcucaaacuauauuucacacuucacuuccuguuaaaaaaucuuuaauggauccccauugccuauaaaauaucuuucauacuauuuauccaauuauuuaaaauucuuguuggaucccugucucuauaaccucuucucucucuucuccuauacaucagucauccaauccagucaaauugcuccaaauaaaacaugcagucccacuuacgugauguugguuggaaauuucucacgccuagaaugcucuccuuucucuccuacacuuaacuaagcccuaccuuucaaaauuggauugcuaucucaaaucucucuuauuaaacacaugugaaaaaugaaccauuuucucauaauccuugccaaaaaacaacaucuaaacuccuaaagaauccauccaaaagaaacacaugaguacaccuaaaaucugaaagucaggagaagaagaauaauguaugaaugcaaauuucuuuuuccuucuauauugaagcacuuuuggccucauguguucacuuucuauucuuaaagguagagacuuaauucuauuuucuacagcucuuaaaggcugauaaugcaguuauuaugauugcgacuagcuagcucaucuuguuagagaaaguaucaugguacuggguuaaguuuaaauauccauauggaauagaaaacuucauuuauuugggugccacaaauugcaacccugacccuucccagaagucuauuaauaucuaccaugaacaccaagauaauguuuguggccagaugaaaguaaaaacagccuaaagugaacacccaacugauuuuauuuccuuaaaauggauuugaaauagaauauuuuauuauuaguuacuuugaauauuauugauauuuacaaaaacauacuucaaguaaaucugccuaaaauuggcuugagaacuaucugaagagauuuuuuuuuuuagauuuucagaaaaauauuccucauggaauaucuuuccaauuuugcagcauaaaaaaauagaaaacauuauuuuguuucuuaucaaacuaauuuuucaauuuucauucauuuaacaaauaauacugaguauauacuuaugccagaauuuuucuagacaccaguaauacagcaauaaacuaaguagauaaagcugcugcucucaaguuuacauucuaguggaaggagauagaaaauaaacaagcaaauauauaauacguugaaucgugguaaguucucugaagaaagauaaaacaggguaauggaaauagagaacacuaagaaggaaaacagagaagacuuuauugacaaggugauaucuggacagauauuuuaaggauuauagcuauucauaaaauauggaauaccagcauagccaaaauucagguaauacugugauguaguaaccuaauguuuccuaguuacauuacuuaaauauucuguccuacugaauuaacaaauccugggaguaaaauauuuguaaaagccuaggcugcaaccacccucaaucaucugauauagacacuauaguuuucuaagcucccuccaucagcaaaauauucguuacucaaagcugauuuguacugacccugugggacacaagcccauuucaaggcugcuggcuauagcuugaaaagaaccacugagauguaacugaacauuucuguucaaguagggcuggcccuaccccuaccuccuauaagcuuugaccuggauacauaauccggggcuaauuaaucaauacauccaucucuuugacaacugagauuggcucagcagucaaaaugugaucaaacuuagaaaucuugcuugaauuuggggaaagaagcgcuuuuggccaggauuauuaagcaaagaacacaaugaaccuugggcuacuuauaucccuugccaccauaugggaaaagcuggccugagaacaaaaccaguguagaggaaaauccagcugaccaauggggaaaggcagauuccagauuacauuguuugaguacuaggauccauaaaagccuagauuuuucauuuauaugcgcuaacacauuccuuuucugcauaaaucaguuugaauugguuuugaagagauacauggaaaaucagaaaauaagauauggcagaaauuuucucuucccauuuucaacacugaacugguauauucuaaauauggauauauggguguuaccucuuugauggaaguaaacaagguuuuaucaccggaccuaaagucugaacacaaggccauuucaaaggaauaaaaucuaauuuuccuuaagggagucaauauaaacaaaagaagguccagggcuauauuggugaccaucagaagcuagugcuucagaaagagugucucaggguuuaaagauucuggcauaugaaaaauauuacuuugagggaaaauccaguacacaaaauaaaaggaauucuaaagcaaaucaaaugaaagcaaauauaguucacugucagaaaagauaaagaaaaaaacgaaaaauaguacaaccagauauauaguuguauaauccaaguuuuagcuaggauucuuaaaaguaauugcugacuuguccaccagacaguacaaauaaucaauaacauucuaucucacaguugaauuuuguaaucacaaaaagaacaagaucucaaauucucucucaagcauauuagaauuacugauuuuauuucuuuaaauauguaaauuugugagugaggcacuuauaauuuauaacuuuuuaugugagugaaugcaucaaaaauuauguguaaguguucaagauaaccacucuaaacagaaguaaaagacccgcuauauauauaauaagcaaaugcuuagaggucacuauaauauuccuaggaaaaaaguaaaacuugaaauugcauugcauaaaggucuaauuguugcuauauaaacauauuucacaauuuuaccuaggaagauuuuaauuaauaaauucauguuuauacuacuaccuauaacuauaggaaaagcuuguauaaaugagaacuacaaaaaucaacauguauauggagaaaaauuauuuaaauuauaaaagauauuguauagccaauucuacuuagcuuuuuaacaaaccuguuuucucuacuucuugggcacuuagcuaaaccauauuuccuagucuugcaguuugggacagccaugugauuguaugacugaguacuagucaguggaagauaaguggaaaugaugucuacuguuuccaggcccauccccuuuaaccuccuaccucaccuguaucuuccaucaucuuuacccauaccaccuuuugacagauaagccaagugaccuugaaagguugugcucaaaagggcagagucaauagaugggagaaaucugaacucccccuuugaggagagccaccugcugauccagaauaccuguuuuagacuuuaaauuguuaagaaauaaacuuccauuauauuugauucauuauauaauuuuuauuuuuuaaaauagcuaguauuaccuuaacuaauauagcuuaugauuauaucacuaauaugugaucauugauauucaugauucauuuuauuuuuccacuaauuuuaaguuuuuaauaucccuagaacucaguacaaaugcauuaacuucaaauuauaaaauauuuuaauauucauaaguagucuacaucuucaguaaaacuauuuuuugaaauuuauuucuuugcuuaaucccagauucuaaacuuucuuuaacauuuaauuaacauaauuaaacuuauucauggcuuuaguaaucaauuagaucuuucuuuaaaaagauuuaauuggccaaaagauuuaauuguaauucuuuuuugaaaucaggauaauguaaccucuuauuaaaauaaacaaaaaauaaauaaaaaucaguaugauacaucaguuuugccauauuccuauaaagcaucucgaaaguaacaaaaugcuucaagaaaacuaccauaaaauaacauuaaaauauuuaaaagaagaauggucccgccagcauagcucuuauucaguaagaaugaaugugcaguccuucugaagaaacagaugaaaacaaaaaagaacuaccccaggcaagacugaacuaaaaauuuuucucaauuuccagucaaacuguguucacuuuucuaacaucuacccauccacccacccauucauucuucuuuuguucauugauucaaaaauugcauauugguauuauguggcaggccccauaccaggauucugugauaucacaaagaugaaauauauagauaaugcccucaagggguucacagucuaauauauucaagaacaagaaacaaucagaauuuauaacuacuuacuacaauuacaaccaccauaaguacuauuacaggacauugggacucuauauuauaaaaggcacugggagaaagccuaauacaaauuggaaugaagguucaaaaaugagcuaagauuagaaguaauguuuugauggaggaggaaaaguaaaaauaaugaaauugguuuggggcagaggagagugugagaacucagguauaguuauacaugcugaaagacuggugaaagagaguuugguaaauuuauagaauuauaaauaauggggaaaaugaugagagaugacaacacagcccuaaauaggagcaaguucaugacaugccuucauuuucccuauuccauaaucagaugauuguuauuaucacacuuuuuccugugccuuucaccucauauucaaacaggacagaaucacuuuucauuuucacugauuaaaauauagcuauuucuuuuuuuaacacacuuuuauaagagagcuacuaucugucaggcaacaucccagacucucagauauacuguucuuccuaacuuucuacaacaccuuauacuaucauuuacuggacugcuugcuugguaauacacuuuaccacccuguauuucaauuauuugguaauauaucuguuuuaccugccaaacuccaagcuccauaaaacauggaaaugccucagucguuuuuuuugucugccauaaaacaguagcuaguacguaauauagguauaacgaauguuuacugaguggaugaacuaaagcaaugaagaaaaauggauuagcuuuaaaauaagagacuaucauuuuaguuuucucauuacgcaauaagauuuuuuaaauauacaaaauaucauaauguguauuuuauguuuauauuuuuauguuuuguaggauauugauacuauuuauugguaaguaauaauauuuuauuauugcaguaccccuucacaauauacccuuauauauacaacuuauaauucugauaguuucugaaaacacauuacuauuggaaugcugcuaaaaauaugacuagaauucauuuuuucauccauauaaaaauguuuauugaguaguuacuauuuguaggacacuaugugaauugcuuagcuuuuauauuucauugccauuaaauacaauaauguaagagguaaaauaugucaaauuaacuucccuuuguacuuagucauagucauacccugaggcaaaggaacaaugucauucaaccuccuuucauaaauaauauacuuugaaacaaugacugauucauuguuaaacugcaugauuauauaguauaaagauuauaaauucaguugaaguucagguguuuuuuauuaugagauacuguacuuuuaaauucuggaauuuccaauuaauguuuuuaauagaucucauuucucuucugagagucuccaucuguucaaagaaaaagaaaaagucugagcuggaguaaguaaggagguuucuauauaaagaaagacuugaacuacaccucauaagaugaacaagauuuaaacaaacagcaaagaugagagaaugaaacaaugagcaaacacaccaugcaagaaaugccuaugauauuuuuagacaaauaacaaaggaauaagcuauacugguggcaggaaggagaacagaaagaaauaucauuggauaaggagggguaguaacagaaucggaagaucuugacauucuugaacuccaagaagaggaaggggccacgauaauuuaguuaaaauaaggcucaauauuguaucacugcucuguauacuucaauguguuuuuguaguggcugguaacagucuuuccuuuucauauuuagugcuuccuucagaagcucuuguaaggcaggucuggugguaacaaacucccucagcauuugcuugucugaaaaggaucuuauuucucuuuugccuaugaggacagagucaaaucuacacauaucaauaccagccuuaaauguaaauaagcuaaauaccacaauuaaaagacacaaaguagggugggcacgguggcucacaccuguaauacuagcacuuugggaggccaagguggguggaucaccugaggucaggaguucgagaucaaccuggccaacauagugaaaccccaucucuucuaaaaauacaaaaaaucagccgggcauggugcugggcaccuguaaucccagcaacucaggagguugaggcaggagaauugauugaacccaggaggcagagguuacagugagccaagaucacaccauugcacuccagccugggcaacaagagcaaaacuccaucucaaaaauaaaauaaaauaaaauaaaagacacaaaguggcaagcuagauaaagaaccaagauccauugguaugcuguuugcaagagacucaucucacauguaaugacacacauaggcucaaaauaaagggacagagaaaaaucuaccaugcuaauggaaaacaaaccaaaaaaagcaaggguugcuauucuuauuucagacaaaacagacuuuaaacuaacaaagaucaaaaaagacaaaagagggcauuacauaaucauaaaggguucaauuaagaagaucuaacuauccuaaauauauaugcacccaacacaggaggaagcagauucuuaaaucaaguucuuagagacuuucaaaaagacuuagacuuccagagaauaacagugggaaacuuuaauacuccacugacaauaugagaaagaucacugagacaguaaauuaacaaagguauucaggaccugaacucagcaauggaucacaugaacccagcagauauuuacagaacucucccccagaauauacauucuucucauugccacauggcacauacucuaaaauugaucacauaauuuaaaguaaaacacaccuuggcaaaugcaaaagaacugaaaaucauaacaaacagucucucagaccacagugcaauuaaauuggaaaucaagacuaagaaauucacucaaagccauacaacuacaugcaaacugaauaaccugcuccugaaugacuuuuguguaaauaaugaaauuaaggcagcaaucaauaaguuauuuggaauuaaugagaacaaagauacaacauaccagaaucucugggacacagcucaggcacuguuaagaaggaaauuuauagcacuaaaugcccacgucaaaaaguuagaaagagcucaaguuaacaaccuaacaucacaacuaaaagaacuauacaaccaagagcaaacaaaucccaaagcuaguagaguacaaaacauaaccaaaaucagagcugaauuuaaggagauugagacacgacaaaaaaaauccaaaagauuaacaaauccaggagcugcuuuuuaaaaaaaaaaauuaauaacauagaacaaauagcuaagcuaauaaagaagaaaagagggaagauucaaauaaacacaaucagaaauaacaauggggauauuaccccgaccccauagaaaugcaaacaaccaucaaagaauauuaugaacaccucuaugcacauaaacuagaaaaucuagaagaaaugaauaaauuccuggacacauauacccucccaagacugaaccaggaagaaauugauucucugagcaaaccaaaccucugaaauugaagcaauaauaaacagccuaccaaccagaaaaagcccaggaccagaaagauucacgacuaaauucuaccagauguacaaagaagaaccaguaccauuccuacugaaacuauuccaaaaaauugaaaaggagggacuccucccuaacucauucuaugaggccaacaucauccugauaccaaaaccuggcaaagauaccacaaaaaaagaaaaauucacaccaauauccuucaggaaaauggaugcaaaaauccucaaaaaaaaaaaaaaaaaaacugacaagcugaaucuggcagcaaaugaaaaacccuauccaccauaaucaagcaggcucuaucccugagauccaaggcugguucaacauacacaagucaauaaaugugauucaucacauuaacagaacuaaagacaaaaaucacauaauuaucacaauagaugcagaaaaggcuuuugauaaaauucaacauccauucauguuaaaaacucucaauaaacagacuuuaaaccaacaaagaucaaagaagggcauuacauaaugguaaagggaucauaccucaaaauaauaaggacauaccuuauaauguccuuauuuugaggacauaccucaaaauaauaagagccauauaugacaaacccacagccaacaucauacugaacgagcaaaagcuggggguguucccacugaaaacuggaacaagacaaggaagcccucucucaccacuucuauucaacauaguacugaaaguccuggccagggcaaccaggcaagagaaggaaauaaagagcauuugaauaggaagagaggaaguaaaaccaucccuguuugcagaugacaugauccauaucuagaaaaccacauagucuuagcccaaaagcuucuuaagcugauaaacaacuucagcaaagucucaagauacaaaaccaaugugcaaaaauaacuagcauuccuacaacaggcaaguggagagucaaaucaggaacauacucccauucacaauagccacaaaaagaauaaaauuccuaggaauacagcuaacuagggagguaaaagauuucuacaagaacuacaaaacacugcacaaagaaaucagagaugacacaaacaaaaauaaauuccaugcuaauggauaggaagaaucaauaucgugaaaauggucacacugcccaaaucaauuuagauucaauacuauuccuauuaaacuaacauugagacucuucaagaacuagaaaaaaacuacuuuaaaaugaauauggaaccaaaaaagaaccaaaauauccaaggcaauucuaagcaaaaagaacaaagcuggaggcaucaugcuacccaauuucaaacuauacuauggggcuacagcaaccaaaacagcauaguacugguacagaaacagauacacagaccaauggaacaguauagagaauucagaaauaagaccacacaccagaaauaagaccacacaccuacaacuaugugaucuuugacaaaccugacaaaaaacaagcaauggggaaaggauucccuauucaauaaauggugcuugaauaacuggcuagcaauaugcagaaaacugaaacuguaccccuuccucauaccauauacaaaaauuaacucaagauggauuaaagacuuaaauguaauacccaaaacuauaaaaaaaauccuggaagacaaccuaaguaauaccauucaggacacaggaaugggcaaagauuucaugacaaagaugccaaaagcaacuacaacaaaagcaaaaauugacaaaugggaucuaauuaaacuaaagacuucugcacagccaaagaaacuaucaacagaguaaacagaaaaccuacauauugggagaaaauuuuuggaaacuaugcauccaacaaaggucuaauagccagcaucuuuaaggaacuuaaacaaauuuacaagaaaaaaacgaccacauaaaaaagugggcaaagaacauuaacaggcacuucaaaagaagacauacaugcagccaacaagcauaugaaaaaaaugugcaacaucacugaucauuagagaaacacaaaccaaaaccacaaugagaugccaucucacccaaauggcuauuaaaauguaaaaaacauaacagacgcuggcaagguuauggaaaaaaaagcaauguuuauacacuguuggugggaguguaaauuaguucaaccauuauagaagacaguacggugauuccucaaagaucuaaagacagaaauaccauucaacacagcaaucccauuacuggguauauacccaauggaauaaaaaucauucuauuauaaagacgaaugcacacauauguucauuacagcacuauucacaauagcaaagagauggaaucaaccuaaaugccuaucagugauggacugaauaaagaauauguggugcauauauauauacuggaauacuaugccaccauaaaaaagaaugagaucaugcccuuuccaggaacauggaugaaucugaggccauuaucuuuagcaagcuaaugcaggaacagaaaaccaaauaccacauauucucacuuguaagugggagcuaagugaugagaacacacagacaaauagagaacagcacacacuggggucuacugaaggguugugggugggagaagggagaguauugggaaaaacaaccaauggguacuagacuaauagcugaguuaugaaauaaucuauacaacaaacccccauggcacaaguuuaucuauguaacaaaccugcacauguaacccugaacuuaaaauagacguaaaaaaaguaaggcucucauugauuuuugaccgugaagucaugaaauacaaacuccauuucagaaagucucaucuggcaguauaauauagguguggguuagaauuaagagagacugauugcaaagaaaggaacaaaaacauugguuugacaccuucuguguguccaacacacugcuaaauacuuuuuacacaaaguauacuucaauaggaaacagugagagacuaagacaaaaugggaagguuagcuauaauuaugggguaaccuuucagugauacagagaaaaauacauauaaaugauucaacaaauaaaauagaaaugacaggcuaccauucguuuaguguguaaucuguggugagcacuguguuagguacuccauacuuaucaccucuauccucacaacaauccugcaagguacuauuauucuuauugcuaccauuuuucauauuaaaaaaaucuaaacaucagggaaauauuuaccagggaaauaauaccugcaagauacuauuacuauuacuauuguuaccauuuuucagaugagaaaucuaaagaucagugaaauaucuaccuauggaguagaacuggaauucaaacacaagucuuuugaacucaaauuccuguucucuacccuauaaugucacauacaauacaaaaauauguuauugaagaaauuaguguaauucuuuaaugcaaggacucuuuaauguaaguuagugaggaugauaauuacuaugacaguaaaaacacuuuaauguuugagaaaggggcaccaggcuagguaaaacuaggauuagagauucaagggcaaaaggaaaucuuucaaagcuggaauggauuuauuucaguaacaaagaauagauuauaggaaaagauauaacaugucaauuuuugucucauuuauucugagggcaggcaauuuucacuuuaaugaucccgcuucucacuaguucauuuucuuuguucauuuuaaagucuuuauuuccugucggauuuauucccuugacuaagcauucuuucuccaaauuaagacuuugcuucucauuauuaaugauuugauagcacagacuggcagcuaucaccuaaauggaacuguuaggaaacuguaaacaaacacaacuuuucagcuuuaaaaagcauagauggcagaugcaagaauucuggcaaagccaugugaaaauaacaucaguuuuaaaaaucuaagccugagauugaagcaggccacacuguaucuuuuacuuacgauuauugauucugauucuaucauagagaaucccaauucuucagcuguuagaggcugaaugaauuccaauauucuuuaguuguggcccaaauggucuccugauaaaauauguugaagcaugagcaauuucagcaauuuuuucuggguuacuagucuacuauuccaucagaauuaauuugcucuucaaggugaaaagcauuuccucggacacagaguuaagugauuauugcaacugccaugucucuuuaagcucaggcucucgccugauuuccuuuggcauuaggcagcaaaauggauuuuuuuaaauacuggcaagcuguccaaggucuucacucaaaaagagagccaagaacucccaaauguaaaccuugaaauagaauuacaaauuagguacacuaugacaaaugaacaagguaaaugugaaaagugacuaaaaguuaacuucaucauuauccagaaugugagguuaaaagaaaggugaauuauuacuacauuuucaggaaaacauuacaauuagcucauaaguguaaaguacagauucucaggaaaauucuaacagcugaguucuucuacuagaaaguuuaauucaaguuagagauuauaaagagauuagaaagaacaaaaguaucaaaacaaaaacuggccaauaauauaucugaagaguauauaaaaaugguaaccucacaaaugucauaaaguucaaaacauaaaaauuaaaauauuuuagaaaggaaguuuacugcccuuaauagaaugcucauaauauagaugcauauuuuaacaucaaacacauuuuaagcacaugcacaaugaaauacugugcaucagugaaguccauaaaaaugugcaagaaucauuaacaauuagaaaaaaacaggaugucaucaaccaccaaauauacauucuuaucaccugcacagggaacauacucaaagauugaugacaugcucagccauaaagcgagucucaauaaauucaaaaaaaucaaaaccauaccaaccauauuuuuggaccacaguggaauaaaaauagaaaucaaugccauaaacauaucucaaaaccaucccucaaaucuuuucaauuucaugaaaacuaaacaacuugcuacugaaugaguuuuggguacgcaaugaaauuaaggcagauaucaaaaaaaucuuugaaauaaacuaaaacagacguaacauaccaaaaucucugagaugcagcagaagcaauguuaagaggaaagucuauagugcuaaaugccuaccucaaaaaauuuuuaaagaucucaaauuaauaaucuaacaucacacccagaggaacuagaaaaacaagaacaaaucagaagaaaagaaauaaauaaaauaaaauaaaaucagugcagaagugaaugaaauuaagacccaaaaauucauacaaaaaaaucuauaaaaccaaaaguuggcaugaaaggauaaauaagaucaauaggcuggcagcuacauuaacaaagaaagaagagacaauauccaaauaagcacaaucagaaauggcaaaggugacauuaaaaccaaucccaccgaaauacaaaaaaaacccucagagacuaugaugaacaccauauauauacaaacuagaaaaucuagaggaaguagauaaauuccuggaaauacaccauaucccaggguuaaaucaggaagacauugaaacccugaauagaccaauaaugaauuccgaaauggaaucaguaauaaaaagccuaacaaccaaaaaaaaaaaaaaaaaacccuggaccagaaggauuuacagcugaauucuaccagacauacaaagaagagcugguauuaauucugcugaaacuauuccaaaaaauugaggagaaugaacuccucccuaacucaugaagccgccaucauccuaauaucaaaaccuggcaaagacacacacacacacacacaaaagaaaacuacaggccaauauaccugaugaacagagaagcaaauauccucagcaaacaaacuaaaagcaguagugcaucaaaaacuuacgacgaugaaggaggcuuucucccugggauacaggguugauuaaacauauacaaaccaauaaaugggauuuaccacauaagcagauuuaaaagcaaaaucaauaugaucaucucaauagaugcaauaaagauaccuucaauaaaauccaacaucccuucaugauaaaaaccuucaacaaauuaggcaucaaagaaacacaacucaaaauaauaaaagccaucuaugacaaacucacagccaacauuauaauaaaugggcaaaaacuagaagcauuuuccuuaaggacuagaacaagacaaguauggcuacucucaccacucauauauaacauaguacugaaaguccuagcuggagccaucaugcaagaggaauaaauaaaaggcauccaaauggaaaacaaaaauucaaacuaucugucuucacuaaugauacgauucuaugccuagaaaacccuaaacuccaacaaaaagcuguugaaacuuauaaaugacuucagcacauuuucagaacauaaaaucuauauaugaagaucauuauaauuucuauacaucaauaacauucaaucugagaaccacaguaagaaugcaaucccauuuacaauaaacacacaaaaaacgaaauaccaaggaauacagcuaaccagggaggugaaagaucucuacaaugagaacuacaaaacccacuguucaaagaaaucagagaugauacaaagaaauggaaaaacaugccauguucaugggcuggaagaaucaauaucaauaaaauguccacacuacccaaagcaaucuacagauugaauguauucuuauuaaaguaccaauaucauuuuucacacaauuagaaaaaaacuauucuaaaauucacauggaaucaaaaacaagcucgaauagccaaaguaauccuaaaagaaugaagccagaggcaucacauuucccaacuuccaacuauacuauacagcuacaauaacaaauacuucaugguacugguacaaaaacagaaacauagaacaaaggaacagaauagagaacucagaaauaaagccacacaacuacaaccaucuaaucuuccacaaaaauaaacaauggggaaaggacaagcuauucaauaaauagugcugggauaccuggcuagccauacgcagaaugaaacuggacccuuaccuuucaucauacacaacaauuaagaaaagauagauuaaagauuuagauguaagaccucaaacucuaagaaucuuagaaugaaaccuagaaaacaccauucuggacauaggucugggcaaagauuucaugauaaagacuucaagagcaauugcaacaaaaacaaaaauugacuuaaaaccuucugcacagaaaaagaaacuauaaacacaguaaacagacaacuuacagaaugguagaaaauauucacaauccaugcaucugacaaaggucuaauauccagaaucuauaaggaacuuaaaaagucaacaagcaaaaaacaaccccauuaaaaaauggguaaaggacaugaaaagaagauauacaugcaguuaauaaguaugugaaaaaaauccucaacauuacuaaucauuagagaagugcaaaucaaaaccauugaaugcaaucucacaccugucacaaugacuauuauuaaaaaguuaaaaaaaaaacagauguuggugagguuguguagaaaagggaucgcuuaaacacuauuugugggaaugucaguuaauucagcuacuauagaaauaguuuggagacuucucaaugaacuuaaaacagaacuaccauuugacccagcaaucccauuacuggguguaugaccacaggaacacaaaucauucuaccauuaagacacauccacguaugcucauugcagcacuuuucacaacagcaaagacauggaaucaaucuagauauccaucaacgguggacuagauaaagaaaacguggcacauauacaccaugggauacuaugcagccauaaaaaagaauaaaacuguguccuuugcagcaacauggaugcagguggaggccauuauccuaagcaaauuaacacaggaacagauaaccaaauaccacuuguucuuacucguaagugugaguuaaacacugaauacacauggaaacacacauggacacaaagaggggaacuacagacaauggggcuuacuugcggguguagcacgggaggagaguaaggaucaaaaagcuacauauuggguacuaugcucauuaccugggagaauaaaucauuuguacaccaaaucccagugacacacaguuuacccauguaacaaaccugcauauguaccucacugaaccuaaaauaaaagcuggaaaaaaaaaaacaaaauagccccaucucaauaauacagaaagaauaacaaggauuaauucaaaaauguuuaucacauaaauauuuaggaauucaaaaauuaauaauguaaucagacauauuuccuauauucauauacuauauacuuccuucguauauguuaucaggaauuaaacaugguauuuguaauacaggauauccuucucaucagugagagugauguacuauuaccuaagaaaaauauaauuugacuuaagauccuagcgauauauugugaagucaauaauauaguuuacagggguauuuuauuucauccucaaagaaacuggcgagguauucauuauuugaaaaaucacccaacaggggaaguucuucucagaucauaaauauuccauguuagaauuuuucucauaugccuacaccgaaauacagguuaucaaacagauguuuuuaugcccaugaccuguucuaucaauucaauaaauguuugcuaagcaugugagugaggaacuaugcuaaggacaaauacaugcacacacacagauuaauauuuucccugucuucaaggagcuuauaggcaaagucaaaaaagaugauucaugcauaauuaauacaaagcagcauaaugaugcaaauaguuagaucuaaauagaaggaucaaaaauaguuuucaauaaguagagaugguagggauaauauauauagacaaaacaugaacguggacaauaagaaagacagacguguuugagaguaauccauuuuauuuauuuauuuagagacagaguuucacucuugucauccaggcuggagugcaguggagcuaucuuggcucacugcaaccuccaccucccggguucaagugauucuccugccucagccuccugaguagcugggaugacaggugcacaccaccaggcccagcuaguuuuuguauuuuuaguaaagauggaguuucaccauguuggccaggcuggucucuaacucccgaccucaggugauccuccagucucagccucccaaagugcugagauuacaggcaugcaccaccgugccuggccaagaauaauccauuuuacuaaaauauauuuaucuaagacauuacuagcagauaaagcuggaaaaauaugaugaagcuagaaaugaagggucuugaaugccugaguuaaacguuucuauuuaacauuugcagugaggaccagggcuaguuuugaguaggaaaaugacaugaccagaauggcacuuaaggcauacugacuuggcagcauugcucagaauaaauaugagcagaugaagaggagagacuagaaguggguggacaggguaggaggcucuugaaauaacucaggugaggggaaaugauggucugaacccacaaacuggcaggaaugaugaaaaggugagaggucaaucuggaagacaguaaugaaagacagaaugaucuacuuguaagacauuggacauacauucagauccaagauuuaccuuuugggcaacugacuuuacuccugauucccacguugaggauaauaaaaccuaccucaugggauuguugucaggaauaaaggagauaaugauuuuuaacauguuuacacaaugccuagcauguagugaaaauuuaguacuuaauaaaugcuagcuucuaguguuacaauuauuuugagauauuauaguuuggucacuguuuacugauuuuuuuaguagcuacaucucacugcugguucacguagcaguuguagucaucuauauacccuaaaacuuuugugugaacuacucucugacauuaaaucucccccaccuuguauuuauaccauugauuuuuaaggaaucuaaauauaagauuuuauacuaacucccacugaauucuauguuuuuaccuugagccaagauuucagccuauugagauaauuuuucauauaaguucaauuauuugucauauuugcuauuccucccuaacuucuacaaagcugauuagaauacauauggcuuuuuccaaguaaaauauugacucagaccaauccaagaacaaaauauuucacuuucacuagagaaauccccucuacguugacauuuugugacuauuuagaacgucuggacaaaauuggacaaagucugugaaacauaaaaaucaagaucucuucagcaacauaaaagagaacaaaauagcucuuuucuauggcugacagaaagccagaguaaaauuuuuuuaaccgaugcagaaacuaaggcuuggaaauaucaagcaacuuccaaaggucacccugcuaguaaauugcagaacagaguuguacaaccaaaucuguaggacucacaaucucaugcucuuaacugcuagacuaaguuaucucccuaagaaagaugguugagauucccaucaugauugcugggaaaaaccuccacuuuggucucuggaauucaucuccaaauaauuaaaugcauuuugcaaugauaaugguucauuugcaagaacauauacacuuuuauaugcagucuuugccuuuuuaugcauuuauucagucaaugaacuuucacugagagaccacuacauucaaggcaccgugugaggcaggaugugacuacagagaucaaucuaauaaugaaccuacugucaaagggguauauaagaaguaaugcaaaacauauacaccuacaaggcaaggcagaaagagauguaucaagaaugguaaaaagcaagugugcuagaaguucagaaaaaugacucuuuuauucuacuagccauuuucucaaggacuuccuagauucccuaagguuacaaaaaguucuuccugaggugaggguaggaacaaaaacuuacccuucugauucuggauuuuuccauuaauguaccuacaguacauacgugugguuaaugguauuguuuucaauauauaaaugcaggucaacaugauccuaguucuacauucccuaauucuugcaaaaccuguuaggagauuuccaaccuuaguugaaucaccuugagucaccacauccaaaaggucuguucaacuacauaagaaauagauuguucagguuagaauguucuuuugaacauuguauaccacugcuuaagauuuagcaccacuauaaaaaauuauacaugcuaaagaaucaguuauguuccuauaauaagccucuauuuacauuucaaaaaauuugccucccaagauucucuaaaucugauggaaauuggguaagauagccacgaagcucucuccaaauucugaaauugaugcauuccugauaauaagcucuagaaauuggguuagaauguguuugaagguaaacuuuguuucagaaacaccauuugguuuuuaggcaaucuaaucugacucuacugaucuuuaaaacuugaugaauuuuagaacuaaauuaaguauauuuuccaaaaguagggaccucacucccagagaguauucucaagaauagcuuggcauuaaaaaaaacugaaaauccuucaagguaaaucuugaaaucuuaaaauacuaaaauaaaauaccucacacuucagaaggcugacauguaauuaaauauuuugcauuggaaaagaaaguaaaauaacagaaaagaggcauaguugcugaacaaaauugcacaaaaccugccaaugcaaccccuuucaaaccaaaagcuuuagaugcugcuugugucaagagaaaaaaauacauaacacguuucaucccuuaagcuucuuauuuacuucuuaaagacauacgcugaugagguaauguucuauuacaaauguuuaaaaaaaaaacaaaaaaacuuuuccugguaccuggauucugaaaucugcucuaaugaucuuuaucaucaaauuucucuauggcaugcuguguucacauuuaagaauuguauagauuguuuauacacauggaggaaaaaacaugaauauaaggcuugggaaaacauaaagagaauagaaaauuuuuucagaugauuucacauucuuucgaaaaccuaaauuucaugaguugguaaagaauguuaggauauuuauauuucuucaaaauuuacauucuagauuauauaauguccuaauucaacuuagaaaaugguuucagaugcauauuauaagaguauauaaaacagacugacuuuugaauuaaaauguaugcaagacaaaaugcaauuuuaacuugagcuagccuuuauauuacaugcaaaaccuccaauugaauacauucaaucauaauaagaauuuaauuuuuaacuuauauuaguaaaaguguucaaacuaccauauuauagcuaauauuuuaauagaaacaaaaaucuccgauucaaaaauaaaaguucuuacauaagauggcugguuuuguauuugaaauuacugaaucagagugcccucuauuggaagaaaagagacaacaaaagcuaaacugaacuaagaauauagguaaaauacuuccaaaacucaagccacaucauuaauauguaaaacacauuaauuaaaaauauggaugcuacaaaacauauuuccuuacauuuuuauuucuccaaaauaacuuuuggaauuacuugucauaucacaaucagcaaguuggauguuucauauccuaugaaauuaaauuuuaacugaacccaaaugcucaucauuuaaccaguaauauaaauaacagacauacagaaauguuuuccacauuuaauaguccaauauaacauagaaauguuauaauugaggacugugguuugacugcaguuuggauuuuccuugaugauaaacugaaagccuccuugcuaugaaccucaugucgguguccccgccaaguuuauauguugaaauccuaaaccccaaugugaugguauuaaggaggggguguugggaggucaucagaugauaaccccuuaugaugugcuaguguucauauaagaaaacaucaggagggcugggcgcaguggcucacaccuguaaucccagcacuuugggaagccgaggcaggcagaucacaaggucgggagaucgagaccaucguggccaacauggugaaaccccgugucuacuaaaauacaaaaaauuagccaggugugguggcacgugccuguagucccagcuacucaggaggcugaggcaggggaaucgcuugaaccccggaggcggagguugcagugagccgagauuguaccacugcacuccagccugcgacagagcacgacuccgucucagaaaaaaaaaaaaaaaaaaaaaaacacaucaggagaaccugcuuuuuuccccucuguucuuugccacaugaagauacaaccagaagacagcccucugcaaaccaggaagcaggccuucaccagcuaccagcucugcugguaccuucaucuugggcuucucggacuccagaacugugagaaauaaaugcuuuuuuuuuuuuccaagccacccaaucuacgcuaauuuguuauagcacagauaaucccuaauucaagagacuuuuagaagcucuuacacuggggaauugcagaaguaggcuggacauuaagauuuacgagauuuguuccaucucaaaaaauucuaguuuugugguguuuucaagaccucaguucugacucaucaucucagaccugaauuaccucagaaagaucuuggcugauuuuuggcucccuagaccaguaguauggauguuagaccugagaagcuuuuccaagagcaaugcucagagcuacccaaaauuauuuugauuuaguuggucuggacugguaucugagggcaucaguauuuauuuuuuagagccucucuagguaaaucuaauauacaacuauggcugagaaccauuguuugagccucuccccagaucaagcaacauacaacuaccacuuuuauuuuccaaaaaugucacuuucaggagaacucuccuacacaagaauuuauucucaggaucaauuuuaaacuucuggcuagccucccaaucuacuuagcugccuuuguucucugacaauagaguugaguggcaagggguuauggcuccagcuccagaaugucuguguucuuggcucuguaauuaccgcaugaaacugggaaagucauaaaagcucccuguauggagaaauaauacuauccuuuucaaaggguuauugugaggauuaaaucaguuaauacaaguaaaguguuccauaaauugagguauuaucauuacuuacccaacuuuauuuccuacuacuuuccaaaacaaacucucaucauaaaucauucucaaauuaugcacuaauucucaucucugugcuuuugcacuuacuguuucuucaggcuggaauccuuucucaaucauuugucccaacaaaagugaaaagcacagcuccccuuucaccaggacacagcuuagucucucccuaccuccacaaagacuucaaugaguaucuguaaauauucacuggucucucccuuuuaaaaauuccuuuggccacaagguagcauacuaugagaaauguggcugagaauuaaaaacacuggcucagaguuugaauccucacucugccacuuggcagcuaagucauuuucuaaauccauauuguuaggauuacuuaauaagcgacuuaaaucacguaaagcauuagaguagcaaauagcaaaaacugaguaagugucaguucuuauuuauucaguguuuuauauguuagccuucaguuauagucuacacacugugacugaagucuccuuaggauagguguuuugaaacacuugaaaucaagaaccauaucuauuauaaaucccacaacucaaaacaugguaagaaccaucuguauuaggugaccuauauuaggugaccuguacuugacuaaacuuuuugcaacauguaagaguauaauugaagcaauauucuggaaaaaaaacuuuuuugaugaauagaaacaaauauucaacaaaacauggaaugaauucaaauaaaacaggcuacagaaaagggucaaaguaauuugauuacuuuuuaaacauucgcuaacagguuucuaucagauucaucuucugaaaggucaguuccaaugaugucuuuuaucugcccaaaauccuuuagauuuuucucauuucuuaaaaaaaaaaccaaaauucuuagccugacauucauaauuauccaugaccugaccucaaacuacacuucuacucucucaucuuuccccuuuguaaacucuauucuuccaaauaaacagaauuauuugcucuuacucauauauaccaucugcuuuucucccuccacauaaucuuuaauauuuuauagggaaauauuuucaaagaacacuauuguaaagguuugucacaggaacgaagagugguguuagaaaagcaugaguucagauuucaaaaccuuaacgcucaauuuaugagcauuaauuucuuucuugccacuaucacaauacagucuuuggcuuacaaaaaaaauugaacaucuuuuccccaaacuauuaucacucucucaaagucaaaagccuuugccguaacuuccugaaagauagaagcuugaaucauggucuccaagcagcacauacagaccccagggcauauaagauauucauuggguaaacgaaaaauaauuagagcuucuguuuuacacuuauucucuaccuuccucaauuugaauuucuuuuguuguguaugucucauaauuuacaucaaauauuacuagaaaugcagucuauauauauauaauuuacaaauaaucagggauauuugcucaaaauuuguuuacuaaugguacguacaacaaaaaaguuuggaaacccuggucuaaaaaauuagggcuuucagaauaucugugguuuuacaaguagaaggccagaagcugccaguuuacauaaaucuuugaggauggaucuaaaaauauaaacacuauguguuguuuauauagcacaaauauguuuuaaguucuaacuaacuuucaaggaaauauuaaaauguaacugauugguaaccuggagacagcauacaccuauuucagauuuuuuaacagaggauuuugucccaacauuaaaguuacuauuauaaauuauuucauuaauauaaaaauuucauuugguaaaacuuacagguauuuacuucaguacauauacaacuguucauaguuauucauaaagaauuuuuauuggggccaauaauaggauguuuuuacaaaagagagugaagcacaaaaacaaaaugaaacaaaaaaagcaggccaaggagguaggacuagccauggaacuagauuagcaagugcuaucccaggaaacagugucacagcuuacuuuaaguaacuaaauuaaguaaauguucucauaauggacagucacuauacuuagcaaguuuuuuuuuaguuuucacaaauaauaugacauacuuaacacaguucacucuauuacuggcuuuugaauaaaguaugauauaucuguaacaaauuaaguucuaaaagugacuacagauuucuuaucagaauaauguauuuccuuuaauaccaguauauacuauaaguccuuccucuacaggacaaaaaguagguuuaaauaucuuaauauuaaacugauuuauucucuauaguuuuucuugcuuuuguguucauauaaaaauccaaaugagugagaaucacccauggccugaccucaaucuauccuucuaaucuuaucuccccucuuucuucuuuguaaacucucauuccuaauaaauagaaauacuugcucuuacucaacuauaucaucuguuuuucugccucacauaaccuuuaauauuuuauauggcaauauuuucaaagaacacuaucauaaaggcguugucacaggaacuaacucaugcuuaagauucugagcuuaucaaagagaaaccucuugggauuugcauaauauuauaaaaauaugcagacugaacuuuccacauuucucuccuacuaugacuucaggaggaagugaggaaacuauacguguggcucugcucuguuagucugaguucauagagaaaauggggaagacagucgaaaggaagguuuuugucuuuuuuugggaaccaacaucauuaugcccaguaaaacuaaaggaacacaacaacaacaacaacaacaaauaccaaaaauccauguuuuuaagaaagagucuaaaaguagagagaccaugaagugaucugucaaagcacuccuuccccuacacaugcacugcgaguaaaaccccaaagaacgucaggaaaagagcaauaaggaaacugacaucuuagaguggcggaaucugauaaugcaccacaucccauaccucuuaaguguacacacugaacuggcaaagacagacacauuaucuucauucccccccgccuuacuuacuacacucuggcuuccauuuuucccaaguucuuccucugaaaucuugcucaaauuaucuaaguaguggucugauauuguguggcacaagucuucaaacgaauaauccuuuucuugacagaguuuuauuucauccaagaguuuugauaauucuccagugacgguuucaccuaugagaauaauuuuuucagaaguuucaagaaaggcuauuguuaaaacuuaauguuaagcaauaaaaauaugacugcuauggugauagaacucaaaauauaacaagauuaagcagucagacacuauucugcugaaaacaagguacucaaccauaauuaguacaacaauauuaaugggcaaaagagauuauaauuuugccuauuuuuauucuuuuucaaaauagaaauaauuauuguaagguuauguauacauaguacauaaaagcaucuggaauuacaauucccaaagcuucacuuauuauaggauuuaauuuccauaauauuucauugguauuuuacuucacugacagaauucauuagcaaauuugaaacggugcugagaaacuucuuccuagguucaauaaacagaaauaguacaaguuauuuaaacaaauaauaacauagguaaucaguaccuuaagaauuaugguauaugauauaaaguaaaaacacaaaagaaacaaacaauaugcaucaucugucaaacaugaagauuuuguagauuacaugaaaauaugcacauuucuaaacagucucagaaagauaccuuauaccuguaauuuauucugaaaaaaaugcccagcaguuacaauccagauuuuaauauuuuuauucugacauaaaaacauauuuaacaucagcugacuauagaugcauggauuuauuucuggacuuuauucuguuuuauugguauauaugucuguuuucaugccuguaccauacuguuuugauuacuguagcucuucacaagguuuccaagaacacaaaauguggaaaagauagucucuucaauaaauaguguugggaaaguggauagccacaugcaaaagcaugaaauaugacccuuaucucauccccuauguaaaaaucaaugcaaacaguauaaagacuggaacauuaagaccugaaaauaugaaacuccuaaaagaaaacauagggaaaaaacuugauauuuguuuggacaaugauuucuuggauaugaacaaaagcaaaaaugaacacgcaggauuggaucaaacuaagaagcuucugcacugcaaauaaaacaaucaacacacuaaaaagauaacuuaaggaaugggagaaaauauuugcaaaccauagaucugguaagggguuaaugugcaaaauacauaaggaauucacauaacucaauagcaaaaacacaaauaaccuaauuuuaaaaugggcuaaggacucgaauagacauuucuucaaaaaaggcacauaaaugacccaagguauaugaaaaggugcucaauaucacuaauaaucaggcaaauguaaaugaaagccacaaugggguaucaucucccaucuauuagaauggcuauucucaaaaagacaaaagauaggagguguuucugaggauguggagaaagggaacccuguaugcuguccaugggaauguaaaauguuaaaggcucuauggaaaacaguauggagauuccucaaaaaauuaaaaauagaauuaccauaugauucaguaaucccaccuuggggugcuuauucacaggaaaugaaaccaguaucuuggagagauaucugcacccuucuguucauugcaacauucuucagaacagccaagacaugaaaacaacugaaguauacacugucagauggauggauaaauaaaaugcaauguguguauacauuuauauacacacuacacaaacaauggacuauuauucagccuuaaaaaaggagauccugccauuuguaacaacauggaugaaccuagaggauauuauccuaagugagaugaaccagguacagaaagacaaauacugcaugaucucacauguggaaucuaaaaaagucaaagucauaaaacagagaguagaauggugaaugccaggggcuggggaguggaggagaugggaaaguguugaucaaaggguacaaagguucaguuaugggggauuaauaaauucuggagauuuaaaauacagcauggugacuauaguuaauaauauucuauuguauaccugaaacuugcuaagagaguugaucuuaaguguucucuccaaaauaaaaaauaaaaaauacuaugugagaugauggcuauguuaauuagcuugauuuuggcaauuauuccacaaaguauauaucaaguugcacacuguaaauauauacaauuuuuauuugccaaguauaccucaauaaagcuggggaaaaacacauuuaagaaaaaaacacauuuaagaaacauauacuccagauaaacuucauuacagcagggauaguuuucugcuuugcucacuacuguaucucagggcugagaagcccuaaucaguaacaggagcucuuauaaauggaugaaauauagaguauaggauauaaccuauuagacuugaaauuuucacaacuguacauacaagucuaguauagauuccagggcuuuauaauuagguacucacuuuuggucuuuugggaaggagacucaacaggagaugaaauguguguuucuuguguugcaucuuccuguacaggcucuucgaggacuguagaucuucccacgccuucuaaauacucuguguguauacauuuuugagauuacauacuugaauucauuuauuuuaaaaucaauaaauuuuaaguuuuacuucugguaaucaguuuuucauuuauuuuuucauauccuaaauauauccuaaguuuucaaaagaacuucaaaaaaccaaacauaucaaaagaacgccaugaugagcuauuuaauuaaaguuguaauuaaaaaaagacacuggauuauuugggagaaacucuugaaccccuuucuucuaaaaccuaaacuuaaaacauucuuuccuuaaaaauaaauucaccuauugaagauacaauaaacuccuuggucuccuuauuuuccaucugaagauuuuaaacugucugaaagaugcuuugaauagauuuaauccccaaaacaggaaugucaaauucagauggauaccacaaccagccagguaacauaaacgaaugaaauggaauaaguucauuucaaaauggugcuguaaucuuguaacauaagcauaauuugcauauuaacuuuauuuccacaaagaaauaauguucauugccauuauucuugaaguaauguccuauacucagccuauuuuucauuuuucuaguuuugauacagauauaauauuaggaauagcagcuuaaacuuaaauauugcuuacuauggacccagcauuguucuaaguguuuuguauaaauuaacucauguaauccuuacaaaacuaugacacaugcacuaaauuuuaaagauuacaaguaaaggaggaguauuauuaacuuguccauguucauucagcuaauagguggcaaagccaaauaaauauaagacaagaaaacaucucacuuuucucuuaaccauaaagaaaacagcaucugaauguagaaauaaauguuaaccaauauucagccucacagaccauguugaaccagagaacaaaugaccaaucuaaaguucaucccugaaauaaaacuucuuuuagagaaaccaaaacuccagaguuugagcuaaaauccuaggguuuuuuuuguuucuuuuugguuguuuguuuguuugagauggauucucgcucugucgcccaggcuggagugcaguggugcaaucuugacucacugcaaccuccgccucccagguucaaauaauucuccugccucagccccccaagcuagcugagacuacagauaugugccaccacacccggcucauuuuuuuuuguauuuuuaguagagacaggguuucaccauguucgccaggcuggucuggaacuccugaccuuguaauccgcccaccucggccucccaaagugcugggauuacaagcgugagccaccgcacccugccaaauucuagauuuuuaaauguuaacagcuaauucaauuuuuauggaaacacaaugugggcucaaaauaugugauauauacaaagcaugugugcuaucugccaaagcguucagcccacaaguggcuaguuuguagccucuguauaaagauuaaaugaacagaucccuuuucauacagagcauuugcuuauacuucuuuauucaagaaccuuuuucuuaaaaucuaauaaagaaaauuuguauucucaugccaaacaaguauguccucauaccauucaaauaauuucuaccagggaaauccaggaaugcaaagaacagagaugacguguucacauucugaaauuugccaguaauuagagaacuucaaagauguacuguaugcccuaccacaaauuaacauaccuaauuaaucuugaccauuuaggagagcaaagauaguuacucccauguaacaacauuucaucuuauauaaaccaaugcaguauguuuuuaaaaaguccaugguuaugucacaccccauuuucuagugggugacauuuauuuugcuuuucccaaaagacauauuacacacaugcuucaguuuuguuuuuuuguuuguuuguuuguuuuguuugguuuguuugagacggagucucgcucuguugcucaggcuggagugcaguggcgcgaucucggcucacugcaaccucugccuucuggguucacgccauucuccugccucagccucccaaguagcugggacuacaggcgcccaccaccgcgcccggcuaaguuuuuguauuuuuaguagagacgggguuucaccguguuagccgggauggucuagaucuccugaccucgugauccacccaccucagccucccaaagugcugggauuacaggcaugagccaucgcgccuggcccaugcuucaguuuuuaaaaguucagugagaggcagccgggcacgguagcucacgccuguaaucccagcauuuugggaggccaaggcggguggcccacaaagucaggagaucaagaccauccuggcuaacaucgugaaacuccgucucuacuaaaaauaccaaagaaauuagcugggcaugguggcgggugccuguagucccagcuacucgggaggcugaggcaggagaauggugugaaccggggaggcagagcuugcagugagcccagagggcgccacugcacuccagccugggugacagagugagacucccucucaaaaagaaaaaaaaaguucagugagaggcugggcgcuguggcucaugcguguaaucccagcacuuuaagaggccaagguggcuggaucaccugcguucaggaguuggagaccagacuggccaacaugguaaaacccccucucuacuaaaaauacaaaaaguagccagacauggcggcaagugccuauaaucccagcuacuugggagacugaggcaggagaaucacuugaacccgggaggcggaggcugcagugagccaagauugcaccacugcacuccagccuaggcaauaagagcaaaacucuuucucaaaaaaaaaaaaaaaaaaaaauucagugagagucaaaaguccaacaugaaauacaaagugcauagagggagaagacuaauaaaaaauaguaugugccacucuuauuuuuuagcuuuuauucaauuuaauuuuaauuuuaauuuauauaaaaggcuaugaugggauuuuucucugauucaucucugcaugcauuugacuuguaauuaacuucuuuauugauaagaaaauuguaggggcaugaacuucccugaaauauuuuggaaauagagaagagagcauaauggccacauauagugcaucuauuccuuuuacuccuccuuggccuuuguugacuauuguaucuacauguucccugccugacuugguuuuaauucauuuaucucccugcaaaacaaugcuguucuucagcuucccaacugacaccuaauaaaaccuaucucaccacccuccucuaucauacuugcagccaauccauaacaaguguaggagauaaucacugcugaacaggguaggagcuaaaggagagaaaaacaucugggguuuuuaaguaacaugcuacaugucaggccuaaucaccaaacaggaagagaaagcauuuaagucuaauuuuguuauaaaacuuuuaguucaaguggagaaguaugcaagcugcaaauaacaaaagucguaccuagacaguugucaaacuuucaauagagcuaaugacugccacuaacaacaaaugcacuuaaaugacuuuuaccaaaaacuaaggcugguaagacugaguuauuuuauaccauuggauuaggaaggaaauaaucuguauucuuuuggcuaaauacaauuuuuguuauuauugauaaucuagcauuuagauacaagcucugccacuuaagauacaugaauuugaacaaaucaaaucucucagagccucaguuucccuuaugugcaaaaguaaaauaauaucugacuuauguuacuucauagggucauagaaaccaaaguaguagcaaaucccugaaaaugcugaaaguauuauucaaaugugaaauaacacuuaaucaucacuacuuuauagccuuauuaacuuccagcucauaacuacauauuuacuacauaaauaugaauuuuaaaaauauuucuauuaucaaaugaguaaauaaauaccuuaacuucuuuaaaauacuuacugaguaguugaaaaacaaaaauaaaacauuaaaagguauuauuauuuaguuuaaaagucuaccagaaaaaaauaaaacuaguaaguuuguucaaaaguaaacacuaacucaaaauccaaaagaaaacuguaacaguuuuaaucucaucuuaacuuuaaggcaaacucauccaucauucaauacuguuuaccuuguaagaguguugcaaucuggagagauuucugagauggauguucuuucagaauguccaagacaguucuaccuaagcuauccuuuauguuggcaucaauuccugaaagaaaaagaaaaacucacuagauauacaccacugaaguauccucaaaagauacuaucacuaucuaacugcuguaauuucagacauauacagaccaagcauugaaagugauuuuuaaaaaauuaaguucuacacacacacauacacacacacaugcgcacacacacacacacucacacaagauuuuagcaagaaagaaggcaggggccuguugcuaccaaagauuaggaacauucuugaucaucaauuaacucuuaaagggcacugacccaauguuuaagauuguuuuucaggacccuaugauaucuuuuuuuuuuugagacggagucucacucuguugcccaggcuggagugcaguggcgcgaucucggcucacugcaagcuccgcuucccagguucacgccauucuccugccucagacuccugaguagcugggacuacaggugcccaccaccaugcccaacuaauuuuuuuuuuuuuguauuuuuaguagagacgggguuucacuguguuagcaaggauggucucgauauccugaccucgugaucugcccaccuuggccucccaaagugcugggauuacaggcuugagccaccacgcccggcugacccuaugguaucuuuggguuauaacuauuuaacucaacagcacacuaucacacugaaaaauauuauugauuuagaaugugaauuccuaaaguauaauggucaugugauuuauauucucuguacaauaugguaaaaauauuuaguaaauuauaaucauguaccauguaaguaacauaagaacagucuuagaacacuugaauauucacaaaguugaaaaagcaugauuauuuugaauuguuguccacaaagaauuuauccaaauacaaggucaaauacucuaugauauuuauuuaugcaagauuguauuugucagucacacuaaucauccaccugacgagcaaacuuacugaaguguguaacuaaaacaccuguuauuauuuuaguuguggaaauauauauuguaagaaagaacuuauuuuaacacagcaaauagcuuucacugcccuaaaaauauuaugaauuuuccaaacacauaauugcaaaaaaaaaaaaaaaagccaguuuacaggaucuggucccaaauguuaguucauuguaagauuauuaaauacauguuuaaauuugcauaggaauguguaaccagcacauauuaauauuuaggugguuuccucaaaucauuuguuauaucaccacacugcaugacaaaguuaaauauaaaugaaauuuuaacuuuguuaaauuguguacaaauacaaucacaauacaacagucugccaauguuuuucauuuuuuuuuacagaggaaaauaaacacacuauaguccauaacaugaaaaauuccaucaguuguuuacaagcaugaauuuguacccaugccuuuugaucuuuaaaacaaaucugaccuuaauucuagcucuauuucaucucaaucagaaugcacauaugaaaauaaauaagccaacuuuauuguuccuucaaagcacucccuuuaaaagguucccuuuaaaauaaguuucuguagccuacuaacaauagcuacucaguuaaugaacuaacuagaaggacaauuuaccuuaaagagagggaacucaaaucucuguuuaccguaguccacaauauaaaacacagaaaaacuauuauguucuucaauaaaucaagcaauugugaaaauuucucaaggaucaauuccucucucuuacagaaggcagaaauuuccuuuuucuuuugguaguucaucucuaaaguacuuaagugcauaaaauuguaauaacaaagagguuuguacuuaaaacaucuauugcauaaaagaaguugcacauugauaucaauguuaucuaaauacugaaacucaguucuacauaauaugaauacauaucugcauuuuagaguaaaggcaagagggugauuugugaagaaaacugugucauuuuccuuugucuauucccaaaauagaaauguuaucugucaggauaagcuccaugcagaaucacaauaguuaccuguuucuaacagaacucguacaacauccaccuuuccaaacaaagcugcuucaugaagugcacuccccuuuucugucuggaaaaaaaaaaguaagaaaaaagaaagcacgguugcauuuggaaugcuuacagguugaaauaaaaugcucacauuuuacauauucauacauauuugcuguaaucucagcucucccuaacagaaaggucauguggaauaaagaagagauucuaaaagcaaaauccaucggcuuggggauuguaaaauaccucugcuucuaaauagaaauuugggccagaugcagcugaggcggauggaucaccugaggucaggaguucgagaccagccuggccaacauggcaaaaccccgucucuacuaaaauacaaaaauuagccacagguggugguaugugccuguaaucccagcuacucaggaagcugaggcaggagaaucgcuugaacucaggaagcagagguugcagugagccaagaucaugccacugcacuccaaccugggugacagagugggacuccaucucaaaaauaaauaaauaaauagccauuugacuuucuuaugugaguauuucaccuucucuuagcuuuagcucuccuuaaguauaaaauaagagaaguaaugcccaccucacaaggcuuuugugacuaugcaagaagcucauuuaaucagcaugcauuuauuaaacaccaauuauaggccaagaguagcugauggauauucugagguauggaaauaucauccuggcccucauauauucacauucuauuugaagagacagauguauaaacacagaugcuccuugacuuccaauaggguuaccuccugauaaagccaccauaaacugaguaucccuuaaauugaaaaugcauuuaggcugggcgcaguggcucaugccuguaaucccagcacuuugggagccaaggcagguggauugccuaaggccaggaguucaggaccagucugaccaacauggugaaaccccaucucuacuaaaaauacaaaaaaauuagccaggcgugguggcaugcaccuguaaucccagcuacucaggaggcugagacaggggaauugcuugaaccagaaagguggagguugcagugagccgagaucgcaccacugcacuccagccugggugacagagugagaauccaucgcaaaaaaaaaaaaaaagaaaagaaaaagaaaagaaaaugcauuuaaacacagguaaccuaccaccaaacaucauagccuagacuagccuacuuuaaauaugcucagaacacuuacauuaaccuaguguugggcaaaaucauguaacacaaagccuauuuuaugauaaagcauugacuaucucauauacugcauaucgcuagccugagaaaagaucaagauucaaaauuugaagcauaucaaaaaugcgacaguuucacaccauuuuaaagucgagaaauuguuaaauuaaaucauuguaaguugggggcugucuguaaauauuuaugauaaaugaaaucuaaacaauuuaauguagccauaaaaaagaauaaaauccugucauucacagcaacauggaugagccuggagaauauuauguuaagugaaauaagucaggcacagaaagauaaauaccacauguucucacauaugugugagcuaaaaaaguuggacccauagaaguagagaguaacauuaugguuaugagaggcugggcaggggagcagggagaggaggauagggagagguuggugauugacugcgaaauuacagcuauauaggaggaagaaguucuaguauucuuuaguagggugaugauaguuaacaauaauugauuauauauuuucaaauacuggaagagaggauuuuuuaauguucccaacacaaauaaauggcaaauguuuaaggugauagauaugcuaauuacccuaucauuauauacuauauuucauguaucaaaauaucacucuguaccccuaaauauguacaauuaugacaugcaauuaaaaauaaaaauaaauuuaaaagccaaaaaaaauuuaauguggcuuaagaaacccagaugauauuuucucccugcuuuccucuccgucccauccuuugcccaucacaacccucuuccaaaccucauacccuaugcuccaggcauacugaacuuucuuuuuuuuuuuuuuuuuuuuugagacggagucucgcucuguggcgcaggcuggagugcaguggcacgaucucagcucacugcaagcuccgccuccaggguucacaccauuccccugucucagccucccgagaagcugggacuacaggcuccugccaccacacccagcuaauuuuuuuguauuuuuaguagagaugggguuucaucauguuagccaggauggucucgaucuccugaccucaugauccacccgucuuggccucccaaagugcugggauuacaggcgugagccaccgcgccuggccccugaacacuuucauaaucauuucauauugcuuucuuccacagggggucuccaaggcuggucucucugccuggcaggaucuaacuccuagcacucuuaaucuagccaucuagauauaccuaccacuaguuaauuuucagcaugaauaagaaccauguggagaaacugucuuaaaaacauacuucugggccccauccccagaguuucugauucagucgccugagauuaggccauagaauuuccauuucuaacaaauuccccugugauucuguaggucuaaagaguaugcuuuaagaaccauaaacauguacgauaucucgaaucuuagcuuaaaauaauugcauuuauaaagacaucccugaccccugaaguuuaguguuuuuccuggauguuccacaucaaucuauauuuuccuuaucacagcacucauauaccacauuauaauuuuauguaauugucugguucccauaauaaacuguaaguucagcggaaauguaggccacaucuauuuuuucaccauuguauccccaaugccuagcaaaguacuuugaaaauauagauguuuaggaauuuuucugagggcaagaaguggagggagggaagaacacaggaugaaaaacuaggacaauuugugaguagugcaggauaagacugauucugccuucaggaagcucaaggaagauuccaaagaugaagcuuuuugagcuacacgaauguuaguugucucuuuuuuuuuuuuuucauucuuuuucuucuucucucaagaaucuaacaaguaucaguaggucgugugugugugugugugugugugucugugugucuguguguguuuucaauugaauagugucaagguagcaauuuuguugcccuauacuaaaugugaucucuaaagugggauucuaaucucaaccugaaauagaaauaucacuauaaaauaacauacaauguaaaaacucuuuuuuuuuucuguuuuucuuuuuugagauggagucuugcucucucgcccaggcuggagugcuguggcaugaucucagcucacugcaaccuccgucucccaggugcaagcgauucuccugccucagcuucccaaguagcugagauuaaggcaugcgccaccacgcccagcuaauuuuuguauguuuaguagagaggggcuuucaccauguugaccaggcuggucuugaacuccugaccucaaaugauccgcccacgucagccucccaaagugcugggaucacaggcaugagccacugcgccuggccaaaacucuuuaauaaaagucuauuauauaauuaacccaaucuaaaguagauaaguacauuauuaagcaggcuugaggaacacugaauaucaaugugaucugacuguaucuucaagauggaaugacugaaaugcccuugaauuauaaucugacuggcaugauauguagauacugaaaaaaauggaaacaaaaaaauaauuuguaaauauacagcacaguuuugaaggaaaugagaaacuggaaacugauucggcucuuaagaaaauauuucaauguggggcaugaacauuuuauuuuuucccuuccuuaaaaauauuccuugaaauaaucuaauuuugcucauucucaugcuguuuuucaaccagauuucugauuacuaauuugauucccuuacacuuuucacaaaauuuuggacuugauuucagauaaauccuuccugauauagcauacuucaguucauucugaaaacaaaccaaagaauauuuuaauucaggauugcgaggggaaagaaauagaauuccccacagccuuagggaaaggcgaggacagaaaguaugaaccccaggggguuagcuuuggaacagguauuuguuccagggagucugucaaccaaugcuagacuagugccuggacuuuaaccagccacucaagguacgaguggcaguggggcagaagacagucugaagucuaagcaagcugaaaguuuaaaugagggaccccuacaaaacucuaaaacuucuaaagaacauccucagugaaaauuaaaacaacaacaacaacacauugcacagaaggggaaaggaugucuaacuaggucuuaguuguagauagagugaaaaaaguaaaucccccuaagaaugccuaaccacaauucuacacucacaugguaaguuuaaggcaaaauuguacaaucucuaugaacuccagauccucauccaaaauguagaauaaagugguccuggguuucuaguaauacaggcagauauaaaugcuuagaaaaaagcagauauaaauccccucuguaaaaguacacuuucaacucaggccuccaaauauuccagcagaugaagcucuaagaaauacaaauucaaaauuauaaauuacugaaugugaaaggaagcaucccaccaugaacaaggauuaguaaauaaaaauacaaaagaauaaaacucacaaaaauuucacauauugaaauggucagguauagaauauaauacauaugugauaaauaagaugaaagaacuagaacaaaagaauaauuaucaaaauugaccagaugugaaaaugaaucaaauagcauucuagaaauagaaaauauaauauuuaaaaucaauggcuuaauaacauauaaauagcuauugaagggguauuaaacuggaugauagauuuuuuuaaguacauaauugauaggguuuggcuauguccccauccaaaucucaucuugaauuuuaguucccauaaucuucaugugucaugggagagaccggcugggagguaauuuacucaugggggcaauuacccucaugcuguucucaugauagugaguucucacaagaucuaaugguuuuauaaggagcuuuuccuccuuuggcucggcacuuccucuugccugccaccauguaagaugugacuuugcuccuccuucaccuuccaccaugauugugaagccuccccagccaugugaaacuauaagucaauuaaaccucuuuccuuuauaaauuacaaccucagguaugucuuuauuaggagacauacuaauaggagacuuaauuaggagaacagacuaauacaauaaugcaauaaaaagaauaagagaugaaggacagagcaaaauugcagaauauaagccuacaucauuugucuuccccacuggaacaccgaauauuaacaacuaucugcacacagaagagcauugucacaagaaccaaaaaucaagugaacaaucacaguaucugguuuuaacuuccuacugcugaaauagacacugaggaggguggaagagaaagucuugaaucacgggcgcugccccucucccauuccauggcaguggccaugcugugcagauagaaaaucugugcauuuuaggaagggagaaagcagugacugaggaacuuuacauugaacucagugcugcuuugccagaguggacaauaaagcugugugggguuccgccagugcccacacauugaggggacauuugcaccagcccagccagaagggaaucacccauggaaugugagucucucaacaagccucaccacugcacugcaggcugaagugcucugggauccucaguaaacuugaaaggcagucuaggacacaaggacugcaauuccuaggcaaauccuagugcuaggcuaggcuuagagccaguagacaagauuggcgcaugaccuagggagacagcggcagauauggcuaacgaagugccuaugccauuccuccaccaaccucaggcagugcaagugcaauucacaacaacaaaaguaacuuuucccuucuauuuaaggagaggagagugaagaguaaagaggacuuugucuugcaucuuagaugucagcucagccauaguaggacagggcacugggcagaguugugaagcccuaaauccuggacauuucuagauguaccuugggccaaaagggaacccacugccuugaaggaaagaacccaguccuggcaggauucaucaccugcugacuaaagagcucuuggagccuaaauaagcagcagcaauaacugggaguacaccaugggccuuguugucugagaaaugcuggcuucaagggucauccagcacagucccagcugugguggcuacggugaacaacuucuucuguuugaaaacagcagagggaaaaguaaaggggccuuugccuugcaccuaagguaccacuucggccacaguaggaaaaaacaagcaggcacacggggucucugcguucaggccuaggcucuuggacaacauuucugaaucuguccuggaccagaggggagccuacugcccuauagggugagucugaggccuggcaggacucaccauaagcugacaaaagagcccuugggcuuuaaguaaacauuggcagugaccuagaagaacccucguggaccagaaguggugguggccacagggagagucuccucugccuguggaaaagggaagaaagaguaagaaggacuuuguaaugaagugugagugccaauuuagcugcaguaaauuagaacaucagguaaacugcuaagguuuuugacucuaauccuuggcuuccagacagcuacucuggacaugcccagggucugggggaacucacugcccugaagauuaggauacagugcugagcuggcuucaggucugacccaacacaaucccaguggugguuuccgaagggguguuugcaucaccacacccccagguacagguggcucagcacagaaagacagacucuguuucuuugagagaaaggagaaagaagagucucugccuaguaauacauagaauucuuccacaucuuauccaagaccaccaaggcaauaccucuaugagucugcaaaaaccacaguguuaguggguuuggggcccaagucccuucaaaugccuggaaagucuuccuaagaaggacagauacaaacagguccagacugugaagacuacagucaauaucuaacucuucaaugcccaaacaucaagaccauccaagaaaacaugaccucaccgaaugaauuacauaaggcaccagggacaaguccuggaaaaaaaauagauauaugaucuuucagacagagaauucaaaauagcuguuuugaggaaacucaaagaaauucaagauaacacagagaaggaauucagaauucuaucagauaaauuuaacaaagagauugaaauaauuaaaaagaaucaagcaaaaguucuagaguugaaaauugcaauugauguaaugaagaaugcauuagagucucuuaagagcagaauuagucaagaagaaaaaauuaacgagcuugaagacagguauucgaagacacacugagagucuacagccauaccgccccaaacgcacccaaucucaucugaaaacacacugagaagacaaaauaaaaaaagaauaaaaagcaaugaaaccugcuuucaagaucuagacaacagucucaagagggcaaaucuaaaaguuacuggccuuaaagaggagguugagaaauaguuagggguagaagguuuauucaaagugauaauauuggagaacuucccaaacccagagaaagauauuaacauucaaagacaggaagguuauagagcaccaagcagauguaacccaaagaaggcuacuucaaggcauuuaagaaucaaacucccaaaggucaaagauaaauaaauaauccuaaaagcaguaagagaaaauaaacaaauaacauacaauggagcuccaauauaucuggcagcagacuuuucaauggaaaucuuacaggucaggagagaguggcaugacauauuuaaagugcugaaggaagaaaacuuuuacccuaaaaugguauaucuggcaaaaauauccuucaagcaugaaagagaaauaaagaccuucccauacgagcaaaaucugagggauuucaucaacaccaggccugucuugcaagaaaugcuaaagggaguucuucaaucugaaagaaaaggaaauuaauaagcaauaagaaaucauuugaaggugcaaaacucacugguaauagcccacagaaaauccagaauaacccuguaauuacggugugaaaacuacuuuuaucuuaaguagaaacacuaaacaaugaaccaaaaaauaaugacuacaaugaauuuucaagacacagagaaugaaauaagacauaaagagaaacaacaaaaaguuaaaaaguuagguggcaaaguuaaacuguauaguuuuuauuaguuuucuuuuuguguguuuguuuguuuaugcaaucagugucaucaucaguuuaaaguaauggguuauaagguaguauuugcaagccucaugguagcuucaaauaaaaaaacauacaauggguacgcaaaaaaauuaaaaagcaugaaauuaaagccuacugccagagaaaaucaccuucacuaaaaggaagacaggaagaaaggaaaaaaggaagagcagaccgccaaaaaaagagagcgagagaaaaaaauaacaaaaugacaggaguaaguccuuacuuaucaacaauaacauuaaauguauauggaguaaacucuccaaucaaaagacauagaguggcugaauagauaaaaaacaaaacccaaugaucugaugccuacaggaagcacauguuaccuauaacgauacacacagauuaaaaauaaguggaugaaaaaaguauuccaugucaacagaaaccaaaaaaccacaagaguagcuauacuuauauuaggcaaaauagguuuuaagauaaaaauuguaggaaaagacaaagaaggucauuauauaaugacaaaggggucaauucagcaagaggauauuacaauuguaaauauauaugcaccaaacacuggaguacccagauauauaaagcaaauauuauuagugcuaaagggaaagauagaccuaaauacaauaauagcuggagacuucaacuccccacuuucagcauuggauagaucuuccagacagaaaaucaacagauaaacauuggucuuaaucugcacuuuagaaaaaauggaacauuuuaucugauggcugcaaaauacauauucuucuccucagcacauggaucauucucaaggacagaccacauguuaggucacaaaacaaauuuuuaaacauuuuuuaaaaaugaaaaaauaucaagcaucaucccugaccacaauggaauaaaacuagaaaucaauaacaagagaaauuuuggaaacuaugcaaacagacaaaaauuaaacaauaugcuccugaauaagugggucaaugaagaaaucagaaagaaaauuuaaaaauuccuugaaauaaguucauggaaacacagcauaccaaaaccuaugggacacagcaaaagcaguacuaagaagaaacuuuauagccaucaaugccuacaucaaaaaggaagaaaaacuuaaaauaaauaaucuaaugaugcaucuuaaagaauuuaaaaagcaagagcaagcugaaugcaaaauuaagagaagaaaagaaauaauaaggaucagagcagacauaaaugaauuugaaaugauuaaaaaaagacaacagaucaacaaaacaagaaguuguuuugaaaagaaaaacacaauugacaaaccuuuagccagacuaacacaagagagaagacccaaauaaaugaaaucagaaaugaaaaaggagacauuacaacuaauaucacagaaauucaaaggaucaugaguggcugauaugaacaacuacauaccaauaaauggaaaaaucuagaagaaauggauaaauuccuacauacauacaaucuacuaaaauugaaccauuaacaauuccaaagcccaaacagacgaauaacaaguaacaagaucgaagccauaauaaaaagucucccaguaaagaaaagugcaggaccgaugacuuugcugaugaauucuaccaaacauuuaaaaaacuaauaccaauccuauucaaacuguucugaaaaauaggggaagauggaauacuuacaaacccauucuacaaggccaguauuaaucugauacuauaccccaagacacaccaaaaaaagaaaacuauaggccaauaucucugauuacuauugauguaaaaauccucaacaaaacuccaacaaaccaaauucaacaacaaauuaggauuuaucccugugaugcaaggaugguucaacauaugcaaaucaaucaaugugauacccuguaucaacagaaugaaggacaaaaaacauuaucauuuugacuaaugcugaaaacauauuugaugcaguccaacaucccuuccuguuuuaaaaaaaaauagucaaaacaccucaauguaauaaaauccauauaugacagacucacgacuaguaucauacugaaugggggaaaacugaaagccuuuccucuaagaccuggaauacaacaagaacacccacuuucaccacuguuacucaaaauagaacuggaaguccuagcuagagcaauuaaacaagagaaagacauaaagggcauccaaauuggaaaggaagaagucaaauuauccuuguuugcagauaauacaaucuuauauuuggaaaaaccuaaagacuccacugaaaaacuauuagaacugauaaacaaauguagcaacguugcaggauacaaaaucaacauacaaaaaucagcagcauuucuauaugccaacaguaaacaaugugaaaaagaaaauuuuaaaaaucccauuuacaguagccacacauaaaacuaaauaccuaggaauuaaccaaauaaaugaaaaaucucuacaaugaaaacuguaaaauacugaugaaagaaauugaagaugacaucaaaaauggaaagauauuccaugcucaugaauuggaagaaucaauauuguuaaaauguccauacuaaccaaagcaaucuacagauucaaugcaauaccuaucaacauaccaaugacauuuuucacagaaauggaaaaccaaucccaaaauuuauacagaaucaccaaauacccagaauagccaaagcaaaccugagcaaaaagaauaaaacugaaggaauaacauuaccugacuucaaauuauacuacaaaucagaaugguacuggcauaaaaucagacacauagaccaauggaacaaaauagaaaaccuagaaacaaaucuacacaccuacagugaacucauuuucgacaaaagagccaagaacauacacuggugaaaagacagucuucaauaaauggugcugguaaaacuaaauauccauaugcagaacaaugaaacuagacuccuaucucucacaauauacaaaaaucaaaucaaaauggauuaaacauuugaaucuaaggcuucaaacucugaaacugcuaccaaaaaacuuugagaaaaaucuccaggauauuggucucggcaaagauuucuugaguaauaccccacaaguacaaacaaccaaagcaaaaauggacaaaugggaucauaucaaguuaaaaagcuucugcacagcaaaagaaacaaucaacaaagugaagagacaacccacggaauaggagaaaauauuugcaaacuacucaucugacaagagauuaauaaccagaauauauaaggaacaaaaaaacuuuacaggaaaacaucuaauaauacaauuaaaauauuggcaaaacauuugaauagacauuucucaaaagaagacacauaaauggcaaacagguauaugaaaagguguucagcaucauugaucaucggagaaaugcaaaucaaaacugcaaagaaaugucaccucaccccaguuaaaauggcuuuuauccaaauguuaagcaauaacaaaugcuggugaggaugugaaaacaagggaauccuauauacuguaggugggaaugugaauuaguacaaccacuaugaagaacaguuuggagguuccucaagaaacuaaaaauagagcuaccaaaugauccagcaaucccacugcuggauaucuaccccaaagaaaggaaaucaguauuuugaagagauauuuacaaucucauguuuguuguggcacuguucacaauagccaagauuuggaagcaaccuaaguguccaucaacagaugaaaggauaaagaaaaugugguacacacacacacacacacacacacacacacauuuucuuggaguacuauacagccacaaaaaagaauaagauucugucauuugcaacaacauggauggaacuggagaucauuauauuaagugaaauaagccaggcucagaaagacagacaucacauguucucaguuauuugugagaucuaaaaaucaaaacaauugaacucacagagauaaagaagggugguuaccagaggcugggaaggguagugggggcacagggguuagagggagguggggaugguuaaagcguacaaaaaauagaaagaaugaauaagaccuaguauuugauagcacaacaggggcacuauaaucaauaauaauucaauuguacauuuaaaaauaaauaauuguaacacaaaagauaaaugcuugaggggauggauacucaauuuuccaugaugugauuauuguacauugcauacauguaccaaaauaucucaugaacccauaaauauauauaccuacuauguauccacaaaaauuuuacauuuaaaauuuuuuaaaugacuacagaaacaaauaagcaaagaagguaaaaaagaaauaagagauggaaaauaugaaagauagaauaaaauaagaggauucaacauaugucuaaucaauuuuagaggaagaagauagagguaaauaauagucaguggcuaagaacuuuacauaauugauaagacacuaaguuccaggaccagcaagcaagauaaaugaaaagaauacauccuggacauaucacaguaaaacuacaaaacuacuaagauaauaacuuuaagacacucugagggaaaaaauugccuaaaaagaaauaauaauuagaucaauagcggacuucacaacaaaaauaaauaauaaagucagaagaaaguauaauaccuucaugugacaagagaaaaaaaaucuaucaaccuagcauucuacauucagucaaacuaccuucuaaaaaugagaguaaaauaaaaacauuuucagacagacuaaaaaugagugguuacuuacaacucuuacugaaagaacuucuauaggauauaauucagaaaaggaacugagaugcaagaaguaaugauaaauaaagagaaugguuaauaugaggcuaaaucuaaacaaauauuuaaaaauaugauagugucuacuuuuggcacugauuuggcuucacagauacuuugauaaaggaugaugcacacuguagacacggaaaaggucccacuuuauacacagggaauauauuccaagcaccccaguggaugucuaaaaccaaagauaguacugaacccgaaugccaucaaucagaauucauuucuguucaugucuuccauccacaaauucaaggccuuuuccaucuuaacuaagcacuuaccgugcacuauagcuguaacuucuguaguuugaggugcaacagcaaaacuaguacaaauuucuuuuucuuucuucucaacuucagauagaggauucauucuuaccauagaucuuagcaaccucuguguacaaguuuuucuuuucuuuaguaagucaagaacuuucaccuuuucacuuagaggaagcacuuuacagcuucucuuuggaauaugcaaauugucagcaucacugcucuugugcuuuggggccauuauuaaguaaaauaugggugacuugaacccaagcagugcaauaccagaacagucgaucugauaaucaagagggcuaccaauaggcaaguagugucuacagcacagagaugcuggacaaagggaugauucaugucccaggcaggacaaaguaugauggugagaguuuucaucaugcuacucagaauggcauggaauuuaaaacuuauaaguuguuuauuucuauaauuuuccuuuuaauguuuucagaccaugguugacugcagguaucugaaacagcagaaaacuaaacaucagauaaagguugggugggcggcagggguagggggaacuauuauauucuagacaaugaaaauacauaaucuccaccauaaauaaacaaaucucuuucuggaaaaagcagauggagcaaaccuggguuccaguggcagcuuggcuuuuaguaucucugaaaauucauauauccuaugagaaacauauuaaaaaccuaacagauacauccauguugugugggaaaaauuaaaaauaaaauacaaauuuuaaaaaccuaauaugguuauugggaagguuaaauaagauaaacauacaacaaauaagauuuuuuaaguguuuuauuaaacuauaaaguaaugacaaguauuaucaauaauauuucuauuaaaaaagcaauuagaaaaccuauuuuaaaaguaaccucaauuauguuaauauuaauuacauacauguauauccuuuacauuauuccaagauaaaaaugcuauguuaaguagaacuaauguuuucauacaauaagaagacacagaauucuucaauaaaaacagaaaagguuaguagaugauaaacauauuuuuagccuguaaaaaugaaucuguuuuuacaaauucaagguugcuguaauuagcuucuuugguaagagaacaugagaacugucaaauggaauggauuggucucauaauucuaagguaaacaaugguaccaagaacuauuuacugcuaucacaauguugucacauaguguacagaauguaaauaugucaaacccauggacuuuucaaaauauagauuaauuuuguaauaauuuccuucuuuucaucagagauuagaaaaauuuaagaauauuuugccaagguguaaaguaagauuuaaaaaaaaaucaagugccuuguggcuuaucacacccuagacagaguccgugucuaauugucuaauauucucacucaaaugagcacuauucuguacaucucagcauucugccccaaaucuacaacccauaaccggccagaccuugaaaaauucuauucuugugaaauauuuaguccaaaacauuuuacaagaaaguaggaagucuacaaagaaacaacacugaacaaggugaacccaaaggcucccaucccuggagauuucaguccugcuuuucuuauggaucaaaauucuccauuuuauuuaaauuaaucauuuaaaaaaaacaaaauuuccaaaaucgauaaucaugcaguuuauaacacagugacauuucaaaacuuauccaguaaccacacauaaagcacucauaacaucucagcaccuuuuaggggaaaaaaaaaagacaaaccucugaacacagugaugaaaacagcugagcgaaaaguacugaaaugauauauauguuaacaucaauaacugaauuguugaugaaagcaaaagaaauucucucauugauuggaaaugccuguuaaagucaagccuugguagcaccaaagcugagaaaaacaagauaagucgcaagcaaaagggagagaagaugacguucauguuuacagcccuggguuucagcuucccuucuuuuuggcguuauauauuucugugacuuccauggaagcucaguugugcauuuaaagggauguuuguuauauuuuauccaaaauuucuagauguuuuaaagucguuuuuagguuaucuauucuaccagagugccaaaacagcagauggaaaagggaugcaaagaugucagagcuuagcugcacugguuuccccuuccaaauuuagcacuccaaccauaauuauccugaagccugcgaaagagaauaaugagauaaagaccgauucuugauuaaaggagaaaauaaagauaacaauuaugauaagcaauaaugauuguggugacgaucagcagagaaaauagcacagauagcauaaaacugugagaagcaagacccacaacuauuguaacaacugguaaauaaagauaaccuuacuggagaugaagaaaaaacaacuagaauggcauuuaacucagaaauaaaauucccuaguacccuguuugguacuuagccacgugggcaccucuuggaauuaaaaaaaaaaaaaaaaaaaacaaaagauaacaacucaacuuaguguuugacaacaaacauaugaugucugaacaaguuggaaggcagcagcucuuuugcauuaucuagaccauaucuagaggaguauguucaauuguggguaucuaacuuuuaggaccaaugacagaauacaauguguccagagaagagagugccaaagaauaaaggaccuagaaaaacaucgugugaagaauaaagguuauaagaauguuuaaacugggaggaaaauggcacaagagaaauaugacaugucuucaaauaauucagaauaccauuguugcuauucaaaagaagaaaucucccucuauuaaacuagggacuucaagucuuggucuuuacucauucucucuuccuucacuucauaucaaaggaagcacccuucuuuucauuaacauuauuucuccacuugugcucuuuauucuaucacuuucugcugcuucuugaauuuugaucaucucugccucuugcaucuucaaggcaaucuuucuccauaaacauacacaccuuuccacuauuuaaaaacaaaacaaacaaccaaagaaacuuccugugaaccugcuuucacuucaagcuucuauccgcuaucuuacuuuucuuuauuccacgcuuuaugaaaagucaucuucccucuuuuaggcacaauuuuugccuaguuuuguuacugcuauauccucuggcacauaguaggcacucaauaaauauaugauaaaugaauugauuacaugaaauugugcugucuuggcauuccucuuuuaacugcuucuuuacagaccuuuuuccagaaacucccugaauauucuuuaaucagccucuucugucucccuacauucuguuucuuguaagcccuucuaucucauggcuucaucucuuacuccucugaggcuagccucuuagaaaguuagccucauuuaaggagcacauccaaagagagaccucucugacccuuccgucucaaucacagcacccaguuuguuuccauuauagcacucacugcaauuuaucauuuuuauguuguuuaugugcuuauuuucugucaucccuacuagucuauaacuccaugggagcaggaaacaaauuuucuuccuccuggagcauagugccugguagcauggcaugagaagucaggaggggcuaggguauccucauagggaagccaggguucaguuaaaagugaaagaaagggaguugcuuggguagugaguaagguaaguaaaggaaggccucacuauuaaggugacauuggagaagacaccugaggaaagaagggggaagaaagucaugaggguuaguaaggcagaggccuggagguaggaguguacauaauguguuccaacaagaacaacaaggucacuguggaugaagcuaagugaagaagggcaaagaagaguaggugguagcuuuagagagacagugaaacuaaguaauauaaaacccuaucagacacuauaaggacucuggcuuuuccucugagugaaauggaaaaccaauagaaguguuuuugaguaggaaaaugaaauuaccugacugaaugggaucacuucuggcuguuugacugaaaauagacugaagggaauauguuauggauugaauaucugugugccccaaaacucacaugcuaaggcccuaaccuccagugugacuguauuuggauauauggccuuucuggaaguaguuaagguuaaauugggucauaaggguguggcccuaauccaauggaacugguguccuuauaagggaaagaggaaacaucagggaacucucucuccauucacgcacagaagaaaggccgugugaggauauaacaagaaggcagccaucuaacaagccaggaagaaagcccucacucaggaauggaauuggccggaacuugaucuuggacuuuguagccuccagaauugugagaaaauaaauuucuguugcuuaagccacucagccuauaauauuuugcuguggcaaccuaagcagacaauacagaagccaaaaaaaaaaaaaaaaaaaacggaggaaaacuagucaggaagcaagagaugauuaggucuuggacuaugguguuaaucuugaagauaauguaaaguagugaaauucuggauacaauuugagcacagaaccaauaggauuugcugaagaacugaauguaaaaucugaaagaaaccguaaaauucugggccaaacaacuagaaggauggcacugccuuuugacaaaaugggaaagacuuggugauaugcaaauuuuugaagaaagggguacagaugcuagauuuucagcuuuggaaaugcugaguuugagaagccuauuagucaucugauagauauguccaguagggaauuacauacacaaauuuagaguuaggguggagucugagaugaagaaauagacuugguaauugucagauaaagaugauauuggaacucaagagauuggaugaggucaaugaggaaguagguauagacagagaugaaaagauguuugaguacuaagcccugggacacuccgaugcuuagagaucaagaagaugagggcaguuaacuauggaauagggacacgauagauuacauuauuggccucuccuuuuauaugcucuuugccguaugacuuuguacuucuuuccacuuauaugaguugaguauauuucucuuccucuuuauuugaggcuugguuuugugaccugauuuagccaauggaugguaaccaacaugaugcaagcagaggcccaaacugugcuugcaugauugagcuuucucucuuaugcacaaucaaugccccccugccuagucccaggaggaagauaauagacacgugcagcagagauucccaggcuaacuuacagcaucaaacauacuucccccagcuucuucaagaagucaccagugaacuaaaugaaaaccaaaagacagucguaucucagaggucaaaagaaaacggugguucaaagaagagacagauacugacuuugucagugcugaugaugaaucaaguaagaggagaagcaggaauugacuguuggaucuaaaaguaugucagucauuagacaacuugacaaaggcaaaaacaaggacuuuuaaaagugagggaguuagaguggccucaagagagaauggaggaaagaaauuggauacaaugaguaaaaacaagcuuuucuaacuacguugcuacaaaggggucagagaaaggggaugguaaggagaaggaaaugugagaucaagagaguuuuuaaaagaugagaaauauuacaucuuugcauccuuauggaaaugguacaguugagaaagaaaaaacguaugguauuaaagacagaaaauauuugucagaguucccacguggacaagaaaggauaggauccaaugaacaaguagagaggaauuagccuuagauacaaaccuaaaagguucauuuaaagcaccaggaaggaaaguagacacagguacauuggcagauguggugguggaaauuugugauugcuugugguuuccucagugaaauaaaagcaguaucaugaucagagagggaugauagagaaggagguguugaaguuuuggaauagagaugucgugaaauuaucaucuagggaaaucagagaguaaauggauuauaauggauaauuaucgccuauguacauaucuuauuucuggugccacuauaagccuuugagagcaaaagcuguaucuuacuuaguuuugcaucuuaacagcucuuagcauggaaacuuguacuuuuuauuauuaacuuucuguaauuuuacuuucauuuccuuuaauagucacauaaagucuaauuggcuuaagguuguacuaguucuuuaacucuucaagucuuaugagagaaacuuauaagaaacucacacaaugaaagcacuagcaugauauggcacuaucgcuaucugguuacccaaaaucaaguucaaaauucauaaaaauaauugcuaacuucaagagaaaacugcccauucaacccuacuuucuuaauaucuuacuuugacugauucucuuuauuaaaaaaauauuuaaagacuaaaggguuuauaaguaaagaugauaugaaauuugcccaaaguauuacuuacuauuuuaaauauguguuauaauuuaaaauuacucagagaguaaugaugcagaaaauaaacuucuagagcaaauauuaacaucaaugcugcauuuaaaaacauauguaggucaggugcagugguucaaauuuguaaucccagcacuuuggaaggccaagaaaggaggaucacuugagcccaggaguucgagaccaaccugggcaacauagugagaccuuuucucuacaaaaacuaaaaaaauuagccgagcacaucagcacaugccuauagucccaccuacucaggaggcugaagcaggaggaucacuugagcuugggaguucuaggccgaagugagcaugauugcaccacugcccuccagccuggguggcagaauaagacccugccuuuaaaaaaaaaaaaaaaguaaaauaaaauaaaaucacauguaacuacuaggaaaagacaagauccucaaaagccaucuauaaguuuuaaagauuuauucauaauaacuugaauguaauugaagucuaaaaguacaauacuauaauuuaccaaaugggauuacuuuuaauacuaauucccaacagguuagcuagagcaguuuaaugaauauuaaaucuacugaaacaauuugaggcuacuagcuacauuguucacucucagccagugagaauaucaacaaaccuacuugauauucaaaaauuuugcacugagucugaugggaaaaacuugguaacaauuaauuugaguaauaaaauuaaauauucacccccccccaaaaaaaaaggcaaugagaccaaaaaaaaaaccaacauauuuucuaugaacaaagcaacaauaacaaaagcaaaauaucaacuaaggcuaaauauauuauggaagauucauuucauugagauauauuuuagaaagauguugucaguucuacuuccuagaauucuuagaaugagugucaauagaagagguuauagcaacacagaaguuguccaccuuacucagacaucaccccgauacuucugauuagguguucaaagugaucuaagcauauugucugccuuucuucugauaugugaagaacaaaucuaaauguggugaggaccaagcagacaaucuaaaggaaugacaauggcaaugauauaaaaugguagaaugaggucggagccuuggaaagcauuuaccccaucuaaaagcacucaaauucaauauuuuaaaauacucuuuagccaaauaaugcacauaugcaagcuaaaggccaccuaaaauucaaagucguguuggacuuucaaagguccccuucaaaugucacuuccaucaaugacuucucauguucucccucuuaaaauccauauuuuccucacccguagauccacagcucuuuguuuuagcauuuauuauaugucauggaugggaguuauucuugcaaauuuuuugucuccuccacuaagcguggggcagagauaguuuugguuuuuuauucuccaaaagcacaaaauacaguguuuugcagaaaaaaaggacacaucauauacauuuauaaaauugaauuuaaacucuuucccuucuggucaugucaucuaguacaaaacaugaaaggaucuuggucagggauaccaagaagcuuacugaccucagucagaggggaaguccuugguuauauugcagucugugcaaucaaguuuaaaaauauuacagaagugugaaagcaguacauccagauuagagaaauucaacauuuauacaauaaacaucuaguuuaucauuaaacaacuuuuaggaaaauaacuuugugagucaccuacaauaguaagcauaccuacuuauuuucaauaccccuuugaggagagagacuguuuuuccuuaauaugacuguuagaaaaaauucuuaugcuuuuuugagaggcugccaaaguugaauaaauaagaaauugagaaaagauauuacaaauaucuaaacuacuaaauaaugcaggcaaagcucuaaagcaagcucugguucagggugcuagccuuaaaacugagauuggaaggccugagauuuuucuaaauucaauaaagaaaacucuggaaauacaggauucaaucucugaacaauuccuaggaaauauaaccccaucugugagcacgcauuccaccuggaguguguaauuauuugcaacauuugccacauuuagucccucuggguauucacacccuuuuacaauucacgcccucuucuaauacagagguagacucuauuuuccaacuccuugaauauggguugccuuuaugacuugcuucagccaagcaaacauggcagaagugaagguguacuaguuccaagccuaggccucaagaagccuuguacaauucuguucucucucucagaaccaugcaugccaugugaguaagcccaggcugaccugcugaaucaugacagagaaguggcagucucaccuaucacccuagacaacauccagccagccucugaaacagaaacacauaacugauuugcaguugauuucacacacaagagaacacagccaagaccagaagaaccaucaguugagcuuagacuaaauugccaaucacagaauuaugagcuaaauaaagaguuauuguguuaagcuauuaaguuuugggauaguuuguugcacaucaauggcuuacuaauaaggggagaaggucacaauaugacagaaagcaaaaaagucucuggaagauaagaaugcugccauuaacuuggaagccaagaaauaaccaugaaaggaggaaaaggcaaaaaaaaaaaaaaaaaaaaaaaaagacuaacccuggaguuggggcuaacuuaagacaagauaucaaaaguaggcuguggccaggcccaguagcccacaccuauaaucccagaacuuggggaugccaagguggaaggauugcuugagcccaggaguucaagacuagccugagcaacagagcaagaccucaucucuacaaaaaauacaaaacuuagcuggguauggugguguguaccugcggucccaccagcuacuggagaggcugaggcaggaggaucacuugagcccaggagguggaggcugcagugagcugagaucacgccacccaccacugcacucuagccugggcaacagagcaagacucugucugaaaauaauaauaauaauaaaauauacuaaauuaaauuaaacuuuuuaaaguagguugaccauuccuuguggagaaacaaaaccuauccaaauccuauucuuccuacaaagcucaccucaaaucacaccuuuuccauuuuuuuuuuucugaguguccuuaggcauagugaucauuccuucauuaguuauguauaaacaguacauuacgguggaaagaggccuggacuuuaaucaguaagucuaaauucacaucccgguuuuaucaacuauguguccuuagacaaauuucuuaaaucuuugaaucugauuccucaucucuuaacugaaauuuaauaguucucaaucccaaaggacaguugugagaauugaauucuaaaugugucaacaugcuaaacacaaaguacauacucaacaauguuaaagugaauuuuguuccauucauucauuaaacucugacuggauuccuacuguauguuaggcugugugcuagauauugggacaaaggaaacaauuacuaaugauaccacacacaacugccaucuacuaacuucucauguguauagcccucaaauuagaaugagguuagagauuaugccuuguagcucuucauauuucccaaaaguagguggcauaguaccuugaacucaguaguuacaaaaguacuugugaacaauuugauuaaaagauuucuacauacagguuuucacauuugaaucccaaagccaagcaacagcaucaucacuuuuaaagcauagcuaaaagcacacucacuugacagcucacauccauuccugccuccagcagcaccugcacgacugcuuuguggccauugcgcgcagcaaggugaaguggcgugugcuugcgaguguugcagcucauuaaguuaggaugugcacugaugaucauuuuuaccacucuaagccguccguagagugccgccaaguccaaagguguuuccagcuugcuauuucuaauugucgggucagugagcucuucuaggagaacagcaacuacuucugaguguccauauugagcugcacaguguagggcaguuucauuuucauuguucuaagacaaagauuuuuaaaaaggcacauuuucagaaauucaauuuguuaucaaaaucuuaacacaguaauuuaaaaccugcaaugcuuugaaauguaaguuaagauuuauccauuuuaacaaguaugccuaauggaauuuuauauuugauaaaaguaucuaggauucauugaaucaaaaaaaaauuuuuuauaucacuuuaaucgaaaacaauccaacauuucccuaaaucauauaugccaacuuccaaaaaugacaaaugauuuagccauguuugucagaggcccuccuggguccagaaggacagugauaucugcauggugcaucacaucuuuagacauuuauuaauaagagagaucaaaacaauuauaacagacuuuuaauagacuggcuuuccaaaagacagauaagaagguaaauucuugguaacaaaagguuuauagaaagguuucccaaauuaaguuucauuuuauuuuccauguaaguacaaaucauugcuuccuuugcaaagaaaaugaaaagauuuuggccuuaagauauaaaaguaccuuuuugaaauguuaucauggguugugaggauggaccuagaucaguucccagacaaguuacuaggaguaucacaguacaacaugugcagcuuauaaggguucaguugaaaaucaaugagauuuuccuagaaauguaucaagauuuuuaaaaauguuaagauacagaaaacugaacccaguugcaaggcagagggacccuucagacuauuugagcaauauagguagaugguguauagguaugucaggagguggaagggucaggagaaaaaugaacaagaaauuuuaguaacaaaaaugcaauaaccguaaaugaggguucuggaaagaaagagcagcugccaccaucagaguuaucaucauagcuaacacuauguacuagacauaguugcauuuuauauauguuuacucauuuaauccucauuaugagauagauacuauuaucauuaucuccauuuuacagaugagaaaacugaggcacugaauaguugaauaacuggccuuccguuauacagccauuuagugguaggaccgggauuugaacacaaguagccaagacccaaaguggguguucuuaaccaucacacauaccaccuuccaaaauaggaacuauuacuacuacuacuuguugagugccuaaaaacuauauauauugucucauuuaacucuuacaacaauucuccaaaauuuauauuaaaauugucuacuucauggacaaguaaacuaaaauacaaaaagguuaaauuacacauccaaguagaauuaagauauuuugcaagcuggaucugacaaauccaaaacccaugcucuuuccacuauaccauguugucugccauguguugcuauauugucaaagaagagcugggaauuagugaucugaaagcagaauuucuagagguuuugcucagaaaaauaccaaccgagaauagggaguagcuguuuagauagcuguucugaugaaaauaaaaggauaagaaguguucagacccaaacaaaucuuaauguucuagaaaguaacucaaguuugcccuggaugauagaagaaugcaaguaaguugagagucuagagggaagauuugaaaauuuaaaaaggaguagagugacaaggggaaaacagcacuaggaaaggcuucuuacuacuuuaccuugcaaauaaguaucaagagagagcauuugaaggucaaacccacagggaaaaaucuacucuuucaagacaaucaaugaaaaguuaagaccuguuagauggggaauccagcugaggguacuguuucuuccaucauuugucaggaguccuucuuuacuugguuugaaaguauuacuauaaucuacuucuucauaaacaaugaucacauacagguuuagacucccuggucuucuuaucuguuuuucuuaucaggcuuauaaaacagccaaucuuauuacuucacaccaugaaaacauuauacagauauauaccuccugaccaacccaaauuucccccuggucugaaagggauucaaucucaguuuucaaaauacaguaucucuuugagaaaagagaaaggccaguuaugaaauaaugauuccucaaaggccucucuacugguccagagcccugagccuaggaaauuacaagagcaaaaucgaaaaauuuucuaguaacaccaauuagcacuguucagaucucaagggaaaauauaucaaucauucaagaccuacucaggauaaaaaguucacagauuuuauccaugaucaucacauacuuggaucgucaccucaguggacgccacaacggugguacuuuuacgagagcaugauuguguauuuguguaugcucacaagugaucuaaaauaaucuaauuugaaauaaauaggcugugaugaggcacugauuaauaauuccuaguauggcuaugcagaauauucuuaaaaguuuuuuaauuccuucuuuuuuaccaaauggguauucucugaaacauuaggacccuuccagauaauggaugauagaacaaaacuggcuaacaaaagccauuuaccaaaaacucuugguucagaguaaaacaucuaacaagaguuggauucgaguuucggugaauggcaaaggcaauguguuuuucagauaaggccccucuggguuuugcccuaauguuaaaauaaagaaaaaaaaaaagaggaagagaagguaaagggaagaaaggauuaaugaaauuuaaagaaauugaaaauuuucaauuuaaaggaaauuuaaauugcaaaaaggaaauaaucagaugauaaaagagaaggauguggcaauuauaaaaaccauaauccggguagaguccacuuuguuuagaauggugaacaagaccuagguugaaguguuaccauguaaauuacuucaucucuccaaaccuaucuuaucuguauaaugagaauauuauuuucccuauaaaccuuauaauauaguuuauaaaccaaaagagauaacauauuuuuaaaaugcauuguaaacuuuaaauauuaaaauguagaauagaauuauuuuuaaagaaagcuguauuagaaaccaaagauaacuuucagaaaucagaaugaagcccugacuauaaugcauaauuuuaacauaacauaaauguauuacugguugagagcuuaggcuuuggaucagaaaaaccugcguucaaacacuggcugcauuucuuaguagcugugauguuacggucaaucuacucuaucucucuaaggcuguaacuccauauauauaguagcaacaguaaucuagggcuuaguaagauaacggggaugaaguauuuugcacaaugccuggcacacaguaaacaauccauuaagugauaggauuuaggaugacaauaccaaugcgcuguuguguaaaaggcucuggagucaaaguccugagucucagucucaguuucagucacucaguaacacguggccuucgacaaguuguuuaguuuuacagagcaugauuucucaacuauaaaaugcgagugauauuaucaauucagaggauuauugugagaauucauuaaaucguauuuuugaggugaaaguguuuagaacagugcccgcuuuaccuuaugucucaauaaaugcuaauuaccauuuuuauuuccuuuauuguuuaaauacauaaaaguuuauaauuaacaagaagauucuguccuauucagaaggaaaaaagaaagcuaaaauuaaaaguuaucuauaaaaauaaaaauccuacaucaaaaaauuuaggagaaauggcauagaaugggaaaacuaugaucagcaucaaaagaguauacauauaacaaugaaaaaauacuaaaauuaugguauuaaaaaucguaagaaaguugcaacuucuugccaauagaaaccgcaacacaaagcaacagaggugaacaaaggacuuugaauauggucuccuuaaaaagacacuuuuuguaauuuaauugaucuauucaacauuaccaaaaacaaguauuucucuuuaaaacauauagcaacuuuucacuuucaaauguaagugaauacuauauguuauuucuuauuuucaugucauuuaaaaacaucuuguuuguaaaaacuaacauccucuuguuuaaccuuggauuguuuuuccauuuuauuauuucagguuugcuuugcaguauucagacaauuuuaagaauaaccaccagauggcucaucucauaaaugaucuaacuguugguuuucuguggaagagaagagcauugucauaaauuuccuuuuagcaugauaugaugauaaagauagccauaucugucauguuuuaaagacugggugcauucuuauuaaaauuucugcauuuuuguaaccuguaaacauggaaauuuuuauugugauaaauauuaauaagauacuuuuccaauuaauaaaauguuuuccugauuaguccuuucaacaacugcauauauauuuucauugaaaaaauauguauuuuucuucccuuugcuauuuacagcaauuguuacuuuuuauccuucagucugaauuucaaaguccggcaaagucugcauccauuugaacaauaugcuaauugugcuuuauuagauaugcuugcccuaaaguaaccuacuugcauugauauuggacaacugccaaccugcagcuuaaugccgugauuguaauucaauuguuggacugucugcugguuuucaaauauaguuuuacaaaaugggaacaguagggggcaugcagagaucaacauguuuguuaucauacuguauuaggggaccauauuuuacuuucuagaaucugugguccuaucuguuuagaauacugacacugguuuucuuuuuaaaauauguccauuauguguaauauagauauuguguacuuacaaauacauuaacugucagaaucauacugcugcuguguuuuauucaacuuauucugggcauauguguuuguguuuguauauauauauaucaaaaaauuuuaacuuaauaugugacaagcaacuguauaugcuauauuucacauuuugauucacaagaguacuuaaccaugaaagugcuaaguaaaugguaaagcauuaugcaaaugauaggcauaucauuguuuuagcauucaaaauuguauuaagaaacauuguaauucucauuacacauaugaauucuguucuaucuuuaaauauucaauggcuauaaaauggcugauuauauaagacaggcaaaaauauuucagcuacuuccuuuauguaggauuuucccauuaacaaaguaucuuuacaaaugcccaacuuagucccugcauaucauauccaaacaccaaagaauuuuucaaauuucuccuuuuaggaaauucagcaauggaaaggccuuugggcaagguaaagauaaaaaaaucacauuuucaauauggcuuugccuuguaaaacuagaaaaauuacaucaugagcaaacauuuggcaagugcaccuguucauugacccuggaaugugaugguccaugaugaauaagaaucuucacaauuuccacaucuccuuuccaggcagccaggugaauaggaaaauacccuuuguugucugcuacauuuguugaugccucauacugaaguaguuugagaacuaugucccuaaaaaggaaaaaacaacaacaacaaaauaggcugagcaagacaaacuguauuaaauagguaauuuuaaaagaauacuagaugcugggugggaauuuagaguaaucauucaagguacuaagauauaaaguuggguuucaaaguuuuugccuacucaacauuuggcuauuuuacuuaccuggaaaaccaucaccccaugccacacacacacacacacacacacacacacacacacacacacacacacagagagagagagagagagaaagagagcgagagcacacauugacuaaccaauuaaacuacuuaauagaauucauauaagcaaaacuuaacuuauuucauuaauuagaugagcuaaguaaaaugaagaggauaccaacucccauuuuuuuuuuuaaaaaaagagcucuuuccagauagcccauaucugagauuuaguuugaaggaaaaguugaaguuacaaguauauuccuuguuuacacacacacaaaaaguuaucauaauaccaaggaggcauuuauaaaauuuacacaucauuccuacagauaauuggaauaagagauuuaagggguauguaaaagagaaagaaagugcaguauguaagggacccuugacaagcuaacuguaguacuagcccaggguuaaaaaauaauaauaaaaaaauuuuaauaacuucucagugauggcacacaacacacuuugaguauuccuuguuccuacuucuguauuccuucaccuuucuucuccaagcauaaaaaauuauuucaaaagggaaacucauuuaaaagacaaguuccaccauuaaugcaauuucaacacauauucaauauauccuaccucaaaaauuuugaacuuaauccccaccagguuuucaaaguaaaaauccugaccugcauuacucaaccuuagaaagaauuaauuaauaauuauuagcauaaauuauaucaaaauauaugucaacaaucaaaagcaguaauucuaaacaaaacuguauuuucauuuggaugcauuuaagaagcaaauucuauuaacucacuaaaugaaaugcuagucagacacacauaaauaaaaauauauauauaauuacaauauauaauaaaguuguuucuuacauacaacaaaucacuaauggggagggugaacauaacagauuuacauuuaaacauuucauaaaaucagacucuagaugcaaguaacaaaugaaaacauuuggaggaaauuuuaauagaaggaagauuagaauuuugauagcucacaagaaaaacagauaugauaugauacaaaauuaugguaaaugguaaaacauacuguccagaauguguccuaaagucacaacauuugacuuaauugcuaaauguaagaaaucaugauuuuaaaaaaacaagaauauguuguagaaauauuuagaauccaaggaguccuaaauugucuaaugauauaauuucugagaaauuaagaauuaaauuuuaacauuucucuuugaaaaaccagcauuauuuuacgaaaucugaauuuagaagacuuggauuugugucccagcuaugcaaacuaccugaggcugugauuccggagaaaugauaaucacacaccacauaaugauaauucgaucaacaacagaccauccgcauauauaaugguuguucaaaaagauuaucauaccucauuuuuacuguaccuuuucuauguuuugauauguuuagauacauaaauacuuucuguaucuauuguguuaaaauugccuacaguauucaguacaguaacauacugugcaggcauguaacucgggagcaacgggucauaccauguagccuaggugugugacaggcuauaucacuuagauuuguguaagugcacucuaugauguucacacaaugaugaaaucacguaauuagacauuucucagaauguaucccugucauuaagaaacacaugacuguacuuagucucauuuucuuuuucuucaggagauacuauaaugauaaugucuacucaaaacugguaauagcauuaaauaagaucauaaaaaagaauucacucaauaaauaguaaagcacuauaccaauaauagcacuugucccaaguaaaaauaaaauacuuuagaagugaaaugaaaugcuuauagaaagucaccuucgaaaaacagaaucagaaaaucagaaggaaacuuaaagguuauccaguucacacgcuucuccccauuucccugccaagcaaggguuguuauauagggucuuccauucugacauaaauaaauacauaacuucagugagguaaugagaauucaauaccuaugaauaacaaaagcagauaaggaaagaucugaagucccaacucucuacuauuuacaaaccugguuaccuugaggaaauuaaguaaccucugucucucuuucagauauugugaaaauagaauuuagagauuacaucuuggugcuaguuucaaacaguuauggugugaaucaaaugagaaacagauguaauuguaaaauuauauauacaaucaaaaguuguucucaaggcagauuguugcaauguuaaacaauuccagugauugcuuuuuaaauaaaauauuucagcauuuaaaaggcaaaauaauagcaaaagaaguuagucaaauuaaauaccuggaucuaaaauguagaauuuagccuacuacaaaauagacuucuccaaguuacugucaaagacaacugugagaagagaaaaauuucauuucuuaauaccuaaggaaauaaaaaauauauucugaaacaacuucuccuauaaagcauuuccuuucaagggguaaagacgaaaaaaagauugaugggaucaucaauucuauuuccuuuuacucuugcuccaaucacuuagaauuucauuuguucuuuggcucaaauuuuacugacauuuucuaauaauguaagugauauacauucauucuucauuuaucaggaagauuuaugacaagugaaaaaacgucuauuuugaaaacugacuuacuaaucauuuguauuuucuaguauuaccaccaucuaauaucuaaaucagaaaagaauaaucuguaaguuuguaaaauugccuuuggaaaacacuaagauccuaacuacacauuauuuacacauuauuuuuaaguuuugaaaaauguauuuauuuuaauaaauaaauauuuuguuaaaugugcuuauuuuuuucuuuuuuaauuuuauuucaauaguuuuugggacacaggugguuuuugguuccauggauggguaacacuuuagugguaaauucugagauuuuagugcacucaucauccaaguagugcacaauguuuccagcguguuguguuuuauccuucacuccccuccaaaccucccuccaccaguccccacaguccauuauaucacucuguauguuuuggcauccacauagcuuagcucccacuuagaagugagaacgcaugguauuugguuuuccauucccuagucacuucacuuagaauaacggcuuccaguuccauccaaguugccacaaaagacauuauuuccuucuuuuuauggcugaguaguauuccaugguguauauauauaccacauuuuauuuauccacucauuggcacuuagguugguuccauauccuugcaaaugcaaauugugcuacuauacacaugugugcaugugucuuuuucauauaaugacuucuuuuccuucggguagauacccaguagugggacugacggaucuaaugauagaucugcuuuuaguucuuuaaggaaucuccauacuguuuucuauagcaguugugcuaaguuacagucccaccagcagcguaaaaguguucccuuuucaccacauucccaccaacuucuauuguuuucuuuuuuuacuuuuuaauuauggccauucuugcaggaguaaagugguagcucauugugguuuuaauuuuuauuucccugaugauuagugacguugagcacuguuucacauguuuguuggcugucugcauaucuucuuuugagaaaugucuauucauccccuuugccuacuuuuugaugggauuauuuguuuuuuuucuugcuuauuuguuuaaguucuuuguagauucuggauacuagcccuaauuugcaaauauuuucucccacucuguggguugucuguuuacucugcugauuauuucuuuugcugugcagaagcuuuuugguuuaauuaggucccauuuauuuauuuucguuuuuguuuaaaugugcuuauuuuaaaauuaaaauuaaaauuaaaauuuauuuucaaauuuuuguuuaaaucgagcuuuacaucuuauucaaagauaccagcuaaugaauugguugagcucagauuucuaguguuaaaacauauuugugaaauauaaaguuguaucccugaucaaauaaguaucugucaguuuuacuaaguuauaaguagaauaaaguguuaaucagcaaauuaugauuaaucauucuuaugauauauccauauauauccaaaguaauaugaacuaaauaggccauuuucauccaggcucauuagaacaauuuaaauuucauauauaauaucuaaauuagaagagcaguuaauauaguguaguaccaacuuaguauuuuuauugauacauaauaguuguauauauuuuggggaugcauguaauauuuuuauauaugcauacaauguguaaugacuaaaucaggauaauugggguauccauuaccucaaagguuuaucuuuuuuuuguguugggaacaucacaauuccucucuucuagcuauuuugaacuauacaauauugguaacuuuagucagucuacuguacuaucaaacacuagaucuuauuccuucuaacuguauuuuuguauuuuaaucaaaucucuucuccccccccccuuuccuucaaagccuccuauaaauaccaauuaacuuucuacuuccaugagauccccuuuuuuuuagcucccacauaugagugagagcaugugaugucugucuuccugugccuggcucauuucacuuuacaaaaugaucucauguccauccauguugcugcaagugacaggauuucauucuuuuuuaugguugaauaauauucuauuguguauaugugccacauuuacuuuaucuguucacuuguuaauaaguagguugaucccauaucuuagcuauugggaauagugcugcaauaaacuggggaaugcagauaucacuuugauacccugauuuccuuuuuuuuuuuggauauguacccagcaggggcauugugaaaucauauaguaauucuauuuuuaguuuuuuaaggaaccuccauacuugucguccauugucauuguacuaauuuacauucccaucaaugguguaccugcauuccccuuccucugcauccuugccaguagcuauuauauuugucuuuucaguaaaaaucguuuuaacugaggugagaugauacugugauuuugauuugcauuucccugaugauuagugagguuaagcauuuuuucauaugccuguuggucauuuguaagucuucuuucgagaaaugucuauaaucguuugcccauuuuuaaugaaauuauuugguuuuuugcuauuggguuuuuuaguuccuuauauguucuggcuauuaaucuguugcuagauagauagucugcaaauauuuuuuucccauucugucaguuguugaagcugggaaaacuggauaaccauauucagcagaaugaaacuagaccucugugucucaacaaauacaaaaauucagugaaaauggauuaaauauuuacaucuaagaccuaaaacuaugaaacuaguaggggaaaacaccucaggacauuggucuggacaaauaauauuuggguaagaccucaaaaacauaggcaacaaaugcaaaaauagacaaaugggauuacaucaagcuuaaaagcuucuacacaguauuucuuuaaauauuauuuagguugagccuuauagcuuacuuuaagguauccacaaaggaacacaucgccugugcuuggucaacuggcaugaaauauucagucauugauugaugagcauuuggguugguuccacgauuuugcagcugugaauucugcugcuauaaacaugcguguucaaguacauuuacuaauguaaccaaauaucaccuggaccacaauaacuuauugaaaaauuaauguuaaaaaauucauugggacugugaaaaaagaaauauuaaguuacauugcuaaucaauaucuguaaaauagcaagcagcaaaauaaucccuaugucuuaaauguaaaguagcauuuucugauauccagcauuugacaaauaacaaauacucuaaaauccuaaagcaaaugugguugacaagaaaauagaaaaaauauuuuggaaaauggaaauagaaauggaaaaauacuuuccauuucccaaaaacaaaguaaaacaucaaauuaaauuuaauaauauccaauguaaauagcugcaauauuuugcagcuuuaagcuaauacauguaaguucaguuaaaaacaggaauucuagaaguauugacuuuugcugcuauauuuaauucacauccauuuucugaaagauauaaauacacaucugauuaauaaaaaauguauuucgguaaguucagcauaugcucugagcaaaauuaaauaaauugggaagagucaaccuucaaauuucuuugccucaacagcaagauucccuguaauuaaaucacaaccaaagauguuuauuucauaccauccucucuugcuuguugauugaguccaaagaauuucaaaauaaaugcaaaucaucuucauauggaugcagaauuaacaucuaaugaaacucucaaauuuaauaagguccuuuugauuucagauuuucuugacacuuuuacuucucuuuaaugggaauaaaguugcagauguguucaagauggucaaaagauuucaggacaauacgucccauuuucuaacugaaguuucuuuacauguugaauucacucucauagauuucuagauuacagagugaauaaaggcaaauuuuaaguagucuguauccuuauccaggaaaaaaagcaagaugacuaaagauguuucuaguuauucaaagagcaacuucagagaccagauuauacaauuuuuagaggagguaugccucuuuuauuagaaaaccuaagaaagaucaaaucauacagauagcuuauuauauggauucuagauccaauuugauacgcaaucuggauuacagauaaugagaucuagcaugcauuaaauacuuuaaaagguagaagaauagaaaauaucuuauguguauauaaaacaauauacauauuucagaaauacaauaacgaucugcugauauuuuucaaaacagcaugcaagugucacaauauaccaaauauaguuuaauaacauuaaacuuaagaagaaaauaaggaacuauuuguuaaguagagaagaaaaauugaauugaaauaugaguauacagguuuaauauaaccucacagggaaagauaagauuauuacuaaaaauaauggaugaaaagaagagaggagaaaagucagaaagaaggaaaaguaaaggaaaaaggaaugaggggacuaaggaaagcagaggagaacaagaaaaaaagggaugagaagaagugggaggcagggaaggaagguagagaggaaggcagguagucaggccagccaauugcuuuucagaggagaauuaagggauuugaauuugcaguagaaauacaugugacaaugaauccuccauauuuuaaaaagagaaaaagauacaaagaaauagcucucuacucuaucuauggaaauaauuuauaauacuugcaguaaauuuuguuuuauuaaccaugauuuuuuccuaucauuugaugguaauaauuuucuaaucugugauuacaaauaacccaagaaaucaccaguagaguacauuuuccauuguguccugaucuggcuaauugaagaugaauaugaaauaaugcauuucagguacaaaaugcugcuucauuuguggauuaacuagcauugauaaacaauggcucccaaugaaaauguacaaaauuggggaaacugguuuaauuuucaguaugaaggcuuuagauuuuauguuggggguagggggacaguuuguguucaaagcaaaagaauaaacuauaugaucccgaaacauuacugcuggcuuuaugauucuaugaacuuuagccuaccaauuauaauguuuauggaaaaaaucuagagcagauggauacaacaacagcgacaaacauggaaaugauguguuucugugcagacugcuaaggcuugcuugggaagaauacaauauaaucauuguuaguuaccucugcuaagugagaaugcaaauaaaagaaauaaccuucuucucuggcucugagauacagucuaugacauuauuuucucccucaaauaucuuuuaagccaauauuaaaauuagcauuccauguaaacauaugacaaaugauuaugggaggcaggccagaaauauauaaugugacagagaagagccagggagaguuuaacaacaaaggggagauaaugcagaguacugguaaaagcauagacuuagaaccagaacacuuaagcucuagacacaaccccacuuuaauaucuauguggccauuaagucacuuaacuaaaugggcauuguuucuccaucuauaaaaugagggagcugaggggugucagguagaaaaagugaucucuaacuguacaaguucauagauuauuuaaacuugcaaaaucaagaaacauacacucuauaugaaauucccaauuucagaacuguagcaucauagugcauaacugagccauaaauaauaccaacacaguguaucauucaauguuaucauuguaagaaacaauggagaauaucaagccaaucuauucaagcuauugaacugaggccuacagauguuaaguaaaugguucaaggucacacaacuagcagagauggggagaugggguuagaaucuuccugcuuuuuccaaugccuauaggaugacacugaaaauuaaaaagaaaagauaaaugagaucuuucagacaaaagcacagacauauaauucccacagacuaucuguaauuaaagggaucuuuaaaaauagcuaaucaaauuaucuguuugugagaaucuuaaugauugcuauucaauuugcuuaaauuaucuuuauuuucuaaaucaccaaaaaaaaaaaaaauuaugccaugggccauagaaaaacauaucucaacaguuagaacuucauagacugucauguauaaaucagcauuuacuaaauacuucacugaaaaugaaggagggauaugaaugcuaauccauuuugggacaauauuacuuuaagaagugcuuaccuaccaaugccaaucugagaaagaacaagaaaaguaguaugccucaaaugaaaggucaggcccaagauauccugcccauuagauguaauagaguuuaucuucccaauuagaacuaaaaaauaugauaguagccugaauccauaauucagauagccaagaagccaucaggauuauauuacuugggcugauuugucuuuguuccuggugacucagguaaaaaaagaauaacaacauucuccuuuaaaauauuuagauaucuggacauacuuuccauucuauaaaggaagagaaaaaauuagaagauauggcaaaauauuucuaaaugagaugauauaagacaauauagaauaggaacugaauaaaaauaaauacaauuugggaauuccaauucuaaaaaucuaaauaaugaaacaaaguuuauaauaguuuauguaacucaaaugauucucuaaacaggcugauggcauuaaauuuauacauuuuaagagaaaaaugucagugaucaauaaugacaaaaaaaaugucuugcauuaagagcuuuaugaccaccaaaccuaagauuaaguaugaagaagacccuugagucaccauucacagaauaaaagaaauguuaggugaaaaaacaaaagguaacuaccauuucuacuuuuuaaaaaauaauuucaacuuuuauuuuagauucaggggacacaugugcaacuuuuauuuuagauucaggggauauauuguaugaugcugagguuugggauacaauuuaucccaucaccuugauacugaggauaguacccaauaguuuuucaacccucccuacccccucuaguggucuccaguuucuaucauugccaucuuuauguccacaaguagccaguauuaaguucccacuuauaagugagaacaugcaguauuugauuugcuguucuuccauuaauucacuuagaauaauagcuucuagcugcaucuguuguugcaaaggacacaauuucauucuuuucauagcugcauaguauuccauggugcauauguacuacauuuucuuuauccaauccaccacugauuggcacuucaauugauuccaugucuuugcuauugugaauagugcugcaaugagcaugcaggugcuugugucuuuuugauagaacaauuuacuuucuuuuggauuuauacccuguaaugggaaugcuggguagaaugguaguucuguuuuaaguucuuugagaaaucuccaaacugcuuuccacagagacugaacuaauuuuuacauucccaccaacagugaauaagcacucucuucacucuauaaaagaugccaacauuugucauuuuuugacuuuuuaauaauagccauucugacuggugugaaaugguuucucugugguuuugauuugcauuucucugacgauuagugauguugagcauuuuuucauacacuuguuggccacuuguauaucuucuuuuaagaagugucuguucacgucuucugaguacuuuuuaaugggauuauuugguuuuugcuuguugaauucuuuaaauuccuuauagauucugaauauuuggccuuugguagaugcauaguuuaugaauauuuucucccauucuauaguuuguuuauugauaguuucucuugcugugcagaagugcuuuaguuuaaugaaauuaggucccacuugucaauuuuaucuauuuauuuauuuauuuuugagacagucacccaggcuggagugcagucaugagaucucugcucgcugcaaccucugccuccaggguucaagcgauucuccugccucagccuccugaguagcugggauuacaggcacauaucaucgugcccagcuaauuuuuguaauuuuaguagagacaggguuuugccacauuggucaggcuggucucaaacuucuggccucaagcuauccaccugcuucggccucccaaagugcugggauuacaggcaugagccacugcaccuggccucaauguuucuuucuguugcaauugcuuuugaagucucuaucgugaaguauuugcccaguucuauguccagaaugguguuuccaagguuuuccucuaagauucuuauaguuugagaucuuacauuuaaaucuucaaucuaccuugagauaauuuuuguauauggugaaagguuaagguccaguuccagucuucugcauaugguuauccagcuauccuagcacuauuuauugaagagggaguccuuucuccauugcuuauuuguuaucaauuuuguugaauaccagauggcuauagguguauggcuuuauuucuggguucucuaaccuguuuauuggucuaugugucuguuuuuguaccaguaccaugcuguuuuaguuaauacuguagccuuauggaauaguuugaaaucugcuaucaugaugccucuggcuuugcucuuuuugcuuaggauugcuuuggcuauuugagcucuuuuuuuaaauucaaaaugaauuuuagaauaguuuuuuccuaguucugugaaaaaugacauuaguaauuugauaggaauaguacggaaucuguagauuguaacuagcacuuuuaaagcaguaauuaccacaucuaaaagacuaaagugagggccaggcgugguagcucacaaucggcacuuugggaggccaaggcgggcagaucacgaggucaggaguugaagaccagccugaucaacauggugaaaccccgucucuacuaaaaauacaaaaauuggccaggcgugguggugggcaucuguaauccuagcuacucaggaggcagaggcaggagaauaacuugaauccaggaggcggagguugcagugagccacgauugugccacugcacuccagccugggcgaaggagugagacucugucucaaaaaaaaaaaaaaagugaaaugaaaugauacagaucugggaaaacuaacuuggaucauucacacaaagggaaaacagagacgagggggagauaaaggaagagggucauuuuuuuucuguaggggaggacagaacaucugaaucauuuggaggacucaucacacuuuaacucugucacuaaaccauuaggauaccuagcuaaaauacuggaaauagagauuguuacggcuacacacucuugcacucuccauaacauauacuauuacauuauuugaaacaguuuuacuuauuaaaaaaauuuaggguuggcaaaucuaaaacuagaaagacaaucaugaaugacaaagauaaaacauuuuagcuaaauaaggauucugaagugguucauauaagugaccagggcucagaauagugggagucaugcuaaguuuacacuccuaguaaacacuccuauguugggugaauacaaggagacaccaaaaaagguaaagggguguuaucaagugguuuuaucccauucucucccccaaagauacacaugacuagcaugguccugucaauuuuuccauucucccagugugauagguugaguauuuuagagcauuucuuucagcuuacacucugcacgcaauuauacucagcaacauuccuaccaagucuaacuugucaguguugucaccuggucccuuuccaaauucaccuaagcccauuggacucacagagacaugagaaagguaucgucaagacauaauuaacuucaucacauguaacuaaauacacacgauuccguccaaauaaguggcacuuacuuauguccauuuaaggcugcgugguguaaagcaguguaacccgaacugucugugcaguucacauuggggccucgccagaugcugcaaauaaagcacaagcgcagaguuaacagugaagccagaucuugccuugaaaaacaaaaagaaggcugguagccccacagucagcagcagguuguagauaaaaauuuuagccauguggaaaaugauugccaucuucuaugaauuccccucagaacaucaacuucauuuauuugauaaaaggaaacuaauagagaaugcaacuauuaauaucuucagaaauuauuaacaaauguguguccauggucgugcacugaaguuuggauccaaaaauucccuauuacuuucuaucguuacuuaaauauuagaagcaacuaacauucagcuacuauauuccauaccaaagaauaaagauuuaugagaccugccucaugccuguuaacacacuccuucugaggugccggugauuuauauaaguuauaagauauuuuugcauugugggaagaauauaaagucuuuuugcucuucaauugcaaccaggaaaauguaaucaauauuucauacuugaaaauaaaauugaagauuuggacuguuguaaaccaugagaagauccuaacaauuuugcagucaucauugauuuuacuaugcaauauauucuggagauaacauguaacuauauaaaagagucuauuuuuuuuuugauaacuacaauuaaggaaacucuuuuuaacuuuuggaaaauaaggcacugaaagacacuuuuccaaaaauagaacaaaaaauugcuuuaucugauggucauagugauaucaaaacuaucaaagauaaacuaguucacacauucacaaaacauuuauuguacaccaacuguaugucacauauugagcuaggcacugggagcacaaaaucguaacucaagguccuucuuuacaagaacauaguguaauggaaaagauagacacacaagcuaauaauuacaaagugguaagauaaucaagguaccagacagcacacaggcaucucugaaaagagaaugaauagcuauuccaaacaaggggucauggcagacuuaaacuaaggugggucaaugaaaaugaauggaaugugcuuauuugacaguuaauuaaaagaagaauuaaugaaacacauggaucaauuggaagaaggugggaaacuggaagcaguagucuagagaugacucagacuuuaggcuuacaugacuagaaaaaauuacaauauuaacuaagaugugaaauaaaaaaagagcaaaaucugcugcagggaagacaaugcaggauggagagaaaacaaugacuccuaguuugcagacguuaaaucuuaagucucugacuuacuuacauuacauagguucaaugcaaucccuaucaaaaucccaauggcauucuuuaggaaauugaaaaaaaauucuaaaauucauaugaaaccauaaaagaccccaaauagccaaaacaauucugagaaagaaaaucaaaguuguaugccaggcucagugacucaugccuguaaucccagcacuuugggaggcugaggagggagguucacuuaagcucacuaguuugagaccagccuuggcaacauaacaagacuccaugucugcuaaaaauaaagaauaaaaaaaauuagucaggugcgguggugcacacuuguggucccagcuacccaggaggcugagguagaaggguugcuucagccugggaggucgaggcugcagugaaccauaaucaugccacugcacuccagccugggcaacagagcaagacccugccacccccacaacaaaaaaaagaaagaaagaaaaauggaggcaucacacauccagauuccaaauucaggggauauauauacauacaauaaaauauuauucagcccuaaaaaagaauuauaucuaaacauuuucuaugacaugaaugacccgggaagacauuaugcuaagugaaauaagccagacacaaaaagaaaaauauugccugaaaauauacggaaucugaaaaaaaaucaaauauacagagauagagaacaaaagauugguagggggaguagaacgggggaaauaaauaucagaggauacaaaguagcaaauauguaggaugaacaaguguagaggucuaaaguacaacaugaagacuacagguaccaaaauugcacuguauacgggauuucagcuacgugaguagauuuuagcugcucuugccacaaaaacaaaaaauaaaggguaacucugugagagguggucauuuguuucacuguaguaaacuuuuuuuuacuaucuauauguaucccauaacauguguauaccacaaauauacacaauaaaauuuauuuuuuuaaauaccacaaugacaugcuacuauauaacuaucagaauuguuaucuuuaaaaaggcuucacaaaccuauauugacaaggauguagaucaaccagaauucacacacacacugcuaauaggcaugcaaaauaguacaaccacuuagugaaacaauuuggcaguuucuuaaaaaguuauauacaaauaccacacauaacuuaccaucaaaucauaccauacaaauaacauacaaauaccauauaauccagucauuccacuguagguauuuagcccagagaaaugaaagcauauguccauaaaaagacuuguacauauaauauuaauaacagcucuauagguaauagccuaaaacagagacaacccaaauguccauuagcugguaaacagauaaauugugauauauccauacaauggaaauaaaaagaauuaaauacucagaaacaaaaggaauuaaauacuacgacauugguugaaaaucuaaaucaauuagauuuucucaggaagaacagcagaauggcugcccuucaaucuccccagcagaaagggagacauucucuggcacagauaaaaugcaugaucucuggacuagaccccugauugguagccuucaucaacuucugugauguaaauacuucaacuuaacgcagugauaggaagagaugcuaacaacugcacuucacaagcagacacaagccaauccagcacaccauucaaaggccuacaaccaacaagucccaacacuaugaacucagagcuucccaugaguuuuugaaaaccuccacucucaaauaugaacaaauaaccaaagacauccaaucacuugaggaaagccuuuacuacuaaagaaaccaaaacaaaaaauuaggaacaaacuacagaaaaaaaagaaacuuagagaaaauuuagacuaugcauggagaagaaauuuucaaaaacaguuaucauuaauaucaucucaauauuagaaaagauaaugaauguaagaacaaugaaauaaaaaagaaaaucagagauaaaaucaguagaagaauuaaaaauaaagcugauaaggccaggcauggugguucucgccuguaaucccagcacuuugaaaggcugaagugggcagauuaccuggucaacauagugaaacuccaucucuaccaaaaauacaaaaauuagccaggugugguggcgcacgccuguagucccagcuacuugggagggugaggcaggagaaucgacugaacccaggaggcggaaguugaagugagucaagaucgcaccacugcacugcaaccugggugacagaaugagacucugucucaaaaauaaaaaguaaaaaauaaagcucaugaaguaucucagauacuuagaaaaaaaaggcaaagauauagacaaauagaagggaaaucauaagaaaaguaggacaccgauuuagcaguuccaauauugaaaaauagagguucuuaaagucaaaacacagaaaacaggagaaugaaaacaaugaaagacaucauuuuaaaaauuaucagaacugaaggacauuaauuuaccaaauaaaauguacaugggccagucgcgguggcucacgccuguaaucccagcacuuuaggagaccaaaguggguggauuacccgagugaggucaggaguuugagacaagccuggccgacaaggugaagccuugucucuacuaaaaauacaauaauuaggccgggcgcgguggcucacaccuguaaucucagcacuuugggaggcugaguagggcggaucaugaggucaggagaucgagaccauccuggcuaacauggugaaacccugucucuacuaaaaauacaaaaaaauuagccaggcaugguagcgggugccuguagucccagcuacucgggaggcugaggcaggagaauggugugaaccugggaggcggagcuugcaguaagccgagaucgcaccacugcacuccagacugggcgagagcgagacuccgucucaaaaacaaacaaacaaacaaaaaauacaauaauuagccaagcgugguggugcaugccuguagucccaacuacucaggaggcugaggcaggagaaaugcuugaaccugggaggcagagguugcagugaggcgagaucacgccagugcacuccagccugggcgacagagugagauucggucucaaaaaacaaaaacaaaaacaaaaaaggaccaggauagcuuugauaaaaaauaaaaauaaaaaaaagacaaagaaauaacugaagugaguccgauacggucuuuuaaauuucaauuaaacaaacaaaccaaauuccuaaaacacccauccagggcuauucucuuaauuuaaauuuuuccucuuucaacucuaguuacacuaacaagucuucacuauucaggaaaccuagaaugaagagaaauuauucauaccuauuacuucuacuucaaucugcaaucuucaauuauuaauggacacucuccaaguucuaaguccaagaaaauacaaguccaagaaucaaacaaaauaaugaauaagauaucaucucuuccuccaaagagcugacaaucuaauagagaaaaauauauacagauaaauuacaauauaggcagugaccauaguuccuacagcacagaaaacaccuaauaauuguuuguuaucaaucuucuuguucuuauuaaauaaaugcuacaauagaaaaaucuuuaacucccuaaauuaauacaucuguucaacaaaaaucucuauggaauauuuuacggaaaacucaacuaaaaguucuaaauuugauuuagaagaauuuacgggaaaaaaaauugugaaacaagaaguaauaaugggaucuacauacuaccaauuaugaaagcauaucauaaaacaauaccaaaaaauguuagucuagcaccagaauagagagcucaaugaauauaagagaagcccuagaaacaaaccagucauacauauaggaauaaagcugacaucugaaagaagcaaaaaaaaaaaaaaaggaaaacaucauucaauaaauagucccgagaaauauguuuuaauuaaugggaaggaaaaaacaauuucaauucccuaccccauaccauuuagcaaaauuuaauccacaugauuuguucuugacuucucaaaccucauuccuacccucuuuuucucacacacccuguucaaaccacacaggccuccuuaaaaauauaaguaugcuugcaccuuaugacuguugcauuugaaauucucucugccuagaaaguuuuuuccucaaucauauggcucaaucuuucugcucaaaugucaucucuucggaaacucucucccuaauuauucagucaaaaauagcacccuaucaucauucucuuuccucuuaguuaugggacuuaucaccaucuggcauuauauuauuuauuuauaugcuuacugucugucuccccacuagaaugaaagcuccaccacacuaucuuugggucuuaaaacagugacuggaauauuguaggugaccaguaaauauuuguuaaaugaaauauaaaaauguugaguacauauaugaaaaaugucaaccucacuggcaaucaaagaaagcaaaaaaaaaaaaaaccaaacccauaccauuauauauuucuuuaucaaauugggaaaaaagucaauaauauucaguaaugguuagcaugcagagcuuauaauaagcugguggugaaaauguaaauugguacaauuuuucuggaaggcaauuugacauuacauguuuaaaagcuuucauagugugcaaauguguuaccuagaaauucuccuuaagaggaauuauuuuaagaaauuaauuaauaguuuguacaaauauuuagcuauaaaaauauuuaucacagagugaggguaguaaaaauuauggauuuugauauauaaugccacuuagaauaguuauucucucuuugcucuugucagcuagauuucuaacacugccugccuccagagcuuaguacucaucuuucucucuagcuuucuuauaugagacccacagcaucagugucuuauauggcuccaguagcauauggcuugagcuccuacugaucaggguuuuuuuuuuuuagcuuaugugaaccucccugggaggagaaagucuaccaacagaguagccagggauccuagagaggacgcaauucuucuuaguuuuauacaauggcucaauauaugugacagauaaacagauaucacuauucuuuaacauaaaauaaaaaucucacaacaaaauggaaaaacaggauauuaacaggcaauucacagaaaaggaaaugugaauggcuaauaaauauuugaaaauauaauuaaccucacuguggcuagcaaagagcaaaauaaaacaguggcugccuacuuuucuaccaucagaugggcacaaauuuuuaaagaaauaauugauaacaaucaauggaggcaaauaugugaagaaauagucacucucacagaauauucauugaaguguaaauugcuacaacauucuuggaaaguaacauggcaauacauaaucaaauuucaaauaugaauacucuuagacccaacaacuccacuuuucaggauugauaucuaugaaauaaaaauauucauaugaagacugcagacacaaaaauauacacuguagaauuuuaauaguauaaaagagaaagggucuggaaugguggcucaugccuauuaucucagcacuuuggguggcugaggcgggcggaucaccugaggucaggagaucgagaccagccuguccaacauggugaaacucugugucuacuaaaaauaccaaaaauuagccagggguagcggcgggugcuuguaaucccagcacuuugggaggccggggcagguggauuacuugaggucaggaguucgaaaccagccuggccaacauggcaaaaaaaacacuuuacucaaaauacaaaaauuagccaggcaugguggugcaugccuguaaucccagcuacucaggaggcugaggcacaagaaucacuugaacccaggaggcagagguugcagugagccgagaucaggccacuguacuccagccuggaugacagagagagacuccaucuuuaaaaaaaaaagagagagagagagagagaaagcucauaaaugcccagcaaaaaaaaaauaaaaaauuaauuaguccaauagcugagaauggggcaaaaaaggaaaaguuaauuaggauucauucacacuaugaaauguuaugcaacuauuaaaauaaauaacuuugaucugaauguauugacuuugaaagucagccaaaacauauaaagugaaaaacguaaauugcagaauauugugugugucuggagcauuccaaaugcuuuauaugcauuagcuuauuuauagccacacgacuauaagaaaguuacuauuacuauucccauuguauagaugaaaaauauuugcaauaacauagaaaaauacaugcaaaaauacauuauucauucugugaauagucugaauguugaaauuaucaugaauuucuuuaaggaaaagaaaagacaauaaacuacaaaggaagaaagauagguuugcuccagauuacgaagaaccucauaauauauugaaaagcuuggauuuuauucugcagcaacuuggaacuaaauggcuuucagaaagauaaguauguuccucacaugaucagucaguguuuuagaauaagagcucuuguaacagguggaagguaaacagagugagagucagguuaauuguuuuacagaccaggggagaaacaaagcaauuugaacaaaugcagauauagugguagagagagagagggugagaaaauucaaauugauaugucuaaaauaaaaccuaugggagaugguauccauaugaauagaauaagaacaagagaauggcugagguuucaaccaugaacgaaaugcaucaaugaugagauaucuccacuagaaaaagcugcaagggcaguaguaucuucuggcaggagccaaguuucaguuaaaacugauuagaacacuagguugcuuggaguaccucaggcaaaaaauggaaaagaaauaggaaaauacugcaaauuaacugucauacauuuuuuaaauuucugcauguuauuagaccuuacaaauauuuuguaagagaagauauuuauaacuaaaauaagauucagggccuauagauuucaauuaccuauaccaacucaguuccccauuauacaaaaauuaauuauaauacacacauuuuuaauaacuccauugaaugucgccuucuccuagcaaaauggauauggauacaucuuuuuuaaacaaggagguuuagaauggaaaguuagcauauaucuaaauauauucaacugcaccuauugacagagccucuaggcacauauccacauauccauagaacauccaccgacacaucugaaacaccauaaauaagccagacccaaacccuccaacuaaaaauuuaauuuaaaaaagaaaccuugauuucuaaaagguucugcuucauuccaacuuuuuauauugccuugcccccuuuacucaggcauaaucuucaaauuuagaaagagggccuagauuaaaaacuugauuaacuuaagcuuguuucauaaaaugcaagaguuucuagacacauuuaagaaaugucuugaaaaaguauaaaaugcuuauuacauauuuauuccaaaaaaagcaauuuauagauccuuggucuuagucuaauacacacccaaaucccauuucuuaugccuacuugucaauaucuuaaauucuguaugugagaauuacugcccaaaaugaauguucucagacaauaugggguugccaauuaccaaaaauuuaauuuccuuuguuauauuauuugcacuaauguaacaaaucagauuaguagauuuuagaauaaauauaaacaaaauaguuuucuaccaaacuuucaaauaaccaggacauucauuagucagaauauucuauuaucuaagcuuucacauauuaaauaagauuauucuuaaaccauaagccugaguuucuuaggccaauauccauauguacagcaaauaagauuugaagcacaacuacuccacaaauugaucauuauuauaccuuccaucagucuauggggaaaaucuaucagaaauaacauaaaacuguuucaguuuuuauugauuccuaucugaccccugacacaugagaucacgccgaggcaucagauauggaaauucauacagaaugugcauuuaaugccucaggcagggucagaguauguaggaauggucuucugacagaucauaucauuucaagcaaugcaaaauaaaccuuauucucaaucugugucuuaauaguuuacuuccauuuuuggaugaacuggacauauguacauaugcuacugauuacuacaagugaaguucucaucaguuuagugauggcacaauuuuauuaucaugggcuacaagugucccacaugggucaaaugggucuauaucagcacuguccuuuagaaauacaaggugaggacugggcaugguggcucacaccuguaaucgcagcacuuuuggaggccaagacagguggaucacuugagcccaggaguuugagaucagccugggcaacaaggugaaaccccaucucuacaaaaaaaaaaaaaaaaaaacacaaaaagaaaaauuagccaggcaugguggcaugcaucuguagucccagcuauucgggaagcugaggugaggauugcuugagccuaggagguggagguugcagugagcugacacugugccacugcacuccagccuggacaacagagcaagacccagucucaaaaaauaaaaagaaaaaaauauauaaugugagccauauaugugaauuuaaauuuucuaguagccacauuaaaaagaugugaaauuaguuugaauauauuuuauuuaaccuaguauaucaaaaacauuauuucaacauauaaucaauauaaaaaguauugagauguuucacauucuuuuuuguacuguuuucaauauugguguuuauuuuacacuuauagcacaucacaauuaggacuagccacauuucaaaugcuuaauauccugauguggacaguggcuacuauauugcacagcacagggcauuucuauauaauuauuccaaggggaaaaaagaaaauuaacucuaauaauaugaaaaagcuuucuaguauaaggaagaguagcuaacggaugcuggacuuaauaccuagaagauggguugaucuguguuacaaaccaccauagcacacguuuaccuauguaacaaaacugcacauccugcacauguaucccagaacuuaaaauauuaauaaaaguugaugaaaaauaaauaauaaaaaaguauugucacauuggaacccacauacuaucccauaugaguuuauugaaugaauauuuacugaaaugugcaaaaccaucuaaguaagauagauauacacuauaaagcuuaaaaaugcagagaacaacuaugaacuggccuucugugaagaaugagaacaagaaucagcaaacuguagaccaugagccacauccaguccacuguuuguuuuuguaaauaaaguuucaucgaaacacauacagacacauacacacacacacgcacaaaagcuuucuaaaaauaacugcaaacguuggcuuuguaguaaauacaugucuauuugagucacaaacaauuucuuaaagauaucuugccuuuggagcaaaaauaaauaauagaucuaguauacagucauauccuagacuguaaugcacaauuuuacaaaaagcacaucaggagcaucauagucaaaaucguacuaacuaaacauuuucugaugaauaaugugcaccuugaauuacuugaugcaauucucaauacauguauuuuuaccagcaaaugcgaauugaaugacuaugagcaaaaguaacuccuugaguuauaaucacacauauaauacaauuaugaccucucuucaauauauacaguaugugccacaagauggaauuuuagaauaugaaaagaauuuguaaccacaccgagccauaaacacagagucaagagacaugagaggaaaacuagagcaucuauuuuaaccuaguuuuaacuucaucacuuguucuaaaaguguaaaacauuccucccagcccauauuuucucuucucugcauagauauaauuccuggaaaauaaaccagcagacaaggcagauuaaucucucauugucacacgaacacugauuuugguggcaauuguuuuuccuauccucacauucucuucauagguaacaauaauuccaggguacuaugguaggaaaaaauaaugguacccccaagauguauacgucuuaaucucuggaacgugugcauauuuuguauuacacagcaagggagaauuaagguugcagauagacuuacauugcuaaucagcuggcuuuaucccggauuacccaggugggccccauguaauuacaaguggagaagagggaaauggaagagucagaaucaaaaagacggcacagucaaaaagacucaacuggccauuguuggcucuaaagauggaagagggucaugaaccuagaaacguaagcagccucuaguagcuggaaaaggcaagaaaacagauuuuccuagagccuucaggaaagaaugcagcccugcccacaccuugauuuuagcccagugagaaccacagaccuccaggacuauaggauaacagauuuguguuauucuaagccacuacauuugugguaacuugcuacagcagcaaugggaaacuaauacaggugugcuuauuguaauuaacacacccgaaauaugagacguucagaccuuuccaaauacuugggaauuuaagguagcaugagaaagagagcaugaacaaaacauugacugcggacuugcuacauacuagaaacuaugcaaaaugcuuuguauugauuaccuaaguuaaucuucauaacaaccaugugagacgggggcuuuuauaaccccuggauuuuuaaaugaagaacugaagagcagaaaaguaauuuaucaaagaucacacagcuaguucacauugcaggcaagauuuggaaccaggcugccugauuccagagccaaugacauuaaccacuacauuauacuucagucucauuguuuuuauuuaccuuugauuauaauaaaguggagacauuuuuacuuguauaaauauaagggguccaagugcaguuuuguuacagggauacauugcauaguggugaauucugggcuuuuaguguaaucaucacccaaauaauuacauuguaccuuuuaaguaacuuuuaaucccucaccgcccaaccccaacccucccaccuuuccuagccuccaaugucuaucauuccauccucuauguccauguguacauauuauuuagcucccauuuauaagugagaacaugugguauuugacuuucuaaguucuuucacuuaagauaauggccuccagcuccauccaaguugccaaagacauuauuucauucucuuuuacagcuguauaguaucccauuguguaugugcauaucacauuuucuucauccaaucaucuguugauggacacuuagauugauuccauaucuuugcuauugucaauagugcaauaaacauacaagugcaaguaucuuuuugcuacaauuauuuauuuucauuuggauagauacccagucgugggauuccuggauuaaaugguaauucuuugagauauuuccaugaaguuuuccaaagagguuauacuaacuuauauucccaccaaugguguauaagcauuccuagaccuuuuauguuucaugaccaauuucauuuuuucuaugaguagcuuguuuauauucuuugcccaguuuuuguauugaguuuuucauuauuuuuacugauuuucaucauucuuacugauuugaagaagccauuuuauauuuauagauauuaacccuuucuaauguugaaaauauuucccuuauuucaucuuucagccgaacuuaugguguacuuugccuggccauaauguuuacuaaaucauucuaucuuucuuuaaauuuauuguuucuagccuugguaccauugaaagaaaggucuuccugauuacaagaugauaacaauauucucuaguauuucuuccuauuucuuuuuuugaugaaauuuuuuaauuucucucuauuauggguauaugauaugagguauuucccaauggaauaaacuaauucaauaccacuuuaaaauaauuaauugccaucuaauuaccccagugaaaugcuuccuuucucauauauuauuuuucuguaccuguauuucaaaucuguauuuugacuguuuuguuacauucaucuaucuucuccaaagacuaauauuacauuauuuaauuucuauagcuuuauagcauauuuuaauagcuaaaaauagaucucuucugauauauauauucuuaacuguuuuuaucauggguuuauucaucuguauaauagaugguauagucagaccaggcacaguagcaugugccuauagucccaguuccucagggggcugaggcaggaggaucacuugagcguaggaguuucaguccagccugggcaauacagcaauaccucaucuuuaaaauaaaaaauaauaaguauagucaaauugucaaauuuaaaaaaaaguuuuggcuguaauugcauuaaacuuauagaaaaaguaggaagaaaugagaucuuugcaauucuguauuuuuccagcugaaucugauuuccaucucuacagcuuugguaacagucuuaggcaagguacuucacuucauuagaccugaguuuccccauagguaaaacccaaggauaaucacaguaauaaccucacuguauugugagaagauuaaagaaaaaauauaaguauuaaauauacuacgcaauccacagaagguacuuauuaaauguuauuuaauuggucuaaccuuuuuauauuuucuuuauagaacucuuaaaaauauuuuaaaauuauuuucuuuaacauacuuacauagugaauacuaugugccagauaucauucuaaauguuuucuaaauauuaacucaauaaauccucauagcaacgcuaucaaaugaguacuauaauuacuacacuuuucagauuaaauaacuaagguacagaguagugaaguaccuugguucaggucacauggccccuaccaggugaagcagggauucaaaccacagcaugccuuuaaucauuaucuauugccuuguuauuuuaauuccuaaguaauuuaguucuuuauuacuauuccacaugaagucuuauuuuucaugucuuuuaauuacugcugcuaguuagaacacuguguuuuucaaauucauucacucauucaaaaaauagcuauugaguauccacuauauacaggcacuguucucauuguucuagucacugacaacacagcaguuggagaaggcuguacagaaaaaagacaaaaauuccugcccucauggucuuuacauucugauuuaguuagacaaacaauauacaaaugaauauauaaauauaugaagcaagaagugguaucaagaaaggcaagaggaacagagugcuguuuuaugcagcauagucgaggaagccucugggauaauagggcaacuuuggaagaacauuuuaggaagaaaugggcuuaaugcugaggaacagccaggacagcaguguggcuggaauaggguaagcaaggaagagagcacagaaaagugggucagagauguguggcuggaucauauagagccuuguggccauucugacuuuggccuugacugauauggaaagccaucggagaguuuugaauggagaaaugacaugaucugacuuguauucugcugcucugcuaagaauagucugaaggggaaaggguagaagcaaggagaucaguuaggaaauuacuauaguaaugcaggaaaagaugaugacggcuuagagcaaagggguagcaucauguagagggaaaaaaugcuuggauuaugcauuuaaagguaaaggaaacagaauuugcugacaaauugugacgugcaaagaaaagaaacaggaaggacugcgagauuucugucaugagcaacuagaaaauuggaauugccauuuauuaauuuggauaaguuugcagaagagguucucuauuauuuuuagguauaauaaucauguaucucuuccuuuauaauauucauuccauuuuuucuccuuacacaaacugcauuggcuagaaccacuaaaauaauaagaagauaaucuuugucuuguugaugaauuuaacggcaugccugguagggcaccaccauuuaguaugaugcuugcuacuggauucucauggauaccuuuucagcauauuaaggaaacuuuuauucccucaguaaagaacaaaaagguggaauagcauaauggauaaaagcacggacucaggauucaaacugucuggacuaaaaugcugauccccucccuaacugcaccaccuugggaaaauuaccuaacuacuccgugccucaguucucucaucuauaaaaugaauauaccaguaauagcuagcucauaggguuacuguaaagauuaaauuagauguaaagugcuagcacaaugccugacacauaauaaucauccuuucuguaggaaaaguuuuuaucuagaauggcucuugugguuuguuaaauuuauuuaggauaucuuucacgauggucauacagcuuuucccuuuuaauacauuaacauauuuaaugucggaugagaagcaucucuacacuacuggaaguaaauuuaucuacuuaugguguauuuuuuuaauauaauccugaauuugauuugcucuuuguaacaggauuuugcauucacauucacauguaaauugucucugguuuucuugucuuuuuuauuucaguuuuggaagcagguuacauaaacugaagaguuuggggccuuuuuucuaguuuccagaauaauucaaccaacauagaaauugauuauguuaauugaauauuugaaagagcaaauguaaaaucaucuaggauuggcacuuuuguggaguaaacccuuaauaaaauuccagugucuucuaugguuacugacuuacuaauauagucgacuuuuucuuacauuaauucugucauuuacauuucucuaggaaauaaguucuuuccauuuaggcuuucuaauuuauugacuagaaaucauacauauuuuuaaaucgguuguuauuguccauauuuacaguucuaucaccauuguaauucccaguguucuguauuauuuuucucuccuugguuagucuagguggggcuaguuuaucagcauauucagagauuuaguuagcuuuauuuuuaucaaaugucuauuggauauguuauuuauucauuguuuauuuacuuuuuaauuaacuacucucuguucuuaacuauaagaauucaguuaccuauuucacauuugaguugaaugcuucacucauuuaauuuuauucuuucuuauucaaagguaaaagcauuauaggcugugacauuucuacggagguuuugcccacaugacuuagguuuugacgaguuauuuuucauuucaauuauuauauacacagccuguaauucaguuuuuguguccuuuuuacucugaaaauuauaguuguuuuuuaaauuuaucaaugcuuagaaucauuauaugucuugcucuauuucuaguguuaccacauuauagucagaaaagaauucuucaacuucuaauaauuuauuuagaauuuuuuugaaaacuaguauguaguuuuuguuauguuacaugugacaaaaguucuuugauuaaccaaauuuuagcuggccuccuaaaacuucuccuaggcccaucuguguacuuccuuguaaaauagcaagagcucugcucagucaguuuagcaagaaccuccacccuugagaucuuaucagauuccucauccuccaccaucccucaggugauaccuggucaccauggccugucuucagcuagacuuuucgaaguugguuuagccaaaaacccucuuacccauguuuccucuugguaauuuuccauccacugaccccugcccuguuccccggcuaugaauuuccacuugcccaugcuauauuuggcacugaccccaaucucucucccccacugcaaaaucccauugcaguggucccuauaccugugauaguccugaauauugucuuccuuaccuugcuuuaacaagcaucauugaauaauuuuuguuaaugcaugagcauugaaaaguauauucuauuuuuuagggagagauguguacuuuucaagcuuauuaauugcauaauucaaaccaucaauaacuauuuaguucgucuacuucauucgcaaauuuuuggaaauguuaccauacacaguauaucacugugauugaauuauuaccaaauuuucuuuguauuucuaaguuugcuucauguguuuuguugcuguaguuucuucaguuuguuuguuuguauuaaggcuuuuuuccaacuuuuagguucaaggguagauaugcauaacgugcaggcuuguuacacagggaaauguguuccuacaucauuucugucauuuauguuuuucuaggagauaaguuauuuccauuuagguuuucuaauuuguugacuagaaaucacacauauuuuuaaaucuguuguuaucuucuauauuuacagcucuauuaccauuguaauuccuaauguucuguauuauuuuucucuccuugguuagccuagguggggcuagcugcacagaucaucccaucaccuggcuauuaagcccagcauccauuagcuauucuucuugaugcucucccuccucucacccccaacccuccaacaggcccuguaugugcuguccacuccguguguccauggguucucaucauuugccucccacuuauaagugagaacaugugguauuugauuuucuauuccugcauuaguuugcugaggauaauggcuuccagauccauccaugucccugcaaaggacaugauuuuuuuccuuuuuauggcugcauaguauuccacaguguauauguaccauauuuucuuuaucuagucuaucauugaugggcauuuagguugauuccaugucuuuguuuugugaaugaugcugcaaugaacauacaugugcauguaucuuuauaacagaauaauauauauuccuuuagguauauacccaguaauaggauugcuggguugaaugguauuucugucucuaggucuuugagaaaucgccacacugucuuccacaauguugaacuaauuuacacccccaccagcaguguaaaagcauuccuuuuucuccacaaccucgcaucuguuguuuuuuaacuuuuuaauaacagucauucuuacuggugugagaugguaucucaugucguuuagauuugcauuucucuaaugauaggugauguugagcuuuuuaaaaguuucuuggccacauguaugucuuauuuugaaaagugucuguucauguccuuugcccacuucuuaaugggguuguuuuuuucuuguaaauuuguuuuaaguuccuuuuagaugcuggauauuagguguuugucagagaguagauugcaagaauuuucucccauuuugaagguugucuguucacucugaugauaguuucuuuugcugugcagaagcuguuuaacucgauccuauuugucaauuuuugcuuuuguggcuauugcuuuuggaauuuucaucaugaagucuuuguccaugccuauguccugaaugauauugccuagguuuucuuccaggguuuuucuaguuuuaggcucuacauuuaagucuuuaauauaucuugaguugauuuuuguauaaaguauaaggaagggguccaguuucaauuuucugcauauagcuagccaguucucccagcaccauuuauuaaauagggaauccuucccccauugcuuuugucaagucugucaaagaccagaugguuguagguguaugauguuauuucuggguucucuauucuguuccauuggccugugugucuguuuugguaccaguaccaugcuguuuugguuacuauagucuuauaguacaguuugaugucagguagcaugaugccuccagcuuuguucuuuuugcuuaggauucucuuugcuauuugggcucuuuuuugguuccuugugaauuuuaaaauaguuuuuucuaauucuaugaagaaugucaaugguaguuuaauaggaauggcauugaaucuauaaacugcuuugggcaguauggccauuuucauauuaauucuuccuuuccaugagcaugaaauguuuuuccauuuguuugugucaucucugguuucuuugagcagggguuuguaguucuuuuuaaagagguccuucacuucccuuguuagcuguauuccuagguauuuuauucuuuuuguggcaauugugaaugugaguucauucauaauuuggcucucggcuugccucuuauugcuguauaggaaugcuaacuauuuuugcacaaugauuuugcauccugagacugcugaaguuacuuaucagcuuaagaagcuuuugggcugagaugugggguuuucuacauauaggaucacguuaucugcaaacaaagauagauugacuuccucucuuccuauuugaauaccuuuauuucuuucuuuugccggauugcccuggccagaacuuccaauacuugaauaggaguggugagagagagcaucuuugucuugugcugguuuccaaggggaauucuuccagcuuuugcucacucaguauaauauuggcuguggguuugucuuauauggcucuuauuauuuugagguauguucuuucaauaccuaguuuacugagaguuuguaauaugaagggaugcugaauuuuagcaaaggccuuuucuacaucuauugagauaaucaugugguuucuuuacuucugauuauguaaugacuuaguuuauugauguguuuauguugaaccagccuugcaucccagggaugaagcugaguugaucgugguagauaagcuuuuugaugugcugcuggauucaguuuucugguaauuuguugagaauuuuugcagugaugcucaucaaggauauuggccugaaguuuucuuuuuuuguuguaucucugccagguuuugguaucacaauguugcuggccucauagaacgagguagggaggaguacuuccuuuucgauuuuuuuggaauaguuucaauaggaauaacaccaacucuucuuuguaucucugguagaauucagaugugaaacugugugguccuggguuuugguugguggcuauuuauuacugccucaauuucagaacaauauuggucucuuuaaguuuuucaguuaagcaaaagaauggcacaucaucuuuaugaauuaaauguuuuauuauuauuuuaaaaaauugacuuuguuccauauauugcucuuuaccuugaauuaugccuuguuauuaauauuacuacaucugcucuccuuuuguuuaacuuaacuaguagaguuuugccuauccauuuauuuuccuucuauuucugucauuuuaucuuggcuuuaucucuugaaaauggccuauagcuacaguuugcuuuuuuguuuuauaaucugagcagcuuugccuuuuaauucacuaacauuuguuauuauuccugcugcuaaauuguauguaauguuuuuauucuccuuuccuauucuuuucccuccucuucucucuucucuguuuucuugaucaagcguucuucauuucuuuauuccuuucuagcuauuuuuccuuaacauuuuauuccuaauaguccuuuacuuuuugcaaauauauuaaaccuacauuucuuacugacaucaauaauuacauuguaacuauguccaucuuuaacaaaacauaacuugcaucuuuucccacuuuuaacccaaggauuuuugauaaaacaagguagaauuuuaaugcuauaguguuacuauuuccucuuuuauuucagaaauacuuuaauaauuauguuguauuugacaaccauguuuucaauagcgacuuagguuuacuaauuucauugcucaccauaguuucuugaauauuuaaaaagauuauaugagauacugugauauuuugcugccuucagguuaccaaaaggcacagaauuuacaaacauagugccaugaccacuaaaguccuauauacuggaauaugauucauccaccccagaguugcaagcagucuuuaggagauauaaagauaugagaaaucuuuugagagauaugaaaaaaggauuagaacuaugauguggucacauuuugcggaaugcagucuuuguguagacagguuaucuguucuccuccccucccauagguguagaagaaaaaaacacucaacuggguuuccuucccaaaguucacagaaagaagaaccaagaaaaacuugaaguguguugcugggccucagaaagcaacacccuaaauuaugauguuuuggcacgcuaaguacuuugaacugaaggacaguggcagggccucagaagcaaggucucucucuuuuuucuuucuuuuuuuuuuuucuuugagacagggucucaucaugucacccaguacacagugcaauggcaaucauggcucacugcauucucaaacuccuagguucaaaugauccucccaccucauccuccugaguagcugggacaacaggugcaugccaccauacuugguuggaaauccuucuguccuucugagcuucuuucuccugcuccccuuucuuccccaaggcaggccauaaaaaauagaauuccucuuccccaaggcaagucauauaaacuagaaauauuacucuaaccuucuccgaccuuucuguguacaaccuggccaucaagaaauucucuaaccuacugucugauaguaggucauaagacccucauucuagaaggaguccugcccuacacccagaaggaacaaaugccucacagagaggucaagaagaaccucaacugacaggccuugcuggguuuccccacucagucuauuaccauuaagucauucccuuuuugucuaaucacauuccuauguggccguccauucucaucaaaccuaaaaauaaaaaugaacaguuuucccuugggucuuuacuucugaaugcuccugugacauauaaaacuuugauuaaauaaaucuguuauucuuuuuucuuguuaaccuaucuuuaguuguaggaguguugacccugacccuuaagauggguuaggaaagguaucacacccuucugccccuacaguugcugcaugaaggaauaaccgacaaauucaguccaugguugaacuuucccuuugcuugaccuaccccaaagcuuaaggcagagugggaguagaggaagagggacagggaaacauuagacugaaaugacaaauuguuccuggugaaaaagaacaguuucuagaauguauggaacauggguccugcccagacccagggaagccugaauuggggcagcaaauggugaaugagacugagagccacagucuggccaucaaucagugcagcaggagguaaacaagcaggagaggaagagagccugaggcugacugcauggugugauagcaucuauuugugggaggcuauugacaaaccugcuuuggaguaaugcugaagagaaaagggucaaaaauacugugggcagucacaguguaugaggcaucaguuuucaguuuccuccuugucccuccucccugcaaaguggaagaaugggggccagggacagagggaacaggaaggggaggaaauagagagaaagaacagaccauguauucccuaccauucucuaccauaccaaguugcuuuugcaaagagaaaaagcauuaaaugaaauaugagaugaaguuuucaaguggacaggaccaacaaagcuggaagacuuaaaguaccauauaucacgauaauguaaaagaacaacuggcacagggauacauaaauagaucuauggaacugaauagaacccagaaacagacccuaaucuauauagucccuugauuuaugacaaggaugacauggaagugaggcacuucuuauuaaaugacgcugagucaauuucauaucuauauacaagaaaugaaucucaacccauacccugagccauauauaaaaauaaauucuagacagauuacaagccuaaauauuaaagggcaaaacaauaaaauuucuagaagaaaaaaauuuaaaggcacacagcccaauaaaaaaugagcaacgucaaugguggauugcauuuaaaaaaaaaaugugguacaauacaccauggaauacuacacagccauaaaaagaacaaaaucauguccuuugcaacaauuuggaugcagcuggaagccacuaucauaagcaaacuaacacagaaacagaaaaccaaauaacacauguucucacuuguaaguggagcuaaacacuggguauacaugcacauaaagaugggaauaauagauacugggaaauaaagagggggaaaggaugaagugagacaaggguugacaaacuaccuauuaggugcuaugcucacuaccuggaugauggauucauucauaucccaaaccucagaaucaugcaauauaucugcauauguauucccugaaucuaaaauaacaguugaaaaaaacaaauaagcaaauauuuggacagauauuucaaaaagaauauucaaauaccaaauauauauauguguguguguauacauauauguauauacacauauacacauaguuguucaacuuccuuaguugucaggaaaaaugcaaauuacuaucacagugagacaccacuacauauccaccagaaugacugaaaucaaagacagaugaaaccaaauguugcuggggauaugaauucucauacccugcuaguaaaauauaaauuggugcaaacacuggaaaguuacuuaguaguacuuauuaaaccuucaaauuugcauacucugugaccagcaauucagaaauucuuaccuauguucacuaaaaaacauguacaagcauguacagcacuguucauaauagugcaaaacuguccaucaauaguagaaagaauaaacuguaguacauucacaaagaauacuacacagcaaugaaaagcaacaaaacuauuauuacucuccacacaaaaaugugucuuacaaacauaaaauugaacaaaagaagucauauagaaaauaacacauacugaaugauuccaucugaacaaguugaaaaacgaaaacaggacaguaauuacccuucugggggauaguaacuagaacagggcacaacugggguuucugagaugcuagcaauauucuauuucuuaauuuggauucuggauacauagauguaaugacuucgugaaaauacauugugcuguaaacuuaugauuuacauaccucucuguggguuuauuuaaacaaaaugacaaaaacuaagucuuaauagcuggaaugugacuguuuuaauaacagaaagugaaaaauuauagaauuggauuuagaugucauuagggagcauguuauucagcaggaauggagauuucauuagauaacagugguaacagaaauuggaaaaauacaauuguuuuauguuuauuccuuaugaucuaagaauuuucagucauuucaguuauauuaaucuuuccuuuucuugaaauugaugugauucaaaacauguuaucccaaaauaugguaucuucgcauuugagaaaacagcagaagcaagaaagucucucucucucucucucucucucucucucucucucucaccuacucuccccuuucuucccugaagcaggccacaaagccuagcugaccuuauuuauuauuuaguuauuaguuauuuauuuuuauaaacucuuuucucuuaaauuuaaucucuuaguaacuugaaacuuccauccucuugcuauagccuucauuuuauacauacagcuucaaaguaacccaaauucucuaucuucuaaaccaauuuccaaugcacaaaacacaucaauaauucuagguuucuacaaauauaugauagcuauuuuugucuuccauuuuuaucccuacaaacuaguuagaugcauuuuauaaucccaagcagaaauaccccaauuauguuaagugacucaagggauagaguuaauuuuguaugaaaagauuaaauuugcuugauugcucuuuuuuagugaagacuauguuaaugucaaguuuaagagugauaguauuuugcuuuugacaaagacauaagggaaaauucuucucagcuaguucaguauacucuaaaucagccacaaauauaaauccuaacucaaguuucucacaacuagaagaaaucagaagaauaugauaaaaaucaaagaauucauaucaugaaaaugaaagguacaagagaaauucaauaacaugcucuuccuauuuuuuguuugacuuaccauaaaaaucugcacuaaugggggacaucuauguuuucaauucuaagcauaaguuuuagaucuccauaacaugaaaaugaccacagauucugaaugaguagcugcucuccaccaccauauuuccaagcucuagaaacucagugcuagagcuaaacugaguuguugcuauuguuuuauuuagaccacuugaaacccugaaaaucaucaaaaugcagaaaaucacuauguugguuagguuuccuguggcaggaauauuuaaaacaauuuaagaaaacuccuaaccagaacauguucagagaauuauuaacauuuuuauucagaaguuuagaugccauuuucugccucauacucccucauucccuccaguucaacucuuccuaauuaaguuuucuggccuugcccuacccccaccugaucaucaugauaaaacuaggacauaaguauuaauacuuauuaaagcauuacaaguauuaauaugucuacuguuccauuucauggaucuacuccuacuaaugaaggaggagauacuaaaaaucuaaauaagaaauugcuuuuaaccuugaaaauuuagaacauuacauuaugauauccuugagguuauuugaggaaaaauauuauuuaguaaacuggaaggagugaaauuuuuuuucuaaaggugucacaaagaagcaaguaauauugguaauaacaauuuuaauaauguacuaucucuuauaaugaaagaugauguugguaacccagacaagcuaaugggcauauguuucacacugggguaauacuucacuaccagucacaggaacaaaaagccuuuugcaaaacuaugugacaaaauuaacuaugcaguauguaucaaagaauacuguggugguuuucaaacuaugcuauucagaacccuucagagauuuaggguaaagcagagucacauuuugagguguucugcuucauucggauugauaucuucauucauuuaugcauacaauaaauacuuauuaagcuaucuauuacaugcaugccugugguugacuagcacuuucugguaucacaccuguaauaugauagaaacagucccugcucucagaaagcucagucuagcuaaaaauaaacacaucaagcaaauaaugguagaaguaauuaauuaauggucaaagguacaaacacaauagaaacauguauagagugcuauaaaagaagucuuugguaaguuuccuucaccuuacggguuuucucauaagauuuuagcugaauaaaggguacaugcuuccaagugaccaaaauaauguaagcuaaccugacacuuaugguauuaauuaccaaaucuaagcucugaugcccuauuuuauugugucacuuugauucaaaagaaccauacauucaaacguuaagguaucuuaagaaucucuguauaccagauacuauguuagaagcuuuagggcuauaaauaugcauucacuuaagaaaauauuucaaaauauuggauugaauauuuacuaugcuaggcacuggggauuaacauuuccauguaauaauuaguuuccagcauuucucagaaaauguauguuuuuccaaaucccaagaaaaaucagucaagaaauagagaaaaacaggagaaaaaauggcggauaggagguaggacuaacuugcagcucccacucggauguacagagcagcauguggagacucacacugugaacuuuugcuccaagaacuaccauaggaacauaucaggaaagccaagagaaugcacagacccuuugaagaagguggauuggcaccgcaggcugugugggacagcagaggaacuguaagucuacucgcuuucucagcugggaggcuuguagccugaggcaaguucuccacucugcucaacggcugccugaaaauaaacucgguucuauugggagggcacagugugagugagacuggccuuucaggcugugaguugcgggggagcugggugaggccuguggcugccagcuuuccuccacuucccuggcaaccugugugagcagcagaggcagccauaaucccccugggaacauaacuccauuggccugggaaccaaacuccuuucccccauagcagccacagcaagccacgcacaaggagucugagcucauacacgccuauaucugccccaaccuggugguguuucucuacccacacugguagcuaaaaaaaaggacaaucucuuaggagcgcuauggccccacccacucccagacccuagggcaagcuuguauccuaccuauacuacuggagcugaugcgcucuugaaagugccaccuccugguuuuuggagggcaaccaacacaaaaccagggcacuuaaaaauacaaccaaggacccccauagaguccgcuuugcuccccugcuacacccacaagagcaggugcugguauucacagcugagagacuugaaaacagaucacaucacaggacucuucguagacacuccccaguaccagcccagagccugguagcucugcuaggagacuagauucagaagagaaauaacccucacugcaguuuggcucucaggaauccccaucacuaggggaagggggagagcaccacaucaagggagcacccugugguacaaaaaaaucugaacagcagccccuuagugucccagauccucccucugacguagcuuacccagaaaaacaauccugguaauauggcaaaacaaaguucuuuaacacccccaaaaguucacacuagcucaccagcaauggauccaaaccaagaagaaaucucugaauugucagaaaaagaauucagaaggucaauuauuaagguaauuaaggaggcaccagagaaaggugauguccaacuaaaagaaauaaaaaaaagauacaggauaugaauggaaaaaucuccaaugaaauaaauagcauaaauaaaaaacagucaaaaacuucugaaaaugaaggacacgcuuagagaaaugcaaaaugcaccggaaagaaucagcaacagaauugaacaaguagaaaaaaaaaacuucagagcucaaagacaaguuuuuuguuuguuuguuuuguuuuguuuuguuuugagacggagucucgcucugucgcccaggauggugugcaguggugcgaucucggcucaugugcaagcuccgccuccuggguucacgccauucuccugccucagccucccgaguagcugggacuacaggugcccaccaccgcgcccagcuaauuuuuuuguaucuuuaguagagacgggguuucacuguguuagccaggauggccucgaucuccugaccucaugauccacccaucucggccucccaaagugcugggauuacaggugggagccaccacucccggccaagacaagguuuuugaauuaacccaauccaacaaagacagagagaaaagaauuuuuaaaaaggaacaaagccuccaauaauuuugggauuauguuaaccaaaccuacgaauaauugguguucccaaggaagaagagaaaucuaaaaguuuggaaaacauauuagauagaaaaauugagaaaaauuuccccagccuuucuagagaucuagacaucuaaauacaggaagcucaaagaacaccugggaaauucaucgcaaaaagaucaucacguagguacacaguccucaguuuaucuaaagucaagacaaagaaaagaaucuuaagagcugugaggcaaaagcaucagguaaucuauaaaggaaaaccuaucagauuaacauagauuucucagcagaaacccuauaagcuagaagagacugggguucuaucuuuagccuccuuaaucaaaacaauuaacagccaagaauuuugcauccagcaaaaguaagcuucauaaaugaaggaaagauacagucucuuucagaaaaacaaacacugagagaauucaccacuaccaagccagcacuaaaagaagugcuaaaaggagcucuaaaucuugaaacaaauccucuaaauacaccaaaauagaaucuccuuaaagcauaaaucucacagaaccuauaaaacaauaauacaauugaaaaaaaaacccagguauucaggcaacaaauagcaugaugaauaaaauaguaccucacaucucgauacuaacauugaauguaaguggccuaaauguuccacuuaaaagauacagaauugcagaauggauaagaauucaacaauaaaguaucugcugucuucaagagacucaccugacacauaaggacucacauaaacuuaaggugaagggguagaaaaagauauuccaugccaauggacaccaaaagugaacaggaguaacuaauauauauucuuauauucaauauauauucuuauauugcaacagcaguuuaaaaacacaaaaagggacauuauauauugauaaaagaacuaguccaacaggaaaacaucacaauccuaaauauauaugcaccuaacacuggagaucccaaauuuaugaaaccauuacuacuagaccuaagaaaugagauagacagcaagucaauaacagugggaaacuucaacacuccacugacagcacuagacaaaccauuaagacaaaaagucaacaaauaaacaauggccuuaaacuauacccuaaaacaaacggacuuaacagauauuuacagaacauucuaugcaacaacugcaaaauauacauucuauucaucagcacauggaacauucuccaagauaggccauaugauagaccacaaaacaagucucaacaaauuuaagaaaacugaaauuauagcaaguacucucucaaaccacagugaaauaaaauggaaaaucaacuccaaaaggaacccucaaaaccauggaaauacauggaaauuaaauaaccugcuccugaaugaucauugugucaacaaugaaaucaagauggaaauuuaacaguucuuugaacugaaugauaacagugacacaaccuaucaaaaccucugggauacagcaaaggcagugcuaagaggaaaguucauagcauuaaauaccuacaucaaaaagucuaaaggagcacaaauagacaaucuaaggucauaccuuaaggagcuagagaaacaagaagcaaccaaaccaaacccagcagaagaaaggaaauaaccaaggucagagcagaacuaaaugaaauggaaacaaaacaaaauaaaaaauacaaaagauaaaugagacaaaaagcugguucuuugaaaagauaaauaaaauuaauagaccauuagcaagauuaaucaagaagagagaagauccaaauaagcuaaguuagaaaugaaaugggagauauuacaacugauaccacagaaauacaaaagaucauccaaggcuacuaugaacaccuuuaugcacauaacauagaaaaccuaguggacauggauaaauuccuggaaauauacagcccuccuacauuaaaccaagaaguagaaacucugaagagaccaauaacaagcagugagauugaaaugcuaauuuaaaaguuaccaaaaaaaaaguccaggaccaaucagacauuuaaagaauugguaccaauacuacugacauuauuccaaaagagagaaaaagagggaauccuccauaaaucauucuaugaagccacuaucacccuaacaccaaaaccagaaaaggaaguaacaaaaaaagaaaacuacagaccaauaacccugaugaacacggacacaaaaaucuguaacaaaauacuagcaaaccaaauccaaaagcauaucaaaaagauaauccaccacaaucaaguggguuucauacgagggaugcggggacgguuuaacauauacaaguaaagaaaugugacacaacacauaaacagaauuaaaaacaaaaaucacaugaucaucucaauagacacagaaaaagcauuugacaaauuccaacaucacuuuaugacugaaacccucaacaaaauuggcguaaaagggacauaccuuaaaguaaugaaagccaucuauuacaaacccacagccaacauuauacugaacaggaaaauguugaaagcauuacugcuaagaacuggaacaugacaaggaugcccacucucaacacuucuauucaacauaguauuggaaguccuagccagagcaaucaaacaagagaaagaaauaaaggggauccaaauugguaaagaggaagucaaacugucacuguuugcugaagacaugauuguauaccuagaaaaccuuaagacuaaucuagaaagcuccuagaacugguaaaugaauucagcaaaguuucuggauacaaaauuaauguacacaaaucaguagcccugcuauacaucaacaguuuccaagcugagaaucaaaucaagaacucaagcccuuuuacaauagcugcaaaaaaaauaaaauaaaauauuuaggaauauaucuaaccaaggaggugaaagacuucuacaaggaaaacuacaaaacacugcugaaagaaaucauagacaacacaaacaaauggaaacauaucccauggucauggauggguagaaucaauauugugaaaaugaccauacggccaauagcaaucuacaaauucaguacaauucccaucaaaauaccaccaucauucuucacagaacuaaaagaaaauccuaaaauuaacguggaaccaaaaaagagcccacauaaccaaagcaggacuaagcaaaaagaacauaccuggaggcaucacauuacccaaccucaaacuauacuaaaaggcaauagucaccaaaacaacauaguacugguauaaaaauagguauauaagccaauggaacagaauagagaacccagaaauacacccaaauacuuacagccaacugaucuucaacaaaucaaaccaaaacauaaauaggagaaaagacaccuuauucaacaaauggugccgggauaauugacuagccacauguaggagaaugaaacuggauccuugucucucaccuuacacaaaaauaagcucaagauggaucaaagacuuauaucuaacaucugaaaccauaaaaauucuagaagacacauuggaaaaacccuucuagacaucagcuuaggcaaagcuuucaugaccaagaacccaaaagcaaacacaacaaaacaaagacaaauagaugggacuuaauuaaaccaaaaagcuucugcacagcaaaaaagauaaucaucagagaaaagugacaacccacagagugggagacaaucuucacaaucuauacauccaacaaaggaccaauauccaaaauuuacaaggaacucaagcaaaucagcaagaaaaaaacaaauaaucccaucaaaaagugggcuaaggacauaaacagacaauucucaaaagaagauauacaaauggccaacaaacauacaaaaaaaugcucaacaucacuaaugaccagagaaaugcaaaucaauaccaccuuacuccugcaagaauggccauaaucaaaaaaucaaaaaaauaauagauggugguguggaugugguaaaaauggaacacuuuuacacuguuggugggaauguaaacuaguacaagcacuauggaaaacaguauggagauuccuugaagaacuaaaaguagcuccaccauuugauccaggaguccaacuccuggguaucuacccagagaaaaagaagucauuauacgaaaaagauacuugcacacugauguuuauagcagcacaauuugcaguugcaaaaauauagaauuagcucaaaugcccaucagucaacaaguggauaaagaaaaugugguaaauauauauaccacggaauacuacucagcaauaaaagggaacaaaauaauggcauucacagcaaccugaauggaguuggagaccauuauuuuaagugaaguaacucaggaaugaaaaaccagacacuauauguucucauucauaagugggagcuaagcuaugaggaaacaaaggccuaagaaugauacaauggacuuugggaacucggggaaagagggggcgggugagggauauaagacuacacacuggguacagcguacacuccuccaguggugggugcgccaaaaucucagaaaucuccacugaagaacuuauucaugcacauaaauaaauaaauaauaaaagaaauagggaaaaccagaaccaguaaaaguacuauaauucucuugugaggauugaagcuuaauaacauggagacauuacugguucaaaggaauauacugauguaaaguugaaagcaagagcagauaauauugacacauggaguagaacacugaaguuccaguaaccaaggaaggugaacauaggagagaaguugucacauuuaaucaguuagucuuauuguggcuguugcagaguuauaugugaguauucauggcauugcaugcugcuaacagugaagaacucuugcaaguaaaauaaacauuaacaaguuuacacgcauaauauacuuuaugcaaauccacugagugguguuccaagaaaugacaaguuuuggaagcaaaguaagcccuuacauugacaaguuugacauauaauucuuugagguacuguuagcuuugcuaggagaucugaauguuauguaauucaaauacuacccaaucacuuuugacugguguuuucuagugucugaauauucacuacaggcuacaguucucuauaacuauuauuaaacuucauauuucucauauauuaaacaaaauguuagauauuuaaaauaaugagcaaagcauauaaaaacuguugaaaguuuuuuguuuuguuuuuguuuuuuuuuuugagacagagucuugcucugucacccaggcuggagugcaguggcacaaucucggcucacugcaaccucugccucccagguucaagcgauucuccugccucagccuccugaguagcugggauuagagguaccugccaccacgccuggcuaauuuuuauauguuuuaguagauacaggguuucaucauguuggccaggcuggucuugaacuccugaccucagaugaacugccuaccuuggccucccaaagugcugggauuacaggcaugggccaccgcgcccggccgaaaguauuuuuaaaacaacuuacaauuucaggaauucccagaaauucucaagaauuacuacuucucauuucugaaucccaaagauuaauauuuauugggaauugggaaauacuacuugagauaaaaguugacuaagagaacuucccugccucuuugaaguuuaggagagagaugaaaacauggaaaccaaaaaaaguauuaaagguguuaagauaaaauucuauuuaggacacagugaagacacaaaggcaaaagacacagagcaauuaugcccacagaggucuggagaaggcuuuacagcaaagaacaugagaucuugagugguguccuaaaaggcaaaaacuaccuucuagauaaaauaaagggagauaugagacugcuaacaggccauacagagggaagacugcugaggcuggggucaugaaacaucauggguuguucagcaaacauuuaguaguuuagggaggaagguggaguuugaugggagacaggaagaacagaaagggauuuaauucagggaagaucuucuaaugaaaggaaaagucucccaagaaucuuaaguaguugacugacaugaucagauuuauauuuuuuagaaagaucccucuggaggacacauggaggauggguucaaagugugugagacuagagauuaguacugcaacaguuaggugcaucccuaaacaauacaacuccauacauuguuaaagacccacacauacccaacacacugcaggguagaaaccuguaagaggaauugggaaugaaagugaauacuaagucuaauggguaaaauaacaagauuuuaaaacagagaguaaggcagucaugaugcuuguugauuguaucaugaacugaagaguauaauaaacucaagccacuguagcugagguaccuaggaacaaacaaaugaaaggauggcuauaucuuuccuacugauaaauuaaacuacauuugccccaaggcugccuccauacuuugaguccuauguaaagaacuacaacccaaauuaguacauaaacucaggaaaagcuaauuagaaguauacuuuuguaacaaauaucugagucucagccaaucacagcagcugagcuuuagucuaucacaagcagccaacugaucagaccauguucaaauaaggcaaaugccuagcuaaaauaaaucaggcuguuccuguaccucgcuucuguguucuguccauaaaugcagcuugcccaggucucagagcagaacccucugaaccucuucugguucugagggcugcacaauuauaaugcaaaucauucuuugcucaaauuaacuguuaaauguaauuugucuaaaguuuuucuuuuaacacuauucuuuucauauaaucacaugaaauaagagaagaaaaucaaugguagaaaaauucccuuguacaguaaaucaaauuguuaagaaguguaauuucuuuaaaaagauauaucuaguuacucuaucacugacucucaaauaaucuguagaacuuuauucauuuucuaaagagucuuguuacccucaugauccguaucaaccugcaauucaaaauaucauagaauugauagaauuguuuugucuaucaguaauugucuucaugguuauauuuuuuucagauuauauuugggaaaagcuacuuauuagaggaauaucuacgaauaauaaucagucuuucacaagcccaaaagcucugauaucucccucccucaugaucccauugcuguugauaguguuaugcagauuuuguaaacaauuaaaucuguucgcaugcaaacaauuuugguuuaaccaugaacaacaauaaagaaguucauauacuucuuuuauguaauucacgaucuacccaugcuccuuuuaaaagcauacuaauauauccuauuauguauuccaaagcuguuauacgaaagugaauguucuuuucaaaauucuuuuugacaugccacuggagcagcuccagaaaaaaauuaacacuuuuggggaauuuuauugcaucccuuucaguagccaaaaaggaagcggguggggcggggguggggggcugaagccaaagauuaaaauaaaugcauaauucauuuuuaacaugguagguuuucucucauucuucauuguaauagcucuagaacuaauuuuacuguuaacacugaauuuuuagagggguguuguauaaaccauuuuuuacaaagaaggagacuaaaaagauuuucugcucaccaucagugcacaaaauugaacaagugaaaaucuucacacacaauaugcuuccaaugagcaugcucuuaugcaucaaagaggaaacaaagcauuucaggauuauguuuguaaaaggauuguuuuugaaaaaaauaaaaaagcauagagcaaauuucagaguggaaaaacaucaaaggcuuuucaauagucaaacucaucacuagauuuaaggcaacauuuaaagcaagacaucuguguuauuuauauaauaucaaaaagaaaaagcacaaagguagacucaagacaaauaaagaauccaccuccuaugcuauaaaauacuucuuauguuugucucucuaacaguaugcuauuauucuagcaaggcaaauauguucuuaaaaggguaucauguuuuguaugaugcugaugagcgcagcuuuuucaugugucuugcuuaaugcagcuaaauacuacgaaugcuauucaguuaucaaagauacaaagaaccauucaaguuuaggaaauuacuagacucuuucuuacagaaacacaaauuauuauaauguauuguuuucaucuuccugcccaauauccaaacuuuauaauccauucuauuuuucucucacauuguaccaugagacacuuuuacugcgagcaguaaguaugagaaugcaaaaucuagggaggggugaaaagaaguaaaagaacaacaauguaaaggaggggaagcugacauggagaaggaaaaauaggauucaacacucuuggauucaguuauuaauucuuaacaaauguccccagggagcucacccaguauuucuagaccagauggaaaaaacaguaugcuacagcaacucuaucccuagacccagcugucaugaggaauagagaggcaaucccaguaaggaacuaacaucuaacaccauacuucaugugugcugcgccauucauauacaggcugaccuuaagauggugacuguuuuguuuguugguugguuuuuguuuuguuuugcuggcuucuuauguaugugccucuguuuuuuauaucaauccuugaccucucuccaaaguccaaucaugcauuuccaggcccugccaaugaucuccuuuguaccuuuaagucaacauuccccaaaaccauucauuuucuccuaaaccugaaaaaaagaaaaaaacuccaccacuugacuuuuucccuguggcuggcaacaccauucucucaauccuucaagcauuacauuuuaaaaugauaacugaguuuuccuucucucucuucaucauaucaagaucuugcuggccaggcacaguggcccacacccguaaucccagcacuuugggaggccaaggcagguggaucacgaagucaggagauugagaccauccuggcuaacacggugaaaucccauuucuacuaagaauacaaaaaauuagccgggcgugguggcacacaccuguagucccagcuacucaagaggcugaggcaagagaauugcuugaacccaggagacagagguugcagugagccaagauugcaccacugcacuccagccugggugacagagcaagacaccgucucaaaaaaauaaaaaaaaaaauucuugccaaauuauauagccuaauagcaaaauauuugucaaaagucgauccccuuggccaagcgugguggcucacgccuguaaucccagcacuuugggaugccgaggcuggaggaucacaaggucaggagauagaaacuauccuggccaacauagugaaacuccuucucuacuaaaauacagaaauuagcugggcgugguggcacaugccuaucaucccagcuauucaggaggcugaggcaggagaaucacuugaaccagggagucagagguugaguuggagguugcagugagccgagaucacgccagagcacuccagccuggcaacagagcgagacuacaucucaaaaaaaaaaaaaaaaaaaaaaguagaaccccucuuuuccaauuuuguuauguaauuccaucccaaaguuuggauuacccaggccucucacuuaaauggucacaaacaccuaacuggucuccccaccuucaaucucuuuauccccaauucauuauauccacugcuauuaaauuaauauuccuauggcacaacugugauccuccuccuccaauucucaaaaaucuuuagugaauucacaauuauugaaaauauuuaaaaucuuuuagccaugaaaaucaaagguuuucaugaucucaccucaaucucacuuuucaaaaugaucucacacaaucuccuucauauacuccauguuugaaccacuggacuacauauuauuaagugaaauguaccugagcuugcacaucuugugucuuuauucacacuaaucuucccuccuuguuugcugugauagggacugugcuagauaguaugauacaaagaugaauaauagaucuuauauagguucuaagcuucuuagagaagcaugagcuuuggaauuagauaggacuggggucugaauucagauucugcaauugccagcugucugauuuggggcaagcucuuaaccugagagacagcuuuuugagcugugaaaugauauaauaacaucuaccuuggaaaguugccaggauauaaauuacauauuuuaaaagcaugauauggugucuuccauuuagguaagucuuccuucugaaauaccaacauuagcuuccccaagcagaaugcacugaugacaauaaugaguuagcugucaccugcaaagauccugaguuaguacagacagagaacaauugcagcuuuccucuacuccuuuucuuccuugcagagacaaaugagggugaccucacaguuuaugccucguaacguuugccuagugaucuuuuccauucuccaacaccauccaggcaauaagcaucaauguuaaugagcugcuggacagcuuugugaaacugacugaaagagccagauagguauugguguccuacacaugcaaauaauauacuuucccuucaaauguacuauuuuuauauaaguuucaaaaguuacauccugguggaaugacaguacccaacugaaauauguuuuccacucuauguuacugcuuacuucaacgggaaaagaauauauuuacacuuugccauauuauguaaacauggaaaacugagcuaacuagugucauguuauuaauugacuccagugauauuuuagcauccuuuauagauuggcccccuggacucguaacugcccguaauccaaguauguauaugugaaauaaccucaggggucggugggagggggaaagggguuauuuacacaguguuugaagaagugcaacacuugcaguuucaauuccagaaguaguagguaccgaggcauccuggauagacuguaaaagaguagucaagaaauccuggcaguuaucaaugacuagaagccaaguaaaagcugcaagucauaauugcuggaaauuuguuuacaugcaacaguauuuucaagggaaaguaagaagcagagggaaaagggcuugauauagagcagacauccgaacccaaguacuuaauaguaggaggaaaaagaaggcugaaacuagcuuagaagccaucuaaaaaagaaauauuuaguuggucuuuauuuacacuaaauuagaaaaaauuuuacuuaaaccuaugccucagucuaaauuucccagugaacauuuguggagauuuggcuaucuagaauccauuucuuccuucuuugggcaacagcauccuuauuucauuuuagagaauucccuccucucuauuguauccagucuugguggugcuacaagucaacaugcccugugcuccucuaaccaguaaucauccaagcuaugccaguaagacucuccaaaauuuaaaucuaaaguggaguagcuuaagaauggaaaaggauaaagucccagaaauagcgcuccaacaaaacuauugugaguaucuugcuguucagaaaccguaagccuggucacuagcuuuuaccuuaauucugcugacuacccaauaaucuuucaauaaauuccuuucugcuuccuuaacuagacuugguuccuauuguuggcagccuaagaagcccugauaaggaauuaaagccauuuugccuaacuuugucccuggucuuuccaaaugaaaacuacaaauauuugaaaacaaaacuacccuauaguuuguugaacgguguuuuuauggcucuauuacagaaguauccagcauacuugcauuuuucaagcacacaaaacuuaaagggggcauuuuuguuuacuuuuccuaccucauuuucagcaguauucacucuauucccacuguuuccugccacgcuuccccauuacacgauuuucuucauaauugggccaagguuuacucuaguaacauuagcuguauugauuuauuuguacauuugcugucucgagaacuuaaguaauuugaguagcucauauuauuguuuacauguucaauuaucuuguacuucuuaacauuuucaaugccauugccuuuauucuaguaucuuuucacaaauaugcauuacuguauuaaguacaauguguccaaaauuaauuguuaaagguaugauaccaguauuuguucccccaggacucuucgaugaaauaaaucaguaaaagaaaaucuaaauguauaauuuauaaauuuauagaaauugagaaaucugaaaaauguagugaucaccuaaucuaaggccauaauuuuauagauaagggaauaggucucccuaggccauuauccuugauuccaacaucuccauugauuuauuuuggguuuuauguguuuucugucauugcaagggguucagggaaaaagauagcaacuguguauguccgguaaucccucuuaaacaagaggaaaaagggaaauaaucugacaucccaacuuaaaucaggggcaccaguaaucucacaguaauuuaaaggucaaaguuuacaguuaucuuaaauuuuuauuuaaaucuccuuccuauucaccuggccacuguaaagauuaaaugaaaguaauuuguagacuauaaaauguuauaugagucaagauuuuguuaauauugcuauucuucauccuuucccuucccacggcacaaacauagagccauuauggccuuacaucaaaauuauaacacaaaccaauaaagcccccauccccuccccauugcaacccauccuauaagacaacuuuuuguacuagacuuucaauucuuucaaacuuuuaagaaauaaauaacaccaauuauaucagucuauuuucacacuguugaugaagacauacccgagacugggaaauuuauaaagaaaaagagguuuaacggacucacagcuccacguggcuaggaaggccucacaaucaugguagagggcgaaaggcauguugucuuacauggcagcaggcaagagagagaaugagagccaagcaaaaagaguuuccccuuauaaaaccaucagaucucacaagacuuacucacuaccacgggaacaguaugugggaaaccacccccaugauuaaauucucucccaccggguaccucacacaauacuugggaauuaugggagcuacaauucaagaugagacuugaguggggacacagccagaucauaccaccaacauuacaccuacucuuccagagaacaggaaaauauaaaacacuuccaaauguguguuguuguuguuguuguuguuugaagccaggauaguauuaauaucgcagccucacaagaacauugcaaaaaagcaaagucaaaagcaaauccuaaucgugaacaugaguacaaaacaccugaacaaaauuucagcaaaucaaauccugcgauauauagaaaggauaauaaaccaugaucaagcugggucuauucuaauaauguaauaucauuuacuacaguaacaggaugagggagaaaaaucauaugauuaucucaauagaugcagaaaaagcacucuauaaaauucaacaccaauuaaugauuuuuaaaaaagaaacuagcaaacuggcaauaaaaugaaacugccuuggacugauaaagcaaauccaaagaauucaaaagucaggauagugguuguccuuugggaguaguaaauggaaugaguaagaaaagagcuucagaagagcuaauuucuuuaucugaaugcuuaaaacccaaacguggcaaguucaugagaauuuacugagcuguacaaauacaguaugagcacuuucuucuauguauauuauacuucaacaauaaaaaaaccuauagcagucauacuuaauuaugaaauaauaaaaguuuucuucuugaaauuggaaauuacacaagcaugccacuaacaccauuguucuucaacaauuuauuggagauccuaggcagugcaauaagaaaaagaaauagaagacaugaaggacgacaagaaagaaauuucaugcagaaaaccccaaaauaaucuauggauaaaguauuagaauaaaaauacauagcaagauuauuggauuucaggucaaaauagaaaaucaacuguuucuauauaucagcaguuaaaaaaaaaguuuuuaaaugacaccauuuauaacauuaaaaauauccaacacuucggaaacuaauggaagauaugcaagguccuuacagagaacacuauaaaacauuauuuuaaaaauuuaaggaagaggccgggugugguggcucaaaccuguaaucccagcauuuugggaggccgaggcgggcagaucauuugagaucaggaguucgagaccagccuggccaacauggcgaaauccugucucuacuaacaauacaaaaauagccgggcaugguggcaggcuccuguaaucccagcuacuugggaggcuaaggcaugagaauagcuugaacucgggaggcagagguuguagcgaguggagauugcgccacugcaauccagccuagguaacaaaaugagagucugucucaaaaaauaaauaaauaaauuuuaaggaagaaauaaauggagagauauaucaugcugaugaaagagaaaauacugaaaaugucaauuucuccaaauuguucuauagauucaaugugauuccaaucaaagucccagcagaauuuuuguggaaauugacaagaugauuauaaaaauuaauauaaaaaaaucaagagaauuuugaagaagugggaggagguacaccaucagacaacuagaauaauuaagacaguaugguauuggcacaaagauaaaugcaugaaccaaugaaacagaagagggugcaaaauagacucauacauauauuuuaaaagauugggcugggcacgguggcucacgccuguaaucccagcacuuugggaggcugaggcaggaggaucaccugagguugggaguuugagaccagccugaccaacauggagaaacccaucucuacuaaaaauaauaauaauacaaaauuagccaggcgugcuggagcaugccuauaaucccagcuacucgggaggcugaggcaggagaaucacuugaacccgagaggcaaagguuguggugggccaagaucgcgccauugcacuccagccugggcaacaagagugaaacuuugucucaaaaaaaaaaaaaaauuguacugcagagccacagagaaacaaugaucuuuucaacaaguggugcugguucaaauaaauaucaauagcaaaaaaugaaaacugcuauaugccucacaucauauaaaaaaagaacuccuaauagaucuaugaaaaaauaauaaaauaucuuaaaaguuuacauaaaugaauaacucaugaccuuuauauaagcaaaauuuucuuuuucuguccuuuaauuucaacuuuuuuuucuugcuuuuuuuauaauuucaacuuuuauuuuagauucgggguagauguacagauuuauuacacagauauauugugugauguugagaauuaggguacaacugauccuaucacucagguagugagcauaguauucgauaguuuuucaacucuugcuccgccgucacuccccuuucuaguaguccccaguuucuauuguugcaaucucuacguccaugaguaccuaauguuuagcucccaccuauaagugagaaccugugguauuugguuuucugcuccugcauuaauucacuugggauaauguccuccagcuacauccauguugcuguaaaggacaugauuucaaucuuuuuuauggcuguauaguauuccacuguauauacguauauuuucuuuauccaauccaccauugacaggcaccucgguugauuccaugucuuuacuauugugaauacuacugaaaugaacauaugauugcauguucuuuuugguagaacaauuuauuuucuuuuggauauagacccaguaaugugauuguugagucaaaugauaguucuaagauauuugagaaauaucccaccuccacaaugguugaacuaauuuacauuccuaccaacaguauguaaguguucccuuuucuccacagccuugccagcaucuguuguuuuuugacuucuuaauaacagccauucugagagaugguacucauugugguuuugauuugaauuucucugaugauuaguuauuugagcauuuuuucauauacuuguuggucacuugaaugucuucuuuugagaauugucuguucuuguauuuugcucacuuuuuagaagggauauuugguuuuugcuuuuugaaauguuuaaguuccuuauagauuuuggauauuaaacauuugucagauguauagcuugugaauauuuucucccauuccauagguugucuguuuacucuguugauaguuucucuugcuguguagaagcucuuuaguuuuuaaauuagguccuacucgucaauuuuuauuuuuguugcaauugcuuuugagacuuagucauaaauucuuucccaaggccaauguccaagauacuguuuccaauguuuucuucuaauauuuuuauaguuugaggucuuacauuuaaaucuuuaaucugucuuaauuuuuguauauggugaaagguagggguccaguuucauucuucugcauauagcuagcuggcuaucccagcacuauuuguugaauagggaguccuuuccccauugcuuauuuuuguugaagaucagaugguuguagguguguggcuucauuucuggguucucuauucugucccauuggucuaugugucuguuuuuguucuaguaccaugcugucuugguuaccguagacuuaugguauagugugaacuccaauaaugugaugacucuggcuuuguucuuuuugcuuacgauugcuuuggcuauuugggcucuuuuuuuaguuccacaugaauuuuagaauagucuuuucuaauucugugaaaaaugacguugguaguuugauaggaauaguauugaaucuguagacugcuuugggaaguauggccauuuuaauaauauugauucuuccaauccaugagcauggaauuuuuuuccaauguuugugucaucuauaauuucuuucagcaguguuuaguaguucuccuuguagaaauauuucaccuccuugauuagcaguauuccuagguauuuuguuuuuguguguguagcuauuguaagugaaauuguguucuugauuuggccuucagcuuguacauuauugguguauagaaauguuacugaucuuuccacauugauuucauauccugaaacuauaaugaagucauuuauuaauuccaggagccuuggugcagucuuacaauguucuagguauagaaucauaucaccagcaaggagagacaguuugacuucuuuuuuuccuauuuggauaccuuguauuucuuucucuugucugacuguucuaacuaggacuucaaaauuuucuuaaauugaauacaaaaaacacuaacuacaaaugaaaagauugauaacuugcauuagcuaaaauuaacaacuauuauucgucaaagacaacauuagaaaguaauaaggcaaaccacagaugggaaaaaacauauguacuaggauggcuaaaauuaaaaagauuaucaauaccaaauguuuuggauaagaacuacucauguauuuccaggcggaguauaaauuuuuuacagccacucuggaaaaauaugcauacacuauaaccuagcaauaccauuuuuagauauaacagaaauguguauguaugugcauguguguguauaccaguuagaaagaagcaugaggguguuucuuaguacugguaauguucuguuucuuauucuagaugguacuugcauaggucuuuugcuucauaauaauucauaaagcuguauacuuacagucagugcccuuuucuguauguaugauauacuucaauuuuuuuaaucaggggaaaaauaaggagagaaaaucaccaaugugaaacaaauaucagaaaugcccauccaggaaccugaaaucauuucucacuggcacaaacacuacccagugauaaaauaaggacuugauauuuagacaacaacaaaaaccugauguuucaguuuaucuauacagccuuaguaaauguaaguauguaauuucauuaagcuuucugaaaugcuaaaaacaauuuuaaagauucuuauuguuuuuguguacccuuuuguauucacagaucccagauuagaaauuagugcccuagucugaaaagaaggaucaccagacaaaaauauucaguaaauguugccucuucucuuuauaaucuauauguuagguuuacacugaaaacuaucucuuuagggaaauuauauagauacaccaauccuaaguaaacauuuuuaaauaaaaugaugagggucuuauucucaauuguuuccaacacuagauacauuauaaaaagaaguuuugucccuauaacccccaaaucuauguucuuuguuaaucagugugucacaguucaaaucuuaaucacauccaaaauuuugugaccuugggcaaauuucuuaaucuguguuucaauuuccauaucuggagaauggggaugaugugacuaauaccuaccucauagggcuauugugaagauuaaaugcaauaaugcaugucaaucacuuagcacugugucuaaauguuaggcuauuauuauuaucaccaucauuuuugccuauuuauuuauuuuuuaaaguaaaacacuaaauugcugauuacaaauuugugagcaugaggaagacuguugacauaagggcuucauucucagugaucauguuaggaaguaaccuuguacugggggauuucuagauaucaguauaugaagucuucuuuggagccacucgauucuuucaaagaagaauacauuuuucuccuaaccuggaaagugcugucuaguugaugaugcugugcaaaggaacaggaagaggaguuuaacugcuccauagaucaacuuucuaccuaucccuuuguuuacugcuuaaagacucauucccuacccucagcucuaccucguaguuccaagcccuucaaauauuuaaagauagccguuauuuuauucugagucuucucuucuccaguuagacauacccaucuccuuuaacuauuuacagaccauucucuuucaucaucaguauauucauucaaaucucuguuauugugaugguuaauuuuaugugucaacugggcuaggccacaguacccagauauuugaucaaagauuccaugauggcaauuuuuaaaugagaauaacacuaaaucaguagacuuuaaguaaagcagauugcccucugcaaucuagguaggccucguucaaucaguugaaggccuuaacagucugaccucccuaaaggaaaaggggauuccaccagcagaccaccuuuggacuggaacugcaagucuucccugagucuccugcaugcugguaugcucugcagauuuuggacuugccaaaucuccauaaucuugugugccaauuccuuaaaauaaauaaaucucucucucucucucucucacauauauauauauauauauccuguugguucuguuucucuggagaaccuugacuaaaacagcuaugcuucaggaauacaaguagaaaacacuaccuaccuuuguggauaugccagucuaaccucacuuuauuauauccaaauaacucuuaaaacuguuucuaggucacauggaccuaugcaaucagaccaaugcaauuugaccauaauauagaauaaauaaacugcaauuucaccucccuaauauaauuauuuuaccgcaaccaaagagcaaccuaauccacaucacugcuuauauugaguuuaccauaauaaaauccccaaaaacuucccacaagaacuguuacagcucaccaauucuguauuugugaauuguuuuggggggccugcacauaauaccuaacauuuuuuccuacuaaauuuuauccucugaaauuuaguuuuucauugacugcugucaagauauuuuggauuccagauucugucauuucaauacauuuacaaauacucucagcuccauacuaaugaaauauuagucuuuaucaaacuaaaagaggcauagcuaagaucaagagaagucucugacaucaucaacuauaaacaaagccugaauucaaauaauacugacauacauaugcugcuauuaaaauucucagggaguauuagauaugcaaggaaggugggacauaugcugcuccagacaggccuggugucaacugcugucucuaaacuuacaaguuuuauaacuggacaauuugcuuauuccucaaagaguuucaauuuccuuuucaauaaaaugguaaagauaaaacuuacaucacaagacuggugugauguucaaaauacacauaaagcacuugacagaaugccuaauacauugcaaauacuugacaugugucuacuuugaagcacguauuauaguaagaacucagcaaaggugagauacauuccugcuucaucacuuucccuuggaucaacuauaaccuaaauaacuuaaccucuccuggccuugggguaaagagguagacagagggggagagaggcagauggaagaauaaaguugcugcaugaaguugcuaccuaaagagacuauuuuaaaggcugagaauccuuuaaaagauaucaaauaguuuagaaagaugcuuugacuugggcuguuagaaaacugcagcuucuagucagaaaagaauaaaugcagugauguuugggauuugguuaaacauuuaaauugcauuucaaaauguuggauuuggcaaaauuuaaaauaaauuuugccaaguccuuaaguuuuuuacuugcauguauucaagggaaagccagcuuguagauuugaaucauuuagauuuaacucauuaaaauguauagagugcuuuaucaagccacaaaaauugugccccaaaucauuuacaguuuaacuuagaaaaaaaaaagucuuauauaaaccacagcucuuguacacuaaguugcugagacuuagaagaaaagauuaacucagaaagaccucaagaaagaaagaaauuuugaagaaguaaugaaaggaguggaauagcacugaaugcacaggaaauggaaaaccauuccaaggaugcagacagaagugauauuacauaauagcugacacagacuauaugcaaauuucagugauuggauuuugacuuaaagauauuuuccugaaaugucuggaagaacaaugggacuuugggggcauccauaaaauuauaaucaagaucuauucagcagauguuuacugugugucuccacgugcaaagcucucuaacaagcacugagaaacaaugcugaaugggacagacauguccuugccuuuuggaagcuuacagucuauugacaaaauagacuuuuuuaugugaaaacagaaaauaauaagggcuaggaaguaucaagauguaggaagcagucgcauuauacacggauuuuaagguguaacauaaaagaaucauacauuuucaauuucuuagggacuuugaaguucaucaguccaguuuuuccaagaggaauccaagacagcaauauguaaacugcuucgauugagguagggggcaaaaggaaaagcaaagccagaccuggacacagguguccuaacucuauaucaaacauccauuccuucauucaacuuuuacgugauauuuacuaugauuaggcacugugcuaagugcugcagaaaagguaaaaauuaaaaacaccucucccuaacaugguccuggaagagagauaaguaugaaaauaaacaauccccaaaagauaaaugauguaacagaaaaauugcacaaaguugugcagcacccaaaagcaagacccucucugcuuaggaagacaaugguggcuuuacaucagccaaaucauauaaaaugaguaggauuuucccaggaacauaaaaagaagagaauucaagaaagaagaaagaggccaggcgcaguggcucacgccuguaauccuagcacuuugggaggccgaggcaggcguaucauuugaggucaggaguucaaaaccagccuggccaauauggugaaaucucgucucuacuaaaaaauauauauacaaaaaaauuagccgggagugguggcgugccuguagucccagcuacucgggaggcugaggcaggagaauugcuugaacccgggaggcagagguugcaguaagccaagaucaugccacuacauuccagacugggcgacagagugacacugcuucucacaaaaaaaaaaaaagagagagagaggaaagaaacugugcaaagaacacuguauguuuggaaaaguauaaguauaaaaaguaugaguucuuuuacuucugagcuuuuuuucuuaauuaguuuuaucaaaguaauacaugcacauagucagauggugcaaaaagacucgaaacacagcaguccuguggccacccuucugcugguuacacuaccaucaagguucucucagucccagaugcaaccauguuaaauugguuuagcugcugcuucuggcauuuagcgccaugcuucuaaaucacgugugucuauacugauauacugguauccuacacaguauaagaacuuucaccucauacccacuucacccccccaccccaguccccaauaugguugaaacauaauguggggugauauccauaauuguaguuauaaugacuaaguaaauauugcuugcugauuaagguauuauacucugacuauauuuccucucugugauaccuuuuccuuuuucuaauguugauuugcauguacuugauuguucucuucuacucucugguuuaaucuucccccacauuccaauggcucuaaagccauuucuaaauaccauuuuucuuauagucaaaccuaucagauaaucuauuuuuccccaugauuaugcccccuagaaaucugccccuguacucaccccuuggccuguccuaggaauuccuucugucuaugguguaaaccaagaaauaggaagccuccaaaucuaggaaacauaggcucuaacaaucucacuuugauagaacccacauucuacuagcuuccugagaaagaaugcaugagagguaaauuuauuuucauacauuugucagucauccuugacugauauuuuaacaauguaaacaauucaagguugaaaauugcuuuccuucauaauuauuaucuucuaguuucuagcguugauuuguggggcuuuucggcuucucaaaguaugaguuaggauuguguuuaguuguagguaaaauaaaauccaacaaguuauaacuuagccaaauagggaaccugaccaggugcugaccacaccuguaaucccaacucuuugggaggccaaggugaguggaucugcuuugagcacaggaguuugagaccagccugggcaacauggcgaaaccccaucucuaccaaaaauacaaaaauuagccagacauugguggcuugcuccuguagucccagcuacauggaaggcugaggcuggacagucauuugagcccaggaaguggagggugcaaucagaucacuccacugcacuccagccugggugacagagugagacccugucucaaaacaaacaaacaacaacaaacaaauagacaaccucccacccccaauguaacaagaaauccagagacagguaguugcugaaauugauucagcaguucagguauaucagagcugagaacucugugauucucauggucgcaaaauacuguagcuccagacaucuuguucagguuucaaaugagaaaaaguagaagagaaaggagaagauucaacagauuuccacuuacauuuuaugggccagcacuuuaccacacuuggucauaucuaacuacaaaggaauugaaaaaaguaagcuuuuagcuuuccggccucuacaaugaagaaaagcaaggguugaaagagacaaacuggaauaugagauaacauuacaaugugcuuuggugugcgucuuuucaaaaaucuuuugugcugggcacucuuugaguccuucuaaguuugaaacacauauuuucaguccuagcaauuuuccuuuuaaaauuuaguugauaguuuuauccuuuuuguuuuuucauucucucuggagagcuccuaaaagucaaagguugaacuucugauacugaucaucuaucuuuuuucuccuauuucccaucucauuaucuuucacuucuuuuuuauuuuaaguuccgggauacaugugcugaaugugcagguuuguuacauugguauuauuuuuuacuucuuuuuuaggagacuuccucaucugcauuuaacccuuuuauugaauauuuuauuucuuaagugcuuucuuacucucuuauucuuccuuuucuauaguauuauguuuuuauuuuaugguugcaaaaucuucucaucuuucugaggguacugauuauaauuccuugaaguuuucuucuuuuuccugacagucuuucuucugagcuuuauuuuguuauuguuauuguuuauuucuuuguuaguuuugaucucuuuuccuguuggaguuucuccuuaauugacuggugauaauugauucugugucauaucuaagaaugagguacuagaagggugacuagaagcugcgugcauguggccaaagcuuaaugaguaguaagcuuuacuaaaggacaaucaggaagcccguuaguuuccucaucagggaagcccacaugucaguaucuacagaguuuuucucugaagcauguuaucccuucagagaaggaucaccuaucugaagagguguuaagagagaaaggcaguuauaagccuugcugcuacuguuguagaacucagcacaggaaggcagcuagaagucucaccauuaugcagaucacuuaauuccccucacuccuauccucccuacuuugcagucucucagguucaguucuucacagauuauacguuucauaugcagcagagacagggaaguggcaguuguuagugccuaguagggaugacugaaaaauauaauuaauuuuaaacaauucuuuuguuuguaugccacccacaucaucucucccucacaaucacacuccaacuuccauaauaccuaauuucugauuccuaagccuaucucagauucugcaggaugaaucaguuuguuuaucauugguauaucccucugcagauaauuagauuuuacauucuugcugcuaaguuaucuacaauucuuccauaugcuuucaauuuuccuauacuacagaugaagguuagagaaaucuaguuuuccuaaagauggaaaguaccuguugcuuuuguuuguuuguuuguuuuaagugauuucuaguaaagaaguacuuuuucugccauuuugaaacagguaagucucuaauuaugaauuuaaaacuugaagacauugauagauaugaacaaaauaugcuccagagcaaaacucuacccauuaacaaccagaucaugcacgaccagauuagaauggccauuauauuguugguuauccccauucugguaauaugacguagcagcuaagagcaugagcucugaggucagauugccuagccuuaaauccugucucuaccacuuuacaagaugcauaaucuugcacacauucuguuuauauuauccucuugaccugaaaaaauguagagugaugaugaggauuaagugaacaaaaugccuggcacacaaguauucaauauauacaaacuacuauuauuaacuccaacagaucaaauuuuccaaaguagugagaguaauaugcacuaagcgccuuacagauauuaacuuacugaauccugaaaacaauacuaugagguagggauaucaccgugccaauuuuauaaaagauaaaacugauagaugaacagguuaaauaacuugcccaaggucacacggccaaaaguagauaacagggauucaaucugaagaaaucugguuccaucgucuuugaucuuaaccacuuacaauacacagcccaaggauagcaucauucaaauuugaguccccagguucucucuagcucucuuauggaaugccaaguaaguuauauucgguaccacagacuaacuuaaaggaagauuucaaaacgacacugcaaaauuuggaccaaauuauuucuccauuuaacugccuucuauguacagguaguaguauagaauaguuguguacaugugaugcucauuuccauaaugaguaaaggacauaaaacauaaaaauaucaugcaguuuuuaggccuauugcucccaaaucauucacucugauuauauccuuuauuacagggaaauguguuuucuaagucuaucuucuuugcauggauugaaagauuugugaaacugaaaacuaaccuuccucugccaagagccccaucaagacagaaguucuuaauuaacuaagcaauuagucauaacaagugaaagcuaaaauggagcaugaauacauaauuugcugauuauuuuucuccacuagaacccuuagccagaauuuaacaaaaaguguucugugggugcuaguuuugggaaggaugguaaaaccuggacagaaugcacugaacagcuauuugagggcuccaaagaguaaagaauugcagauggauuggagaagaccagaauucaaaguaucagcagugcguuucuuguuuuuccuuaguaucccccagucuggugucuacaccugguacaccaaaaccaggaguagacaccagcauacaaacagagagauuuccagagaaguccucuagcucuggcucaacagguaggaaaacaaagagauuucuaacacucagagagagugggggaaauuccagguuuuucucuuauaucaucauuauuacuuauguuuucucucuuucaugccucagucuccaggccauccuguggcaguggcagcagcaacaauggcaagcaauggagugauucacaggugccugaaacuuggauagaaguguaguccacaagagagaggcaaacuccuacugcuuuuucucucuaucucuguuuaccuaccucuugaaccuaaacauggguacaacuacaggauguguguggcagagcaggauaacuaaaacuccaguuuguggccaaggaaccaaaaaauacuggggauauugcggagaaaggguugggauaugagcccguccugagcugcacauacagagauaugaucuugaacaccuaacaaagacuugagaaaugaauuaaacuacugaccacuacccagaucucagacuggcugcuugguugcaaauaugugggacagagcaaaagagcaucacagagcguuugaaaacgaauugacacugaaaccacaagccacugaaggcugaucagaccuuacaaccugaauucucuggguugauugcaugcuaaaauaaaaauaucaacauucaccauaggauguaaauaagacccagagucucauaacaugauauucaaaauguucagaauauaauacaaaauuacucagcauuacaaagagccagaaaaauuucaaauuacauagaggaagaaauuucacagacaucaaugccaagaugauacauauguuagaauuaccugacaaagaugucaaagcagcuauuaaaaacacucuugaaauaaauagaaaguuucagcaaggaaauagaagacgugaagaagaaccaaauggaaaauuuagaacugaaaaaugcaauagcaaaacuuugaaaacucacugaaugaguucuguaacagaauaaaaaugacaaaguaucaauaaacuugaaagcagaucaguauaaauuauccaaucuaaacaacauagagaaaaauacuuuaaaaaauaaauaagagccucaggaccuguaggacaauaucacaaugccuaauauguauaucaucccagucccagaaggagagaagagagaguauaguacaaagaaaaacaauguaauugcuaaaaacugaccaaauuugccaaaugacauaaacccagaaauucaaaaaguucagugaacuccaaaaagaauaaaccccaaaauacccauaccuagacauaugauaaucaaacuucuaaaaauuacagaaaauaauguuggaaaguaaccaaagaaaaaugaugcauuacuuacagggaagcaaugauuucaaagucugaggaucccucaucagaagugggagcuaagcuaugaggaaacaaaggcauaagagugauauaauggacuauagagacuugcgggaaaggguggggaagggggugaaggauaaaagacaacacaaugggugcaguguacacugcuugggugaugggugcacuaaaaucucagaaaucaccaccuaaagaacuuauccauguaaucaaacaccaccuguucccccaaaacuacugaaaucauaagaagaaaaauaauuuuuuuuaaaaaagaagucauggaggccagaagaaagugcacucauuuuuaaagcacugagaaaaaggaaccaugaaaccagaauucuguaucuagcaaaaauacucuucaggacuaacaaugagauaaagacauucuuacaugaagaaacacuaagagaauuuucauuagcaacagacuucucuacaagaaugacuaaaagaaaguucuucagccagaagauaaugaugccauaugcaaauguggaacaucagaaaggaagagagaacaacaggaaugguaaauuucuggguaaauauaauagacuauucuuucacccugagucauuuagaguauguuuaacaguuaagagcaaaaaacagagcauugucugaugagauuuucaaugugcaaacagaguccaaaacuaggccuacaaaaguaugaucaauggguuuuugacgaagguacaaaggcaauucaauggagauaugauaguuuuuuccauaagagguguuggaacaaauggacguuucgaagcaaaaaaacaaacaaacaaaaaaagaaccucacgcauuauacagaacuuaucuuaaaagagaacauagacauaaacauaaaacauaaaacuaauuuaaaacaucaaauauaguuuuuugaguaauaauuggaaaaaaucuuaguaacauuaguuuaggaaaugauacaccaaaagcaugauucauaaaaaaaauuuugauaaauuggacaucaucaaaauaaaacucuugcucugccaaagacccuguaaagaccaugaaaagacaaggcauagacuuggggcaggggggaaucugcaaaucggccgggcacaguggcucacgccuguaaucccagcacuuugggaggccaaggcggguggaucacgaggucaggaguucaagaccagccuggccaacauggugaaaccucgucucuauuaaaacuacaaaaauuagccaggcgcauuggcaggcaccuguaaucccagcuacuugggaggcugaggcagaagaaucacuugaaccuggguggcagagguuguagugagcugacaucgugccacugcacuccagccugggugacagagugagacucugucucaaaaaaucugcaaaucauauaucaaacaaaagauuuguaucugacuauaugaaaacuccccaaacuuaagaaaacaaacaacucauuaaaaaaaauaaauacaugauuugaaagaaaacuucaccaaagaagauacauagauacuagguuggugcaaaaguaauugcgguuuuugugauuacucuuaaugcugaaaaccacaauuacuuuugcaacaacuuaauaguaaauaaguacaugaaaagaugcucacugucauuagucauuagaaaauguaaauaaaaauccacaagaacaugcuacuacacaccuauuagaaugggggaaaaacagacaacugcagguauuagcaaguaugcagagccauuggaacucugaaacauugcugaugggaauguaauauuacagccacuuuggaaaaguuuggcaguuucugacaaagguaaacauucauuuaacuuaugacccaguaauuccacucuuaguuauuugccuaaaaggaaugaguauuuguuucacaaaagcaccuguacaugaauauuuacaguagcuuuauucauaaauaaaaaaugcauauguccuuaaacuggugaauggauggaacaaaacuaauuguggcacauucauacaacagaauaccacucuccaguaaaaaugaacuauugauacacacaacaacaugggugaaucacaaaugcacuauguaaagucaaagaugacagauguaaaacacuauauaccauauaauuccauuuauaugacauucuggaaaaagcaaaaaaacagggacagagaaaagaucagagguugccaaggauuagagcuagggaaaaggcugacuacaaaagagcagacugaaggcauuuucagagacaauggaacccuuuaguauguucauugugauggugguuacacgauuacauauuuguccaaacucauagaccuguacaccaaaaacaguaaauuuuauugcauuuuaacguuuuuaaauuuuaaaacaaauuuaccuauuuaaaaaaaaaaacaaagacagcaacaacuuaggaucccauauuaccaucacuauuuaaugugaucuuagacaaaucacuuaauauagagcuuugguucccccaauuuuuaaaaugaaaaauauaguauuuauaucucauaggucuuuauaaaaaaguuuuuuaaagguuucaagauccugccuuuucacauucuauuucuucugaaauguuucuucccauccucucuucccuacuuugcuuggcuaaaugcuauuugauuuucaggucucagcuuaaacguuauuuuuucauaaaagcuucuccuaacucacauuuuaaaucagggccucagcuaugccuuuacugcccaguguacucuuauuucauaacacuucucauguccuuuuuuuuuuuuuuuuuugagacagagucacccaggcuggagugcaguggcccgaucuuggcucacugcaagcucugccucccggguuccugccauucuccugcuucagccucccgaguagcugggacuauaggcaccugcuaccaugcccagcuaauuuuuuuguguauuuuugguagagacgggguuucaccauguuagccaggauggucucaaucuccugaccucgugauccgcccgccugggccucccaaagugcugggauuacaggcuugagccaccgcgcccggucuuuuuuuuuauuucaagagcuuaggcguacaaguaguuuuugguuaccuggcugaauuuuguaguggugaagucugaaguuuuaguguaccugccacccgagcaguguccauuguauccaguauguaguuuuuuuaucccuuaccccucuucuacucuccuuauuucugagucuucaauguucauuauaucacucuguaugccuuugcacgcccauagcuuagcucccacuuauaagugagaacauaugguauuugguuuuccauuccuguguuacuucacuuagaauaauggcccccaguuccauccaaguugcuacaauggacauuauuucauucuuuauuuuauggcugaguaguauuccaugguguauauauaccacauuuucuguauccauucaucagcugauggacauuuagguugguuccuuaucuuuucaauuaugaauuguucugugauaaacauaugcaagcacauguauuuuuuuuauagagagguuguacuaacuuacauucccaccagcagugcacaagcauucccuuuucaccacauucacgccaacaucuuuguuuuuugauucuuaaauaauggccauucuggcuuggguaaguugguaucucacugcaguuuuaauuugcauuucccugaugauuagugaguacaucuauagguaaauaauuuuauuuaaugucugucucuuucaugaaaugguaagcucugugagggaagaaauuguuaucagaauacaagcaguacaaagugucugaaacacuggugaauauucuguacauauuuuuaaacaaaugugcaaaaacacaauggcauuuccuauuguguaauuaauucuuucuuaauaucuuuaccuuucucacuauuuauauguauagacacauguaucuuaauguuuuuaucuuccucacccuguauauauacacauacauauauauguauguauguguauauacuaugcauaccaucaacaaaguuucuuagcaaauguccaucaaaagauaacaaauaauagauuaugccuugguugacauaccuguuuacuaacuuuuccucauuuguagucauuaacacuaauugaaccugacaaaaauaagaugugacagaccuacuguauauccacaagucaaauuaacaaauuaguugaagaaucaauacaucuacauaugagucuacuaacuguugggcauacauccagacuuacaugcagaaaagcacuuaagaaccaaaccuuuuucccucuuauauaagcugucaaaaauguuacagaugugacauuuaagaaacucagagcaugacuuauagauuaccuuaugcauaaugguaaaaauuccucuagaacaaccagcaacauuaauaauuaguuggaacucaauuacggauacuugccaaagcaaauccccagaaagcuaucuuguaucuuucaaccuggccuuguagaaaugaucuaauguagcauccuacaguguagguacgugggguauuaauaucccacccuccuugaugggucaguaacugaaacagugaaaggcucaaugaagaucgcagcacuaauaaacgaugggacagguauuaauacugcaaugccgcacuguccaauaugguaaccacugagccacauguagcuacagagcacuucaaacguggcuaauccaaaucaagaagugcuguaaguguaaaauacacaccagauuucaauacuugguacaagauaaagaauguaaaauucucauuauuuguuuauacugaauacauguugaaaugacuauggguuggauuaaauaaaaucauuauuaaaauuaauaucaucuguuucuuuucacguuucaaaguguaguuacuacagauuuuuaaauuauauauguagcuuguauuauauuuccagcggcaucaugauagagcacuccuggaucaguaugguugaauaauagaagacauguggaggcaaacauuuagguuuacuucccagacucuaccauauacacacagagugacuuugcagaagauuauuguauaucacuaagaugacuuuucccacauuuaaaaucagaacauuaaaucuaugauacaguacuaguacgagguuaaauaauacauuaaaggucuaauaauguauucuacaaugaauagccacuugauguuaauuucucuuuuccuccuuuuuccuaauccacuucccuguuaauuuaagcugcaguuaaacuuccauaguggacagauuaguccccaugccuacuauucccaguaccucggucuagguuaacacaaccuccaugaccagaaaaccagguacagaaugguggucacugaguagcccaaaguagguaugacacaaguaugaccugucuguaguuuggcauagucuaauacaaugggcucaaauagugaaaaacagcauaucugcucccuucagaauucauccaagaaacagagacagacugguuaauaacaaaaggguaauggaagcagacguagaaagagacauagaaguaacaagauggaaaagccauucauuuguucacuccacaaauauuaaugacugucuauuuauuacaugcuauaugaccugagagaggaaguaacaggggaauaauucccagagcuuuauaagacccagacaacuuccaguuccaguccaaaugucucuuuacaauaaauauuuuuucuuuagaugaauagaugaaggcucugcuccuugaaacuaaaaugaccuaacuaacguagcuucacaaaggaaggcacagaaaagugccuuuuuguuagacacucacacacacaaagacaaaauauguauugcccuagguaauaaaucaaacaaaaaggguucuuccucaaagugggccauuccuuuccuaaaaccaguaacagacagaacagaaaacaaguggagauagcaagggcuacugacccuuaauauuccuuuagaaagccacuaccagaaauacacuuuuaagugccuuaccugcacugcauagaaauauguaggcaaagagaaaaaagaucggccaacuaaaacuacagacuauaaguacuuauuaaagacuacuuucacuaacauaaaugggauucacuacaucagaguccccugaucacuuuuugcagggcagucugugggccucacuaaacuaauuugcgauauuaagguaaggaaagaagaauuuccucauucuaaauguauuauuggacaggcuugaaguccaggucuuaaguaugguuacauaagggacaacaauaacuauuuguuucaaauuguaucucuuucaauaaaacaauaucucagugguuucagcagggaguacaaaaucugaucucuuaacccuaaaauuccaacccuggaaaaauggcucaccuucgccaaaacacacacacacacacacacacacacacacaacuagagacugauuuuccacacaaaauuuauguacuuauuaaaaaggaauuuacuuuauaauuaugugcaagaauuaucauggugagaagugaauguugguuuuaaucauugccaguagauccucccaucagccacauaaucauauucacuuuauggaggaagcacuauuacuccguaccaagcaucuuauauaauauagcucuuuguuuucaucccugugacaaaccaugugagauggcugugugacccuuguuuuaaaaacaaggaaacugacugcuggaaagguaaguaacauaauuauccaagaucuccaaccuaacaaaugucaaaguaugggagcugaccuugggcuuuuaugcucuuguccacaauaauccagagcacccagaacauuuauaucucuaagaaguuaaguuuagaaaaaugcaucuuuuuuugcauauaugucaccaacuucggguauuucuuauuacaagagaccuuuuugcuuaaagauuccaaaucaaucacccaucauuuuucuaacacuauaaauucuaaaugcaaaugucaacuaagaaaggucuaugaacauuuuaaaaacucauuuuccccaaauccauaugagucugaaugcugagaaauuccacacuaaagguagaauacuuaacaaaacaccaacauuucccuucagaaauaacaaagggaaauauaaguuugugcucacuuuuucauaaugucauggcauguuaaaagaugaaaaccuaguaacaaagucaauuaauagaaucuacaaucuuuuuaaaauauuuuaguagcuuaagaagcauauuaaaacuagaaccuaaauauuaggcuggaaucgugguacaucuuuagcucuuccagaaucauacucacaguggggcucacacuguauuuuaauaagcuucuaggugggcccauucaucuagcagcuuaaaaccuccccaggugauuccaaugugaacuccaggcugagaacugucauaguugaaaaccacuggacuggcacaugagagccugauuucugcugaauguccuuucuuugagcucuucucccccaguccuaugaaaagcauggucgcugauuaacucagaguuaggugaagaaaaucaaacuuggagagauaauuauaauagauaccgugaugguuaauuuugugugucaacuugacuaggcuauggugcccaguuguuuggucaaacauagccuccauguugcugugaggguauuuuuaaauguaauuaacauuuaaaucaguagacuuuuaguaaauuagauuacccucccuaauguagaugaggcucauacaaucagucaaaaucuuaagagcaaaggcuaagguuuccagaagaggaaggaauucugcuucccaaaugcaacacugaaacucuaccuggcuuuccagccugccuggcaugugcuguagauuucagacaggacugcaacaucaacucuuuccugaauuuccaggcucccagcuugccuuacagauugugaacuugccagcucccauaaucacaugagcguauuccuuaaaauaagucucuuucucacucgcauucaugguguguguguguguguguguguguguguguguguguguguguguguguguguguauucucuuguuucaauuucuccaggggacccuaaugcuagauaccauuauuuaaacacagacuauguacuagaaaccaugcuaaauuauucacauacauuuucugaguuagccuuuacacaacccaauuaaacaguugaauaagcaagcuauaaagagaagaugugaccagagauagggaagcuuccuuuaguggcuguggagagcaagcaguacagaaguuagcacuaggugagccaagaaaaagccaaggacaaaagaagauaagguguucauugaaaaaaacaaaagacaaaagggaaaggggaaaccuauagauuuaaaaauacagugcccaccauaggaaaccauucuucuacuuucugcuuuuauugcuuugacuuuuauggacauuacacuuaaguggaaucacacaacacguagucuugcaucugacuccuuuaaagaagcauaauguuuuugaaguuuauucauuuuguagcgugcaucaauagaucacuccuaaaacuucuugaauauagaaguggaaucauguaguaguaggucuauguuuaaacuucaggaaacugugaaagcaguuuuccaaagugguugcaccauuuuauauucuuaccagcaaugaagguuccacguucuccauaucaaugccaaaauuuauuauugcuaacuuuuuaaauuauaaacaauugagaguguguguguauguguguguguguuugugugugugcaguguguacuauauagagguuguuuauaucucauugugauuuuuuuaaaauagagacagagucuugcuauguugcccaggcuggucuugaacuccugggcucaagcaauccaucugauucugacucccaaaaugccaggauaacaggugugagccaccaugcccggcccucguugugauuuuaauuugcauuugucuaaugacuauuuauguugagcauauuuucauguguuuauuagccauuuguagaucuucuucagugaaaugucuauuagaaucuuugacuauuuuaauaaacuuuggauauugguacuuauuuuaauaaaccaacuguaaaauauguuuaugauaaaauuguggaaauuuaaacauucaaaggauacuugauauuaaggauuuauuaggguuguuuuggguuugauaaugcuauugcaguuaugcuuuuagaaaaaaaucuuuaccuuuuaaugugacacacugaauaauuuauagaugaaauaaugugaggucugugauuugcuauaaaauaauccagaggagguaggggaauuuauauaaaagauuggccauauguugacaacugauaguucuuggagcugagaaaaggauucauggggacucauaauacuauguuugaaauuuccauaauagguuuuuuuguuuguuuguuugagaugcagucucgcucugucacccaggcuggagugcaguggcaugaucucggcucacugcaaccuccgccucccagguucaagcaauucuccugccucagccucccaaguaacugggacuacagguguguaccaccaugcccggcuaauuuuuuguauuuuuaguagagacgggguuucaccguguuagccaggauggucuugaucuccugaccucgugaucugcccaccucugccucccaaagcgcuaggauuacaggcaugagccaccaugcccagcccacaauagguuuuaagaaauaaaagcugacacaccgaaugcaugcauuaaccuacauauacacucucucaaaaucuacuaaauacaccguaaagggauuuuuuaaggcauaagcaacaagaagaaaaggaaugggaaugaagacaacagcaacaaaacuuuggaagcuagaaaguauauggaugaacaugaaccaacuugagaaaccugaauccccaaccagaaguggaaaaagccaagaaaacaaccugauuuacacaacaaaaaucuucaaaggguuuaggaauagguggcaucagguacaucucuggagauaaguuugaagguggaacugaacaccaaggaauaacugaaaguagauuuaagaaaaugaaccuccagauauuuuacuacacucuacacagccaaccaaccaccccucuccuacuccagcaaaugacuuuggcuuauuuucugcagagucaaagagagguucucugcgaugaagaauccaagcuacgguugaggguggggacaaaauacuaaaaugaagaaaauaaguaaaagucuacagauugaauauagagacuucuuccucaguucagcucccagaaugcuuauagagaggcuaaaagauuagaagaaucuggauguccaacaagaaagacuaaaagaugcugacauuagaggaccccccaccaugucugcucacuccacaguaauaagcuucacccacgcacacagaguucgcacuagcuuuacagagcccaaccuuuucuucugagucauuaauugguagagauaacuuauugggguucaggggguugauuuaaaaauugagaacuauaggccgggugcaguggcucacaacuguaauccuagcacuuugggaggccgaggcgggcagaucacaaggucaggagaucgagaccauccuggauaacacagugaaaccccgucucuacuaaaaauacaaaaaaauuagccgggugugguggcgggagccuguagucccagccacucaggaggcugaggcaggagaauggcaugaacccaggaggcagagcuugcagugagccgagaucgcgccacugcacuccagccugggagacagagcgagacuccaucucaaaaaaaaaaaaaaaaaaauugagaacuacagaaaaaguuacagauuuaugacuauaugaggaaguaaugaaaagccauuucaugaagcaguggugaaucaaguuuuuacuauauguuaccucuugggagaauaguuuauacuaaauuacuuguuuuauuaaaaaaagaaacuaugccaaaaaagaaaaacaauauaaauggucaaaucuaauauauuuuuggcuuucuuuuugacaaacugucuguaaaaauggugucuauuguucccauauuuaugaccauguguauccaauguuuagcaccuauuuauaagcgagaacauguguuauuugguuuucuguuucugcguuaauucacuuagaauaaucguuuccagcugcaaccauguugccucaaaggauauuauuuuguccuuuuuuauggcuguguaguauuccauggugaauauauaccacauuuuccuuauccaauccaccacugacgggcaccuggguugaucucaugucuucgcuccugugaauagcacuaugauggacauacggagcccaacuuuuaaauacaaauggacaaccaaggaucacaggacauuuuagaaaagccccaaacaugaaaaaugaaggcugaaaagugaaaaccugaagagauuuguaaaauaaaccuaaguguuagauaaacugacaaaauuucccagaaaguaaaguaaaaagauuuuuaaagguacaaauggacgagcgcagugacucacaccuauaaucucaccaauuugggaggucaaggugggaggauuacuugagcccuggaguuugagaccagcuugggcaacauagggagacccccaucucgaaagaaagaaaggaaagaaaggaaggaaggaaggaagggagggagggagggagggagggagggagggagggagggaaagaaaagaaaagaaaagaaaaaagaaaauuagccaggugugguagugcacgccuguagucccagcuacucaggaggcugagacaggaggacugauugagucugggaggucaaggcugcagugagccauggccaugccaccgcacuccagccugagcaacagagcgggacccugucucaaaaaaaaaaaaaaaaaaaaaacaagguacaaaucgugcuugauuuaccaugguucaacuuacaauuuuucaacuuuaacuuggugcaaaagugagaggccuucaacagaaacuauaccuauacaaccauuuuguuucaguacacuauucaauaaauuacauaagauauuccauacuuuauuauaaaauagucuuuguguuagauuauuucaccccacucugugauccaacaauucauuauauccaacaauuuauuauaaauauauaauaauaauaauauauccaacaauauauuguuggauauaauaaauauccaacaauuuauuauaaaauaggcuuuguguuagaugauuuuggcuaauguaagaguucugaacauguuuaagguaggcuagacugagcuacaauagucaguagguuagguguacugaaugcauuuuugaauuaugauguuuucaguuuacaauggguuuaucaggacauaaucccaucacaaaucaaggaccauuuguauaauaguuaauuuuauaugucaauuuggcugauccacagugcccagauauuuggucaaacaugauucugcauguuucuuggcaaacauguuuuucgaugagauuaacauuuaaaucuguggauuuugaguaaagcugauuauucuccauaaugugggcaggucucauccaaucagucaaagaccuuaguagaacaaaaaaugaccacccagaagcaagaaggaauuuugucaucagacugaaauauguauuagucaggguucuccagagaaacagaaccaacgggauagagaaaucuagaaaaauaauuacuauaaguuaccuagaggcugagaagucccauguggcgaaaucuccacaaacacaugaaccaauuccuuaaaaucaauccaucaacccccaacccguguguguguguguguccuuucgauucuauuucucuggagaaccuuaguaauauaggauaguaagaaauaaagcauuuaaaaaaggaaagucaaagccaggaggucaacaucuuaacaggauauccagaaagacagaacagaaaaaacaaacuugacuaaaucaaauaaauaauucaaaaaacuaccccagaacugaagaacaugacuuucuggauugaaagggcccacagaguaccaaccacaaaaaaaacagaaauagauccacaugaacuaccugcuuaacacaccagcacaccucccucuaagaaggccaaaacccuuacucagaguaauuggccuacaauuucagccucuuuucuauggaguccuucgguucuggaaaauacuccugagauugaugaauagaaaagaaacaagagcaggcaggacucugggccaucugccccugcuucauuuauagaagcccugcuuuuacguuucauauucuagauuuuuggauaaguuuuuuuuuacuuugcauuuuugcauuggcuauuuuuuaauuguaucucuuuaagguauauaacaugauguuuugauauauauacacauagugaaaugauuacuguaaucaagccaauuaacauauccaucaucucacacuguuacucuuuguaugugugugguacaaguaccuaaaaucuacucucuuagcacauuuccaguauacaauauuauuaacuacaguccucaugcuauacaguaaaucucugugcuuacguguccuacauaacugaaauuuuauacucucguugaccuccaucugcccauuucucccacacccuucauuccugguaaccacucuucuauucucuguuuccauguacuugaaguuucauuucguuuuguuuuguuuagauccuacaaauaagugagaucauauaguauuuuucuauguuuggcuuauuucacuuaguaucauguccucuacuuccauucauguuguuacaaauggcaguaacuccuucuuuaaggcugaauaauacuccauugugaauagagacaccacaauuucuuuauccauucaucuaucaauggacacuuggguuguuucauuaucuuggauauugugaagaaaaccucuuucuuuuugcucuuuaaauauauaaagagccaucucuggugcaaauuccaaaagaaccgcccaugaccaagacuauuccugcuggaucacaccucauccuuucccuagcucccaacaaugacaucuagaauauuauacugaauuacauuucaggccuuuguggucuagccuagaacuuaaaugugccuuaagauccaaacaagcagcuuuuaaacaaacuuuuggaaaaugcucucuauucauaaauggaagcucucugugccuacggaauagaagcaaauucauuuauuaauagucccuaggucacucauaauuagugcaaaacuagucuguuaacuaggcaaccccugaggcuucaggaaguaauucauuuauguguuuguuuuucuucaauauuuauaguuguugucuugcacaaaaaucuaucucacagagaugucugaaaucucuucacuggucauuaacuacucugauaaacauuauuuacuuuucucuuaaaacauauaagagaacuagagaaauucugaaaguaaaugagauagcacaaaaaaaagaugaaagaacacugaagauaacuuugguauauuuuauaaaucuucccagagucucggcuuauagcuggguuuaaugccuugacacauacauauuuaucaaaauuggcagaguaauaaaaucaggugagauaaaaacugacaugaacacuacaaauacaaacuuacuauagcuuuuuucaaaauuauauucaaaauggaagcaucuaacugaaaauuguuacuuucauuguacacaaaaugaguauauguguauauggguauauguguguaucucucaaaugcaucauacuagcaaauuugagcaauguuuuucacauucucauuuaaacauaacuaaagucauccucaguggcuaccuaaucagccuaauuacucugggaauuacuauuaaacuagugaaagccacacaaaagauugguguaaacuauuccagauucaaauaaaacauaucauuucuauuuuuccauucacagcugccgaggaacaacuacacagucagcagcuacuagaauaaaaucuuacaguccauucaaaucuaaaaagcaacacugugcuuauuuaacaaacaaguaugcuauuuaucuaccauacuagugcuuagaacaaggacggggagccauuuuggcuauaaaguuuagacagcuucaagaugaaggucugagcuaagccuuaaaagauagguagggauauagaaaggagagggaagaggaguucuaaacgaggacauaaaguuugaaaauuaaaaguuaaaaaaaaaaaaaaaaacccugaaaacuaccauccagcaaacaguuuucccaaaugcagaguucuuagaagagaaugaugggaaauaagauuaaguaggugaaacuuacacugagaaauaacagaaauauuuagauagaaguacaaugauggaaggcauaauuuuuucaguguacaugugcauauuaaauagcaacacauauaaagcucuuagcacaguaucuggcccauaaggcuaaacaaauauuugcuauuauuguuguuauuauuauuaacugaaaauuucaaauaguauuuucuguaguuuggacaacuaguaaauaugacuaccccgauuuuuaaaaucuagaauuaaacauuucuauguacuucuuaauuuuauauacaugaucucaccacaaagcccucaauauuacucaaaaggcacaucuuuauuucccuguacuucaaaucaauuucuaucuaaacagaaauucagcuuggucuuuccccaggcaaugauaaccuucucugacacucucuaaugcugauguccuccaaacaggacuuucuguccuccaaaaagaaaaaaccuuccccaaggaacagcaagaaagaaggaagcuuuauaauagaugaauuuauaggcaagucugucucuuaucuaacuucugugaguguccagcccugauccugugucuuugguuuaaaagaaaaaaagcccuggguaagccaagcucagcccuaggcauccuccucuucuuccuauuuuggcccuggcuuccaugacccuaucuguuuucuguaauuugcuacauauaauggguaaauauggaacaacgaugaagaaagcaaagauuggaggggggagguugccaaacugcucuccgcuuuagccccgacuuugauauaagaaggcaggagagccaaggauuaauaucagaggugguuuuucauuuuucauaacauuucagagccugaaagacuguaacaagauggugaugaugaugaugaugaugaugacgacaacaacaacaacauuucacauuuauuuaggcuuucacuacauaaucgcaaaaacacuaucucauauuaacaagaauaacagcuaccuggagaucaaugagucuaguccucucauuuuauagguuagacaacuuaaugaagucagagagauuaauaacuuugccaagacuacaaauuaguggcauuggugauaauaacagugaugauaauaaugauggugaugguggcagugauuacguuaauaacccacuaaauucuuugugugccuugucucauuuaauccuuacagcagcccuaggagggaaguacuauauuuaucuuaauuuuaagcugaagcaacuaagaauuuaaaagaucaaaaaacuugcccaaagucacacagcaaauaaguggcagaacugagauucaaaaagcagauggacucaaaaaucugucaaguuaaaacacuaaacuacacuuccuguaguuaaaauuacaacucgauucuucugacucugauccuaguuuaauauuguuucccucauagccugucuccuaaauuuagugagguauguguugaaauagaaaucuaauacguauugcauuuauuuucuaauauauuaucuguuaccccuacaaguuuaauguuacagaauauagauccaucucuagcuguaaaaauauacuaauauauauuauuaaguaauuagcaauaguauucauuuuaucaauaugacauuuaaucaauuuuaguuuuuauaagucagaugcacauaguuuauuucaagaggaaaaaaagucaucucacuguuauauucuugcagaagauugcccuguccuaaaaucaggauuauuuguagacaauacaaagcagcuaaacuagcuucucuuagaauuuccacuguaggaaauaaauaacaauauacacuaaguuaaaaauaauaaugcccuuguuauuuauaaucuacccucagggaauuuuaaagcacuuuucaugucguaacagucuuaaaauguuuccaggauauggauuggcaaaccaaaguacuguaaaaagaauugugauuuuuuuuuuuucuuuuagauggaaucucgcuuugucgcccaggcuggagugcaguggcacgaucucggcucacugcaaccuccgcuucccggguucaagcgauucuccugccucagccucccaaguagcugggacuacaggcaccugccaucaugcccggcuaauuuuuguacuuuuaguagagaugggguugcaccauguugaccaggcuggucucaaacuccugaccucaggugauccaccugccuuggccucccaaagugcugggauaauaggcaugagccaccacuccuggcauaacagugaucuaaaaaucuucuauauggccaugugcuguggcucacgccuguaaucccagcacuuugggaggccgaggcagguggaucacaaggucagguguucgagaacagccuggcuaccauggcaaaacccugucucuacuaaaaauacaaaaauuagccagguaugguugcaggugccuguagucccagcuacucaggaggcugaggcaggagaaucacuugaacccgggaggcggagguugcagugagccaagauagugccacugcacuccagccugggcgacagagugagacuccaucucaaaaaaaaaaaaaaaaaaaaaaacuaugugaaguagcuccuugcacacaauagugacaaaaauauuuagcauuuauucaaagagcuauaauuuccagaacucuuucaauucuuacccuaauccugagaagcaagcagggaagauuacauuauccccacauuaaaguuaaggaagaacuaugauucauaauggauacuugucucagccaaaaucacagucaccaagaggcagagccaggauuagaaccuuggucuucugacucgugaguccuauauacuugcuacucuacuugaucuuuauuucuuauauaaaagaauguucaguuaauguuugacaaaugaacguaugcaaugcaugagcaaaucacauuucaucagaaagaaaugcugaauuucuaaauuucagaccagcauuuugccauuauauaauuuuuucucuguaacuauacuuuuuguuucugaagaaugaggcuguccccucaacaaguauaauuauccucuagaaaagcaaauugucuuugagcugauaagcugauaaacagcuaacacacaaaaucacuaaauuuuucuagauaaaaaucacgaguuaaaaaaauagauauaucuucuuagaaauauaccaagaaaaccaaaugcuauaacuuuuaacccuaguuuauagcauagcuaaagaacaauuacuauauaaacuagacacaguuuuggaaugaaugaaugaagacucauuuauaccaagaaggaagaaaagaaucacaacacaguucacccaugauuucacaucuauuaaguagaaaauauuaucauauucucacaacugucagccugugcugccagacuucacauuuagcaauuaucucaacgccagcuguccccacaauuucguuucaaauuuaauaugcccuagaaaauauuacauuucaaaauuucuagcaauuugcaaaagauagagacagaagaggcagccucuguagcaaaggcauguguaggcucucugcacacugugggaacacacuggaauccuauaguggacauuuguuaugugccccccaacccucuccaggauuauucugggucuucugguacaacuccaaaaccucauuuagauaacaccccucccccauucucaguccauguagacuggaugaggucuccuuacuccacucaacaaagccaaaaaugaacauaagacugcugaugccaacaucagugcuuucuacuacauuaugcuucauauuacagugacauuuauuguuuugucugccuaacacaacauucccuucuuauggaauggcaacuaauggcuaugugaucaagcugccuggguuugaaaccuguucccaccacuuccuacccaugugacuugauccauuuauuuaacugcucuaagccuccauuuccucaucuguaaaacaaagauucauucacauauucaacaaauauuuauugaacacuuauuaugauccaugcuugugcaagugcugagauaagaauagugaauaagauagaaaaggucaauauccucauggagcucagauauggcaguaaacaacaauaaaccaacaagagaggugcagauuauaagcgccauaaaagaaauaaauaaugggagaagauaguaaaagagugauucuagauccacuuacauagaaugugcagaauuucaggauaaagaggcuuucaguauaaagccucucugaggaggugacauuuuagcugaaauauaaaaagaaagaauaagccaaccacucaaagagaacuggaagaucauuccaggaagagggaaagccagaggaagaaaagagcuuggcacaaaaggacaucuagauaacugaagcauggcaagugagaaggggguaaaauaacacaagacgacaucagaaagcuaaacagaagccagacugugcugagccuugcagguaugggaagaaauugagauuucauucuaggagcgagcaacggaaauccauugaagugcuuuauuuaaagcuuuguguuuuuaaaauguuauuccagcuacuauggaaaggauggauauggaaaagaagagucaucuauucaauauaguuaagaggauggauggaagagggaaagaaggaaggaaucagggaugauuucuagguuacuuggguugagcagcuguguauauggugaucuauugauugagacuacaaagauuaggcaaaagucaggguucaagaauuauuacauuugagaugccuaucagauccucaaaauagcuguuauacacuuuuuuuuuuuuuuuugagacagagucucacucugucauccaggcuggaaugcagcggcaccaucucggcucauugcaaccuccaccuccuggguuaaagcaauucuccugucucagccucccaagcagcugggacuacaggcaugcaccaccacgcccggcuaauuguuguuguuguuguugcuguuguuguuuuuagagacaggguucgccauguuagccaggcuggucucaaacucuugaccucaagugauccacccuccucggccucccaaaaugcugggacaugagccaccaugcccagcccugugauacauauuaaaugaaauaaucuauguaaaaagcacaaugccuaaugcagaguaaacauucaauaaauguuagcuauuauucauguuuugagaaaaagaggaaaguuccuuccuuggucuacccaugugguuuugguaaugacugaugacuuuaucuuaucccaugacccagcuagggcauuggacaacuaacuggucuagaugaaaccaacaagaaucacacucucuuagcuguggugauugguccaucacucaagccacaccaacuuaaguucuucccuaugauuuucaaacuagaagcugaaagggaaguuccccuuccucuucaguagggacccuguaagaguccagggaugcugaugguaaaguuccuacuucuaggagaaaugcccucuguaauuggagggaauaaggcugauacccagagagaagcacagaugagagacagaguacuagaggcagagagugcuuauuucuaguaauucuaggguagugcuguccaauagaagcauaauacaagccacauaugaaacacuaaaaauagacagguaaaguuaauuuuaauaauacauuguauuuaaaccaauguauccaaaauaguaucaugguaauaugcacucaauauacaaaguugccaaauaagaaugauacaauggacuuuggggacuccggaggaaaaaugggagggggggagagggauaaaagacuaugaauguggugcaguguauacugcucgggcgaugggugcaccaaaaccucacagaucacacuaaagagcuuacucauauaaccuaauaccaccuguaccacaauaacuuauagaaaaauuaaaaauaaaaaaaaauaaaaaguugccaaguguucaaaacccaguguguaugguaaauuugaacucagacuagccauauuucaagugaucaagagcgauauaugacuaguggcuacuguguuggauagcacuaccaacacuaccugggcucuacccaggcccuuugcaggccauaagccaaugcaugcccuuguaggauuucauuaauuuaaguuggauuugugucucuuaucccgagaguccuuaauuuaccuaaaaacauuauuucacuuauuccauuuacaucugaaacccuaauaauucuuuuuuuuuuuuuuuagauggauucuugcucugucacccaggcuggagugcaauggcaugaucucagcucacugcaaccuccaccuccuggauucaagauaaucuccugccucagccucccaaguagcugggauuacaggcaugugccaccaugccucaguaauuuuuguauuuuuaguagaagagggguuucaccauguuggccaugcuggucucaaaugccugaccucaggugauccgccugccucagccucccacacugcugggauuacagacaugagccacugugcccagccuaaucauuuuuuuagaaaucacacacaguacauuauauucugaaaauugauucaccaauucuuauuagcauaaggacuaucaccuauuucccuacuugagugccaacucccacuucacauaugcacuacaguuaagacucauuagaccucuguauuccagccuugauuagcacaagaaaccauaauggagcaucugcaaacaagaaucaaagguacuacaagugauaacucugauugaguugaucugagguggaaucugggacuccauuuuuuuaaauguuguccuaguaauuuugauaaucacccagauucaaaacuaccgaguuggaucacuuacuaaaucuaaauagcaacuucugccccuuauuuaccuuuucuauuguuacaaguauuuccucuguuguauuuacugaagcgcauacuauauucaccuuuguauacuuaauuccuaaccccuuaauggauauacuucaaauauucaauaaauauuuguugaacuaaaagaaaaacuuaaaguggacuuuuaauaugaugcuauuuccaauaugauaucuaaaauaguccagagaaguagugggagauaauaagaguacuaaguuuagguaauggccuaucucuccuucuuucuguucuaauuuuaauuagcucucugcuagucugaauugaggguaaagggaguuaauuguuggauuacucugacuacaguuacauuaaaaagaaagugcccuguggccauauuaagugccauguuguacccaaauguccaccuguaguuagauaauuuugauuuaauugacuucacucacauccagagaccauggaagggaguggaaguuuggucaauuaaaaaucaagcauuaagaaugccaacugauuccuccugagugagaauuagagaaaaggaauucuaggucugugggcacagggaaagacauaccaaagcauucauaaauggcucuugguuccucaccuccuucuucucuuccacacacacauucuaggagguucaauaaagugcuguaauguguuuugcacacagaagguacucaacaaaguuguaucaguugcuggggccauaaccaaguauuacaggcugggaggcuuaaacaacagaaauuuguuuucucacaauucuaaaggccagaagucugagaucaaagcauucgagugguuaguucuugcugaggccucucaaucuggcaugcagauagcugcuuucuuccugagucuucacaggguuuucccucuguguuugucaauguccuaaucuccucuucuuauagagauaccagucauauuggauuagagcccacccuaauaaccccauuuuaacuuaauuaccucuuuaaagacccugucuccaaauacagucacauuauaagguagaugggguuaggagagcaacauaugaauuuaagaagacauaauucagcccauaacaaguaccgucuagguaaccacucuaacagagguuagaugaauccaagaauagcugaaucuugaagaggucauauagaguuauuugguuucagggauauguuaaacaugaaagaucuaaaccagcgguuucaaacacuacuguucaacagaaucgauuaugggguauguuacaaauuauggguguucuggccacacucagaaauucuuaggaguagaccaggcaucuguauguuugcagccuggaacaaagucugguauugacccuaaaagacaugucaaccuagacagccagcaaugaggcaagaagcaggacuggcaaugaagaggaaaagaccucacgugaauaauguagugaucuguaucgcuacauucucuucaucauuaagucucuguuacccaaaauucacucuaauaccauauuacucucuuugugacuuuguccaaacaaagucuucccaaagacguaaugcacaaugagaagucuaugcuuaugauauuuuucagaggagggcugguuagaaucacaaaugaugaucauuuacuucacaccuaauauaacucauucuccgcugaacggaauuugguugauugacugauuuguuuaggccaauggauucaaggaagugggccauauucaucucaucuucuucuccuuuaagcugccucugggacaaguugacacacauuuucaccacucucuagucucaugguugauuaauaauauccguauaauuauauuucauccuaucauuaaacaguacuggauucaaaguaaaacucagugaaauaauuuggcacaacugcuuuuaaaaauuauauuuuuguauuuucuccuucauaugcuucuuuauucuaucucugccuuccauucaacaaauauuuauuguagugccgggaguaugggaauauaacaauaaauaaaacauagccucugcccuucagaaaaguaaagucuagaaaagaaaaaaagauguguaaacaaauaaccacaagagaaugugccauauuauaacaaagauacacauaaggucccauggagcacagaguagagaacuaacauugccugaaggcagagcuuacacacaaacugaaggauacagucaaguauccaggcaaggacacaggacaagaacaggcauuaaagcaagaaaaugcaaggcaaguuuagggaacagaaaauacucaugauggcucuaacaaaaggcuuguaagguugggacucauggugggccuuccaugcuacacuaaauaaccagcacugucaggggaagucacugauaguuuuuuaagcaccaucaguucuguguuuaauuucccccaggcauaaaauuuuccugaggcugucugcugcuccccacuccccagcgugcgccccucuuccacagccccaugccgccugugcuguagcaaucagaaguacuuacuguucucuaaauaugccaggcauguucucacugacugcuaaugucaaaagcaugacuugaaaaacaucuaaaugcaugaucagaccagugauagcaacccuaugguggaguuuucaacaguuaauaaggggagcaauauugaaucauuccaguucucuauauuuugucauuugcuguuccugcugcuucauggaaaaggguuauauuuucucuguaaauagaacuugauauaucuucauaaccgucagcagggauggacacugugcuacuucccagcaaaaggugaaugaaaagugauagcaguuaaaaugguguucuuugcuguuucucuguuuuguuuucauacucuucuuuuaaaaucagacuguaauuuuaacaagguggcagguaaagcauuccuuuuugcuuuuaaugcugccuggaaauaauuuguuuucuccucuccagagaaauucuuaaaaaaaaaaaaaaaaaaaaaaaaaacuguaaaaaccugacuguucugauacaaaccuuguuaauaggauguucaccuuaaaacuaacccaaaagaggaacaaguaaagcaacaugauaacaaaucacagaauuuuagaaaggacuaagagcaaauguaguggugugguuaaaagcuaugguuccuuugaagcucaaauuaagaagaaccugcuaguacugaucaucuagcauccuaagugggaacauagcaaauagacauagaauuauaacccuaagaguugaaaucagaauaauagcaccaaugaacuccucaaaucauuuuuuaaaggaauauauuugugaggcaaugcaagugaaaauuacauaauauacaguuacuaaauuccugagaguucuauuuuuguuuauucaauaucuacuaauauaaggacaaaaaucauugcuaaugaucaaaagagcauagcaaucauuaucaaauuaagaggccaggcaugguggcucauaccuguaaucccagcaauuugggaggcugaggcuggcagaucgcuugagcucaaaaguuggagaccagccagggcaacauaguaaaacccaucucuacaaaaaaauauaaaaauuagccaggcguggugaugugcacccauugucccagcuacuugagagucugaggugagagaaucacccaagcccggggaagucaaggcugaagugaaccaugaucacgccacugcacuccagccugagcgacagaaagaaacccucuccaaaagaaaagaaagaaaaauuaauuaagaugugauucaauacauuuuuuccaauucuuuaaguuauuaagaagccaaugucaaucucucauccacugcaggaaucuccuaguuucccuaauauacaacuucggucucugcugaaauauuaccuuuuuuaucguaaauacuuaagguauacaacaugauguuuuguuauacauauacauagugaaaucauuaucacagucaaacaaauuaacauaucugucaucucagauaccuuuuuucccccuuuggugauaaucuacucucuuagcaaauuucuaguauacgaugugauaucauucuguacauuggaucucuagacaugcuguacauuggaucucuagacauucaugcuacauaauuacaacuuuguaccuuuugacauacaucuccccauuccugucccucccuccccaccccaggcccuaguaaccaccauucuacucugugucuauauauucaacuuuuuuuuuagauucugcacauaagugagaucaugcaguguuuuucuuucugugccuggcuuuuucacucaggauacuguccuccagguuuauccauguucucucaaauagcaagaucuccuuuuuuaaggcuggacaauauuccaucguguguguguguguguguguguguguguguguguguguguguguguguguaccaccauuucucuauccauucauccaucaacaaaugccuagguuguuuccauucuggaccaugguagauacugcugcaauaaacaugggagcucagauaucuugacaaggugcugacuucauuuccguuggauacauacccacaagagggacugauugcugaguuauauuguagucuuauuuuuaauuuuuugaggaaccuccacucaguuuuccauaguggcugcacuaauuuacauacaaaaguuuccuuuccuccacagucucaccaacacaucucuuuuugguuuauuucugaacucucuauuuuauuccaucugucuaugugucuguuuuuaugccaguaccauacuauuuuuccauauuauaacuuuguaauauaguuugaaaucaggaagugugaugccucaaacuuuguuuuucuuucucaagauugcuuugccuauuuggggucuuuuauguuuccauacaaauauuuucuauuucuguaaaauauuaccuuugccucuucuuuuccuuucuucccaugucauaguucccuuucuuuuucuucccucuucucucuaugcuucucauucuagaucacauuuggguaauguuagguacauguauauagugacuauuucuccuggaagaugauuuagacuacaacuacaacuauaaucacuuagaaaaguguagaauuccucuguccaccuagaauagagcugaauuuguucauauuccauuccaaacacagcauucuaggaaacuaugaaguauucugcaagcuguaaaaagauccauauaauagaauauuauuugccauuaaaaaggaauaaagggccagacgugguggcucacgccuguaaucccagcacuuugggaggcugaggucaggaguucaagaacagccuggccaacauggggaaaccccuucucuacuaaaaauacaaaaauuagcugggcauggugccccgugccuguaaucccagcuacuugggaagcugaggcaggagaacugcuugaaccagggaggcggaggucgcagugagccgagaucgcaccacugcauuccagccugggcuacagggcaagacuccaucucaaaaaaaaaaaaaaaaaaaaaaagaggaauaaaguacagauacaugcaauaacaugggugaauucugaaaacaugcuaagugaaagaagacagucauauaggccacacauuguaugauuccacuuauaugaauuguacagaauaggcaaaucuauugaaacagaaaguagauuaguaauugucuacacuggggagaugggaggaaugggaagugacugcuaauaaguacaguggcuucuuuuuagagcgaugaacauauucuaaaauuagacugugguagugguuucacaacucuguuaauauauuaaaaaccauccaauuaaaaacuuuaaauaggugaacauuaugagaauuauaucucaauaaagcuguuuaaaaacauguaucuaacgcaacagucuauguguacacacccauaauauaugcauauauauacauacucauuuacagagaguucugaauuaucagccugcaguuuauccacugaaauuuuaaaauucaaaauuucuuacuuccuugauuguaugagaaugguaauaauaacaauaaugacagcaauaauaauaucaaguacucauuuaguucauacuaugugccagcuauugugcuaaaaauacguaaucuuauuaaaaccuuacaaagucaccaaauaauagagucuguuacuaaccauuuuaacauauuauuuuuuauaauccucacaacaagaacuacaguuuuucucaauuuaugagaaaacugagauuuaggguggugaaauaaaucauucucgguuuuacagcuaguaguuggcagagcaaugauuuaaacuccggucacugcacucugcugccacuugagcuaucccucuguaagggcaauugagucucagugagcuaaaagaaucuuacauuacuuuugcagacaggcaucuaacagaguaggaaaaaucccagaaccaaaagcugaaacccagaccgcagucugagucaugauacaaacuaaccaggccagccaaauuccaauccucucaucuacaaacauggaaauuggaauagaaauuuuucaagguccuaucagcuuaaaaguccauuuguccaagaaaaacuuacuuaaaaaucugagucuucaguccaaaauaaacuugccagaagaaaugcuuucuuuauuuucugcccuaugaguuuacgacuauuauuagguuguaaaaauauuaaguauaacuggaaacugaaagcauaauuaacauuuacuuauaaaguucgauaucacccauuagcaauauaacacauaaugauuuauuaacuuuuuacuauaaaaacuuuuaaacauauucaaaaguagacagaauaguauuaaaaaacccaacguacucaucauacaccuuuaaaaaucgucaacucauggucaaauuuguuccaucuauauacccucccacuuugaagaaaauccauggcaucauaacauuucuguaaauauuucaguauccauguguaaaagauaaggguucccuucuuaaaaguauaaucaugauaccaucaugacaccuaaaaauauuaacaauaauaucuuaauaugacaaacuuggaaaauacauuuagauauauaaauggcaauaaauaauacagauuuaaguaccacuuucacugauauuaaaagauaaaccuaggcacauuaaaauuuuaaagaguuuauuugagcauucagugauucaugaauuaggcagcaccagacugcaagugauuugggcuccaccaaaggcgugcaagggaaaacuuuuauaaggugucuguggaagcaggacagagaaaauguuugauuuauuaaaguggagagucccuacuuagagguaauuggcagugucugguaaagacucuagauagagauucacuggugcuuucugauuuguuaaacuuaaguuucauuucacuguuuuacaguguguuuacuguuuacagugaguuugguuucaguuugcuuacauaggaacccaaagcacuaccuaaugguuucccaaucaauuuuuuuuuuuuuuugagacagagucucacucuguugcccaggcuggagugcaguggcauaaucuccacucacugcaaccucugccucccggguucaagugauucucaugccucagccucccaaguagcugggauuacaggcacacaccaccacgccuggcuaauuuuuauauuuuuaguagagacaggguuucaccguguuggccaggcuggucuggaacucccggccuuaagcaaucugcccguuucagccucccaaaguacugggauuacaggcgugagccacugcaccuggccccaguuaauuuuuuuaacacugacaaauuuuacuuugaguguuaaggcuaucuguauauucaaauuuuccagacuauuauuucuauuugaauacauuauuuauauauauaaucuauuauaucuauaccuaaugucucuguacucuauucaugaaaugucauauggcacuauacugaauguguccauagaaguagaguacuaaacauucuauauauacugagcuuauuaguuuuguuuacucauugagcuugccugguauugaaaagaaauuaaauuaguuaggcaugguuuguuugugauuaaccuuuccugucuuccacaguucaauuuaucauccucuucgugauaccaaaugacuacuuuaugaauuguuccacaaauuugccagcuauuauucacgagcuacauauuuuauccaacugaaguguuuauucugugacccuuauuuucauauaacucucuauaaccauuuugcuucuaccauacuuacucucacauuccuucccuagcuugccuugcccuccaaaacaaaaaagcuuccaccaugaaauuacuaauugauauucugccuuauaaacuuugccuugaaagauuccuuugaaaaauuaauuucauuuccucgaucuagccaaugauaaaauaaugaugacagcaaacagaaguagaaacagcauaauuuuuuaaaaaaggaaacaucaaauuuuguauugaaaauuuacaucagcauuucacuagugaacagacauuuccucugagaaagagugauaauuaccauuugcaccucauguaaggauuuuccugaggccuaagaaagcuauaaauaauauaguuucuuuugaaauaaagaaaaaaaauuuaauuuucuuucaucacgcuaacaagaaguaaaauagguugcaaauaaugguguaguaaauggauuaaagagauuagcuucaaaauaacugcacugcaggaccuaaaugcugaacuuggguuauccaggcuaaauaaaggccagucaucaucuuauuuuuauaguucaaucauaaguuagggcuuaugggaguaacgcaauuaagaaaauauauauauuugggggaguuggaaaaguuuggaaaauuucaaaaaucaaaucacauuucaaauggauuaggagaacucacuaauuaaagguggauagauuucauacuguuaaaaaaaaaacucaaacaaguaaaaaaaaauuuaugauuaaccaccaauacaaacaauaggcaaauuuauuaguuucucugcucuugcuuuacaacuguaaccuuuauaacaaacccuguuagaccuuguaggagacccuguuaaugcccacaccauaucccccugacuugucugugaguucucuuccacugcuguggauagucaugcugaugcugacagcuucccaccuaaaggacccacaguucuuucuccauuuucucuuuauucuuccuggaaccaccuugcacauacacuacccaugccuaaguccuuacaccagggucugcuuuuggggaaaacccuaauaagacuguugguaauagaaauagcacuagaaagcagaccuucagaaugagauucuggaauugcauuacuugcuggucagagggcagcaaggauccaauuucuagugauaagugaguggugauaaccccuaacaggcuacagcaguauaaugcccaaaauuuuuaacugagguggacuguaauguguuacaggaaggaggaaguacaagcuuauauaauagcucuaauacuugaaagacaugugguaaucaaaacaaagauuuuggaguauguguuaacuacucgagaagcuuugaagaaugagaauggcaggcuuggguaagccaucuaucaauucagggcaugcuguaaaagucagaaaaacuccaugucaguauuuaaaaugaaccuuaucucuggcacucagcuaacauacuauacugaaaucaggccuaagauuugaugaaggagcuuagcuacaaagacaacuaaaugcacagccccagcaggucucccaucagggcucugauagggaaagggggaggguggugaugcaugggagggugauauuuagggggguguacaugagaccacuaaacacucaaaucugcugaaaccucugggccggcagaauccacccucaucccuuucauaaagguaagccaccucuaauugcauggagaccuggcaaaggacauaccugacgggggugccuuccuccagaucugcccuucaucuuucauugccucuagaccaguaacuagggucagguccuacugauaaaagcuccaacuguaaggcgcaguggcucacaccuguaaucccagcacuuugguaggcugaggcggguggaucaccugagaucaggaguucaagaccaacuugaccaacauggugaaaccucaucucuacuaaaaauacaaaauuaucugggcauggugaugcaugccuguaauccuagcuacuugggaggcugaggcaagagaaucacuugaacucgcgaggcggagguugcagugagcugaggucgcaccauugcacuccagcaugggcaacaagaacaaaaagcugucucaaaaaaaaaaaaaaaaaagcuccaacugugaagggcacaccuucacauuggugggaagaauaugggaagaaaucaccuauucaccgaaaaagucagcugagccuaucugacaugugucauuagaacugagagcacacauaaggacguggauguugagggugcugagcugaggcauggggaaagaaugcuagauagaggagagugcuuucauauggaggcaaucucuggugauucauaauuuaauuuguagcaaggaaaucauaaguagguccuaaaacacuaaugggaugucaaugugacugacaggauuccaaaauaacaggcaucagagguggcacuuagccaucagaagcaaggugaaugcacgccauuaaagguaguaaggucagagcaguaaccagagagcuugaccugcaggggucuguggcaaugguugauaagucauuagccauuuuguuuauagaagcaaaagagauggguaauguauuuguugcuagggcugcugucacgaacuaagugacuuaaacaagagaaauuuaccgucucacaguuuugaaggccagaaguccaagaucaagacauuguugguuccuuuuaagggcugggugaaucuguuccaugacucucuccuaucuucuggugguuuucuggcauucuguugcguucauuaacuuauagaagcaucaccccaaucucugccuucaucuucacaugacauucuccuuguguacauuucugugucaauauuuucuuuuugauaagaauaccagccacauuggauuaggggcacaaccuaccccaguaugaucucaugguuacucauuacacaauucaaccuaugacaaguaguuaauaagguuaauuuuuuauuuauauuugcaaagaagaccaagaacuaaacagaagaucgauguuccuuuucuggaucuaaggcaguucucagacccagagcccaucaaggggaggcuaaguccucuugagcgaaagagcuaauguuucuccaauaauucuuuaaggggaagugcugccauauaacagaguauauggcaccauaugccaguauauacacuggugaaaguggaauacccaaaccuuucagggcuauuggauauaggcucuaagcugacacuuauaccaggguauccaaaauagcuuuguggucucccaguuagaguaagagcauuuggaagccagauaauaaauggagcccugacucaaguccaucucaccaucagcccaaugggucuccagacccaccaacuggucacguaccuggucccugaguacauaauugagauggauauacuuagaagcagcuagaauccaaacacugguucucugaacuaugaaacaagagccauuauaauagaaagggacaaagaaagccccugguaucacuucugcucugucccuggcccaaauaauaaaucagaaagaauauuuuggccagguggaauaacaauuugugccacccucagaaugcuuccugcaaaaaaaccauacggcucauggaugagucagcuaaauacguuggugcaagaggaaaacuacugucacacuauagcccaaggcaaggaugaacuacugcaauguuacucaaaguguaauccauagacuagugccaauucauaaauuuauuuuuguaagucgacaaaauaauuauuaaaagugagaguacauauuuggaaacauuagagcaauuugacauugcuguaauaacuguaguuuuauauuuuacaaaaagaucacucauguugaacugaaaacaaacccauauauaguuccuucacaugaucaguuugaguagcacuguucuaaaggacaguggugaaaggaaauccaucaggcagagcuucauaacuuuacaugaagaaagaagugguuugaggugagaacaauaucaauuguugggcaggggcuagugguucugcuaauugaucagaugccuggaagaagcaauacuucaugaucagauacaaggaggucugagaaggaggcauguggaugacccuauaggugugaauaccuaacaaagcaucuauaguagaggcagcauugaacaaccagauggaaaagaugacccauccaaugaaugucagccaaucuuuguccucagccaucacaaugguugcacaguggacauggaaacugacuagccauaaugucagggauggaggcuaugcaugggcauaaaagcauauacucccucucaccaaggguaaucuagcuauugacagugcugaaugucugaccaauaaguacuggcccaaaguggccccucaauacagaaccaucccucaaaaaagccaaucagacauuuguggcagguugauuacaucaaauuccuuuccaccuuggaaggcacagcaauucauccucaaugggccugaugguuauucaaacaugcuuuugccuuuuuugccucugccaggucauauuuacuagcauaggauccaccagucucaccuuuuauggccauucuagcacuccaucaagcugaugaaccacuagcauuccaucaagcugauggccaaaaggcucagcuuuagaauaacugucuaaaggauuggugccccauccucuuaaacagagguccccaaucuccagccugcagagagguaacucuccauggccugugaggaaccaggcugcacagcaggaggugagcagcaaggaagcaagcauuaucgccugagcgcugucucuugacagaucaggaguggcauuagauucucauaggaggugaacucuacugugaacuaugcaugcaagggcucuagguugcaugcuccuuaugagaaucuaaugccuaaggcagaacaauuucauccugaaaccaaccacucuccccaucccagccucccaccucuguccauggaaaaauugacuuccacaaaagcagucucuggugccaaaaagguuggaacugcugcucuacagcgcaguagaugagucaaaccaaugaucauuacacgauguucuguccccuuagcaugggugugggaacuaagggguagaaguagaauuggcagcacucaccacuuaacccacuugggaaauuuguccauccucaguagccaaguuggguaauuuguacuucccguucucucaacuucagacucugugggaugugauaccuuaaccccuaugaguggaacacuuucaccagagaguaaauuacuuucacccaaacccuuuauuuuggugccugauuuaaaagagaaucugaguuaacuuuaacacaguuagauacaauuauuaucaccuuauauugaggaaugaggcacgaggaaguuuaaguggaccagggucacacagcuaguaagugauagaaucagaacuugacccugggcagucucaucuagaguccuugcuuucaaccucuacucuaaauuaucuguuuuuaaaguucauguuuuuguauuuaguugucuuggagcaaagcauuccuauauuauuuuauguuucuaaggcagguguggcuagcaccucuauaauuaaaauaaaguucaauuaaaucugaacaaguauuauuuaauauaguuuuuuauuauuuuaauacagguuucaauguaaucagacaguaacaaugucuagcucugucuucauuuagcauguaucuauaaacacgcuccuuaaaaacauaccuaaacacacacacaaaaaaagaugucuuuauaacaaauuuucacaaguuaugcauuuuugaacaacaguuaacaggauaaguucaagguaacaguugccagugauuuucaucccuaggaaguagguaaaucaaccaggcuaggaguuuucaaaaauaaacauaaacuccuuuguacuagcuaauccuuaucauuuagcaucaccuguccuucagcuggcccuaugcuugaggcaucagaaugaagcccugggaacuaguauucaaaucacaauuauuuuaaaguuuacaaugggcaauuuccuaaaagugauaugauagaaagaguaugaauucuggagucagacaaucccaguuuugcaacuuaccugcuauguggccuaggacaaguuauuuaacuuuuggaucuucaguuuuccaauauauagaauguggaagaaaaaaagauugaaguaugcaaagugccuaguguaccaucuagcauccagcagcuacuuaauaaguaauaguuuccuucuucauagguauuauuaauuaauucauguuuacauaauuacuugcaacuaaaauaaacaauaaauaauguagaaaauccuaagggucuuauaaguuuagauggaaauaaauuggaagcuugcauaaacagauuaaaacacagauucacaagaagaggaaauaacaauaauagauuagaaagcagguagacccagccauaggaaagaaaacuuaaauacuacucagcaauaucuccaggauaccaucagaacuguuuuggucaccccauagggguagacauggauauccacugcuauaauuuugcacuguacuaacaugguagccucuagccacagguggcaaauugagcacuugaaauauagcuagcccaaauugaaaugugcugcagaguuaaaaaaaaaaaaaaaccuggauuucaaaaacuuggcaugaaaaaauauauaaaauaucucauuaaaaauguuuagauugauuacauauugaaauaauauuuggauuuauuguguuaaagaaaacauuguuagauuuaacuucauuucccucuuuuuacuuucuuuaugguggccacuagaaauuuuaaauuuacauaagugguuugcauuuuauuuccacuggacagcacuaaugugagguccuaauuuaacuugaacagcacugauguagaguccucauucuuaggcucccauguucuucccucccagucuuccauucuuuagcaaagacuuagcacuacaguaacaacaauuuucauucaugucccuguaugagggccccacuauccuggaugcaacacacggaugauuugccacaaauagucuuuaaaugauuuauaaaauauauaggaaugaauaagcggauaaauaacucccagcgaaaaaugucccucaaggacaauauucacauaggcaagacucugugguacuuucuaacacacuuuaaaaggaacauuauuuuaauaugcacuauccauucacgacauucaagacaagugaagguuagcugucuacuagaaaaaauaaaauuuuaaacuugaggcauuuauucauauaaucaagagucuaggaaaacugccugaauuagucaagguucuccagaggacaaaaaaaaaaaugcauauauacauauauggagauuuauuggagaacugacucacaagauuauggagacugaaaaguccaccaaugauuaauucauucauucauacuuuacauaguuuaaaagucccuggcaucaagcaggguacccaggaaagccgguggugcgauucagaccaaaucuaaaggccugagaacuagggaggcugcugguguaaaucucagaguccaaaggaguucaaaggccuaaaggaggcgcuccauguccaaaggcaggagaagaugucccagcucaagaacagaacaaauuugcccuuccuccacuuucuuguucuauucaggcccucgaagccagacugaaugacacucacccacaugggugaggacaaucuucuuuacucagucaacuaagucacauguuaaucucuuccagaaacacacucaacagacagaccuagaaauaauguuuuaccacuuaucuggucauucuuuaguccagucaaguuugacacauaaaauuagccaucacaccaccucaauccucuacacaaauuuggcugaaacuagcuugauaagucuuucuaucagaggcuucaguggaaaaacugaccaggugauaugguuuggcucugcauccccacccaaaucucaucucaaauuguaauccccaugugucgaggaaggaccuguaauccccaucugucaacagaggaaggugauuggaucaugggggugguuucccccaugcuguucucaugauagugagugaguucucaugagaucugaugcuuuuauaaggggcucuucccccuuugcuuucucugucucuccugccgccuugugaagaaggugccugcuuccccuuccaucaugacuguaaguuucuugaggccucuccagccaugcagaacugugagucaauuaaacgucuuccuuuuauaaauuacccagucucagggaaguuauuuacagcagugugaaaauggauuaauauaccaggcaacuccacagacucuggguaucuucuucaaguguuucacaaauacaguuucccaaucuuuacagaacaugagacuccaaaaauaaccaaauucucacuuccccugcucacacuccccccaaaaaaucuacucaccacaaacaaagcaaucuaaucugauaguagaaaaaucaaaauuaaugaacagaaaaaaaucuguuuuggagauaaaaaccagagaaccacuggagaagaugacauaaacagugaaagaucacaggauggcuuuucaucuucauaacucugccauuaguaaacaacacacacuaauauuuugcuucuaugaaaaucuccuguauaaauuuucaaggaaaaauuaguaauauaaaaauaugaaaaauauaaacuuuuuuuuuuacuucgaaaguuuuuaaucucuuagacaaguauaauuacagcaagcacuuuucuacaaguaacuuuaagcuaauggacauauaauggauaacaauaagcauccuagagucaaguuaccuggguucaagugccagcucugccacuuaggugcugugugaccuugagaaaaucccuuaaccuuucccugcucaguuuccuccucuauaaaauguggauaauagcagcuaccugagggaguuguuauaauuaaauacauuaacauauaaagcauuuaaaacagugccugacacauagcaaaaucuaaauaagugguacuuauuauuacaaaugaccaaaaauuaagugacaguaauugguacaucuaaucucaccuaaaugucuuuucauuuaauugaugacuguucuccucacuaaggacuucuuuaauucuuccaacaggugauaaauuguuacuagguuuaagagccaaaggauacauauuaaauuuuuugcaagacucaauaaauaugguuuuauagcacuaaacacuucuaacaagaguaggaaaaaaaacauuucaggaaaaacguuuuguauuaagaauaggaaagucaacagauugauaccauuaauaccaauggacauaauacuuaaggcccaaaccacaccauauuccacuagcauuuacuaagugucaauugugugacugguguuuccaagauacuggacauacaaagaagacaaggacucuauccuuaagggcucagggugaguauacaggcaauacacaauuauguuaugauguaaacuaugguuugaaugugucccccgaaguucauguguugggaacuuaauccccaaugcaauaguguugagaggugagaaauucaagaggugauuaggguaugaaggcucugcccuucugaauggauuaaugacauuaagguaggaauggguuacucauaaaaagaauaaguucagccccucuuaccccuuuuaacuuccaccaugagauaacacagcaugaaggcccucaccagaugccaccccuugaccuuggaccucucagccuccagaacuauaaaaaaaaaaaaauucuuuuccuuauaaauuacuuaaucuguggcauucugcuauagcaacaugaaauggacuaagacaauguauuauaacagaaguaugagcaaagugcauuacaggcaaaagaagaaaucugaacaaagccaaagaagcaugaaacugcauagcauauuuggggaaugguaacucaccuaauauggcuucagcauuccaucaagaccuuacauugcucuuguuuuuucaaacauuaacuaccugucaugugcaaggcaccaaagaaacagacauguaauccauagccucugggaagguaauaucuguuucaggugcuaauguauaaauagaaguuagcugcaagaacaaaggaguaagagcauucuaggaaggagaaauggcauaugcaaaggcauucugagaaccaggaagaguuuaacaagucuaaauccacgggaggaucccaagauaaaggcagaggugggaucauuagauguuuuggaugccaggcuuuuauaacaaaagugacuaguaaucacuaaaggauuuaaaauaagaucaugaccagaucuguguuuuaacaaagcccuucugauagaaggccaguaaggaguaauccaggagguaaaagggauaaggaaauagcauuagugauggugacagaaaaaaaggaaagaacauauucaagagggucuucgaugagaaaauuugguaaaaguaaggaagaaggagauuccuuggauggugccuugaguuuuuuccuaaucccucuaucccccuaguagaaacaucuucuccuuugaaccuauuuuauuucuacguuaguggacuuuuagggggguaccuauuuauucaugucucccuccuccuacugguaaacucauuaugggcagagacugugccuuaucccccuuauauucuuagcaggaccagaacuagggugaggagagugaggcauucaacuucagguucaugcugguacaagguugaaaucuguuucuauuuaaaauuuucauauuuuguucaucacagacuuuuugcauacauuuugauuuuuuaaacauuaaauuaaaauauuguauauuauuuaauacuuuggcacacucuuaaauuuuauaccuguggcaaguaccucacuuaccccuagucaaagaccugauacucagugucuuccugacauaguaccuaacacaagcagguacuuaaaugcauguugaaugaaggaaaagcaaacaaguggcauaagcaacaagauggaugguggugggccuuuuacagagacagugaauacaggaagagcaaaagacucuagaggaacaugaguuuauaaugcaugucagaagcacugcuugguguauuacagauuaauuuauuauucaacacuggaagcauguauaauggaaauauuaaaggaugacauuacucaaggaauuguucucaagauauuuccccauucucuuuuuaaaacuuacacuaauauuugagguauugcagcaauaucuaauuucuuaguucagcuuuuaaguuaacauuucuuaggaugccaagaugagaugcuuguuacauauauguaccauuaacacugcuaugguaugaauguuuguguucccccaaaauucauauguugaaauccuaauccccaagauaaugguauuaagagguggaaccuuuugggaaguaaucaugucaugacagcaaagcccucacgaauggcauuagcaccuuuauuauaaaggcccccgaaaaaugacuugcaucuuccacuauuugaggacacagcuagaaagcaccauuuaagaaucagagagagggcccuaccagacacuucccaaucuccagaagucugagaaaugaauuguuuauaagccacucagucaaugguaucuuauuauagcugcccaaauagacuaaagacaaacacagucuuugauaugacuucaucaaacggcacccacaucacucuauuucuguauccuugcucacuuuucuucauagcauuuaucacuacuagaugcaguauaaguuaguuauuuuucuucccccuuuaaaaaagauucacuccaugagaacacagaauuuuucuguuuuguucauaguuguauccccagcaccuagaauaaaugccauugaaggucaugacaaagagugcgaggguggcugggggcuggcuuacacuggagcagaaauaagacaaaaaaaauaaauuaaacccucuguggauacaaaacuagagcuaggcgcucacaagaauuuaacagaaagcccuaggagccaaaaacaaagaugcaauugcaaaccagagcaauaagcuugggagcuuaccuguagucaccuugggaaguaaccagugggcuuggguuuaauagccuuuggccagaugagauucaaaucucuggauaaagcugauacccucaaaggauuacauacuuggcuaucacuggcauaccagaagauaaaaggaaacuugcauuucucagccugggcuccgggaagaauaaaaaagucucccugagaauucuuaaauaugaccuagccuccuaucuuuggggcuuuaaauuuauaccacccagauggucuuggacucccaagccaagaaaguauauagugguucugggugugauaguuaucaauguauuuucucacagcucccaaugcacccuucuuugucuugcuuuauauauuggagcuggacccuacgagcauuuuccuuugacuucuggcucaauguuaagcuucgucaaaaggagggacaaggcugaucagcccauugaaaaaaagguaagugauuccaaacaaacuaguuuuacuuauuaaauauaauaaaacauaaaauauuuguuucugaaaaccuaacagaaaguuaauacauagaauugucauccaauaugaacauuuccaaugguagggcuggccuuaagucaagcuuaauuuuucauauacugaaacauuacccaucuaacauuugaacagauuuuuuaucugauucucaucuaacucaauagcuguuaucuuugaagauuuauagccucacaccuaaauggauagcuuuuaaguaguuuuuuaggccagugggccccagauucauuuaucauaagauugguugccuauauaucccauuucacauuccaaauaucuucccauuuuauagaaugauaaaggguuauaugcauuuuggauauaguaagaaugaaaaucauugagaaaaaccuggguugccaauuuauauauuuaaugcuuaucaguuaaacuuuaacuugcucuauaguaacuuuaacuugcuuauauuaggacugcaaaguacaaaacauacuccaacccagauucuagcaaguaccaccuugcgaagguuaauuuuaucugucaauuuaagguccccagauacuuagucaaacauuauuuggugaagguguuuaaaucgguagacugaguaaagcaggcugcccucccuaacaugguaagccucauccaauuaguugaaagucuggauagaacaaaaaaguugaccuucucuugaauaagaaaaaauucuuccagcccaacugccuuuaaaaugggauaucaguuuuuuccugccuucugacuugaacugaaacaucagcucuuccugggucucaggccugcuggucuucagaauggaaccacaucgcuggcucuccuggaucuccagcuugcagaucuugcauccugcaggucuuggaacuugucagccuccauaaucacacaagccaauuccuuauaauaaaugccuuuauauacauaugcacauauccuauuggcucuguuucucuggagaacccuaauacacacugcaaaugaccucuuauuaacuccugcuaaagcaucccgccuaaauagcuacaaauguuccagaccuuucccuuucuccucucauuucaaaagguaaaaguauuguguuuacuaucuugucuucucauuguccccauucccccaugcuacuaccuuguggaaacacauuccuaccccaccucuguaauucugugguuagaacaugagcuuugaaauccugccuacccucuggauuacaguuguuuggcuggauauccuccaagcugagccaaucagaagccauaaauguaaauuagauuuuugaaauuuguauuuagaaacugaaagagaguugauugaagucccucucugccaacaaccaugugugggaguuaggccuaagaaaaugaaggagacacacugaaacagagguaaaagcugaaagaaaaaaaaauagcauccuacugauaccuaauucccucauuuauaccugaagcuuagccucacccugucuuucccugaccccuuuacaguagucaauaaauucccuuuuggccuaaacugguuugaauuagguuucagucagucacaacuagagaagacacaguaaauuccuacugcauguaaaucauuacagaaaucugugaauuauauuaaaaauaaccaaacuuaguuauucaaauguuuucuaaaaucuguuugccauaaauugauauuauucaaaaauauauauauguuccauauuuguccuagaaacauuaacauugaagcuacuuaaaaugcaaagauugccuaggaagaaugucucuuugcuuguuuuuacaagggacuuaucaaauuagaaagcaaaauuagaaaucauaaugaguuccauguucucuggugaacacuaugagguaccauuaaaaauguuauauaaaccaggagcagcggcucacaccuguaauaccagcacuuugggaagcuaaggcaggaggaucacuugggcccaggaguuugagacugcagugacuuaugauggcaccacugcacucuagccugggcaacacagugauaccccaucucuuuaaaagaaaaaaaagaagaagaaacaagaauaugcugcuuuaaguuuguacuauuuuuauaaauuaauuuuaauuuuaaaaaacacuuuaacugcuauauaaaaauaauacuauaacuaaaaauauuguaaucugaaucuuuaaggaaaaccauacaaauuuacuaaaugagguuaucauuaccaaauaucuucuuggcacuuuuaaguuuuaaauugaguguuuucuuagcugguugaaggcugaaauucauuaucuucuuauagaacucuuguuauauagaaaacacuuaauuaugaaguaguuauucauacacaugaaagauaaacugguccugaauuuccuccucaauaauauaaauguuauccuaagaaacaggaaaaaaaugguggcuuggguaauuaaaauucagagauaaacacaaucuucaguacccaaauucaauugaauucaaagucuucaaccaccuauuauuuuauuuuauuuuauuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgccuggccucaccuauuauuuuauaaagcugcugacaaauauuaaaguuuuaauaguuguuuucucuaauuugauugcccuuauagauuuuccugaaugaugugcuaaguagcauaauugugaauaagcagaaaguaagagagaauauaaaaagcuaacacacauauacacuucaaaaacaaacuugaugagaacuuagucacaaaggguauaaacccucucaggaucguaacuccaggugacuuuucuuuuucacucuuacuaauuuuaccaacuacgaaagggaaucagauaauccuagaauagguaagagaggaaaagcaggcuuggaagugaucaacagacucuauauaaggccacuaaaggaacuagggagugauaaguaaacuaguuaguagaaguauuaauaaaaauuucaggccccagaaucaugcucacagauuggaaagguuagauuuuucuguugcuuuaauauuauacaauugcaggaaauauuauaagcuucauuuguccaacagcaucaugagaacagguaaugaauacaauauuucagguucagcucacagaacuaauuuucauaaauucuuauauaagugaaaaaccucuuauccuauugcaauguucucaaucucauugccauuaagacucuucacacaauaaccacucaguuaagagaaugacagagggauuuuuuuucauguguuuuuuggcugcauaaaugucuucuuuugagaagugucuguucauauccuucgcccacuuguugauggggugguuuguuuuguucuuguaaauuuguuugaguucauuguagauucuggauauuagcccuuugucagaugaguagguugcaaaaauuuucucccauucuguagguugccuguucacucugaugguaguuucuuuugcugugcagaagcuuuuuaguuuaauuaggucccauuugucaauuuuggcuuuuguugccauugcuuuugguguuuuagacaugaaguccuugcccaugccuauguucugaaugguauugccuagguuuucuucuaggguuuuuaugguuuuaggucuaacauuuaagucuuuaauccaucuugaauuaauuuuuguauaagguguaaggaagggauccaguuucagccuucuacauguggcuagccaguuuucccaacaccauuuauuaaaaagggaauccuuuccccauugcuuguuuuucucagguuugucaaagaucagauaguugcagauaugcggcauuauuucugagggcucuguucuguuccauuggucuauaucucuguuuugguaccaguaccaugcuguuuugguuacuguagccuuguaguauaguuugaagucagguagcaugaugccuccagcuuuguucuuuuggcuuaggauugacuuggcaaugcaggcucuuuuuugguuccacaugaacuuuaaaguaguuuuuuccaauucugugaagaaagucauugguagcuugauggggauggcauugaaucuauaaauuaccuggggccguauggccauuuucacaauauugauucuuccuacccaugagcauggaauguucuuccauuuguuuguauccucuuuuauuucguugagcagugguuuguaguucuccuugaagaaguccuucacaucccuuguaaguuggauuccuagguauuuuauucucuuugaagcaauugugaaugggaguucacucaugauuuggcucucuguuugucuguuauugguguauaagaaugcuugugauuuuuguacauugauuuuguauacugagacuuugcugaaguugcuuaucagcuugaggagauuuugggcugagacaaugggguuuucuagauauacaaucaugucaucugcaaacagggacaauuugacuucuucuuuuccuaaucgaauauccucuauuuccuucuccugccugauugcccuggccagaacuuccaacacuauguugaacaggaguggugagagagggcaucccugucuugugcccguuuucaaagggaaugcuucaucaucacuggccaucagagaaaugcaaaucaaaaccacaaugagauaccaucucacaccaguuagaauggcgaucauuaaaaagucaggaaacaacaggugccggaaaggauguggagaaauaggaauacuuuuacacuguuggugggacuguaaacuaguucaaccauuguggaagucaguguggugauuccucagggaucuagaacuagaaguaccauuugacccagccaucccauuacuggguauauacccaaaggauuacaaaucaugcugcuauaaagacacaugcgaagguauguuuauagcggcacuauucacaauagcaaagacuuggaaccaacccaaauguccaacaaugauagacuggauuaagaaaauguggcacacauacaccauggaauacuaugcagccauaaaaaugaugaguucauguccuuuguagggacauggaugaaacuggaaaccaucauucucagcaaacuaucacaaggacaaaaaaccgaacacugcauguucucacucauagguggaauugaacaaugagaacacacggacacaggaaggggaacaucacacaccagggacuguuguggggucgggggagaggggagggauagcauuaggagauauaccuaaugcuaaaugaugaguuaaugguugcagcacaccaacguggcacauguauacauauguaacaaaccugcacguugugcacauguacccuaaaacuuaaaguauaauaauaauaaaauuuaaaaaaaaagagaaugacagagggauuaccaaaacagaaaggguacacaugcugauaguaauauccaauucacaaauauuccucuacgcaguucuaacccaggaaauaugucuuguaauuaugaaacuuugauauuuucugcuauauagaagcauucauucuaaacagugaaauauucuaaaaaguuuugagucuauauuaaggagaacauuuuaauuaaugugucuaucaaaauaaaauuagaguuaauauaagcaacaucaaugaaagguuuguggaaaagaauguuuuauuuuuauggguacauaguguauguauuuaugggguacaugagaaauuuugauacagaaauacaguguguaauaaucacaucaggguaaacaggguauccaucaccucaagcauuuauuucuuuguguuacaaacauuccaauuauacucuaguuauuuuaaaauauauaauaaauuaauguugacuguagucacccuguugugcuaucaaaugcuaggucuuauucauucccucuaauuauauuuuuguacccauuaaccauccccacugcccuacuccccuucccagccucugguaaccaucauccuacucucuuauauucaugaguucaauuguuuucauuuuuagcuucagcaaaugagugagaacaugcaaaguuucucuuucugugccuggcuuauuucacuugacauaacgucuuccaauuccauccauguuguugcaaauuacaggaucucauuauuuacaauugaauaauacuacauuguguauacgugacacauuuucuucaucuauuugucuguugauggacacuuagguugauuccaaauuuuggcuauugggaauagugcugcaauaaacauggggguguaaauaugucuuugauauauugauuucuuuucuuuugggcauauacuuagcaaugggauugcuggaucauaugguauuucucuauauuucuaguuguuugaggaaccuccauacuguucuccauaguggcucuacuaauuuacauucccaccaacagcauacaaauguucccuuuucuccacaucuucuacagcauucauuauugccugucuuuuggagguaagccauuguaacuggggugaaaugauaucuccuuguaguuuugauuugcauuucucugaugaucagugauguugaacaucuuuucauaugccugucugccauuuguaugucuucuuuugauaaaugucuuuucaaauauuuugccaauauuuuaauugaauuacuagauuuuuuucccauagaguuguuugagcuccuuauauauucugguuauuaaucccuugucagauggauaguuugcaaauauuuucucucauucuguggauugucucuucauuguuuccuuuacugugcagaagcuuuuuaacuugaugugaucccauuuguccauguuugcuuugguugccugugcuugugagguauuacucaagaaaucuuugcccaguccaauguccugaagaguuucuacaaaauuuucuuguaccaauuucauagucuggggucuuaaagucuuuaauccauucugauuugauuuuuuuagauggcaagagauagggguccaguuucauucuugugcauauggauaucaaguuuucccagcaccauuuacugaagagacugucuuuuuccccaauguacguucuggcaccuuugucaaaaaugaguucacuguagguguguggauuuguuucuggguucucuauucuguuccauuggucugugucuguuuuuaugccaguacugugcuguguuggucacuauagcucuguaguauaauuugaauucagauaaugugauuccuccgguuuuguucauuuugcuugggauggcuuugucuauuuuggguccuuugugguuccauauaaauuuuaggauuauuuuuuauguuucugugaagaauaucacugguauuuugauagggauuacauugaaucuguagacugcuuuggguaguauggacauuuugacaauagugauucuuccaauccaugaacaugaaauauuuuuccauuuuuccauguccucuucaauuucuugcaucaguguuguauaguuuucacuguagaaaucuuucacaucuuugguuaaguuuauuccuggguauuuuuuuaugagauuacuuucuugauuucuuuuuaagacuguucacccuggcauauagaacacuacugauuuuuuauguugguuuuguauucugcaacuuuacugaauguguuuaucaguucuaauaguuuuuuggugggggcuucagguuuuucuaaauauaagacuauaucaucugcaaacaaggauaauuugacuucuuccuuuccauuuuggaugcucuuucuuucuuucucuugucugauugcuuagcugggacuugcaguaccauguugaauaacaguagugaaaggaagcaucuuugucuuguucuagauuuuaugggaaagguuuuccauuuuuccccauucaguaagauacuagcugugggucuguuguauauugcuuuuacuguguucaaguauguuccuucuauuccaaguguuuugaggguuuuaucaugaagggauguugaauuuuaucaaauguuuuuucaguaucaaaugaaaugaucauauaguuuuucucaguaucuaaugaaaugaucauauaguuuuuguccuucauucuguugauaugauguaucacagugauugaucugugcauguugaaccauccuuaccucccugggauaaaucccacuuggucaugauaaaugaucuuuuugauguguuguuagauuuggcuugcuaguguuuuguugaggauuucugcaucaauguucaucaguaauacuggccuguaguuuucuuuuuuugauguaucuuugucugguuuugguaucaagguaauacugaccuugcagaaugaaccuggaaggagaaacuacuuccauuuuucagaauaguuugaguagagcugguauuaauuuuucuuuaaauguuugguaaaauuuagcagugaagucauuggauccucggcuucucuuugcugggagacuuuuuauuacagcucagucuugucaguuguuauuggucuguucaaguuuuggauuucuucaugguuaaaucuugguaggguaugugauuaggaauuuauccauuucuucuaacuauuccaauuuuuuugguauauagcugcucacacuagucucuaaugaucuuuugaauuucugcaguauacaucauaaugucuguuuuuucaucucugauuuuacuggaucuucucuuuuucuuagucuggcuaaagguuucccaauuuuguuuaucuuucgaaaaccaacuuggugaaaaagauuaaauucaguaggucuuaaauacuuugguacuuuaggagauuaauacaaaaaagaaaaaaagacauggauucuucaaacaucucacaaugaagagaggauaaacacauuaauuuuguauauaaaggagggaggagauauguacauaaaugcuugucuaaguauagaaucucuacagaaggauaugugaaaaccaaaaagaaugauugccuuugggucagaggacugggggacuggugaucugggauaagagcacuuaauuuucauuauauacuauuucccacuguuggaauauuugaauguauauacaguccuuucuauuccgauaaauaaauuaaaaagcauaaaccauauauaaaauaacuuuuacaaaacaaaguuaaacguaagagauauaaauuacacuugauauucaaaggauagaaagauccuauucaccuacagaagcagaguaaguaccaauaagggggugguccaugagauggauggguagaauagauauauaacaaaaaucauuccagggaagagaacaccugacuauagccacaaaguugggaagggauggggcguguuuagaaaagugauaguuuagaagcuuaggcugcauauaaggauguguucuuuuucuguagaugccugacaaaaaaaaaaaaaaacuauacaguuagcaucuuaaagaacgcacauuuaccaucucacagguuuuguggucaggagucugaauuagcuagguccucuacacagggucucacaggcugaaaucaaaauguccaccaagacuaugguuuccucuuaagcauagggcccucuuuuaacaucacugguugcugacauaauucauuucccugcaguuuuaagacagacacucacccauuuucuugcugucagucaggagccacucucaacuucuagaugccaccagcgauucccugccuaguagucccucaauaagcccucuaaugcucccaagauuugaaucuuucuaacuucagagaaaacccaaucccuuuuaaaggcucacuugauuagaucaggcccacccagauaauggcccucuuaacugacuuaaagucaacugauuagugaccucaucacaagugacucuacaggauguguacccuauaggaugacguauuaguccauucucacauugcuauaaggaaauaccugacacuggauaauuuauaaagaaaagaaguuuaauugacucacaguuccgcauggcugaggccucaggaaacuuacaaucauggcagaaggcaccuccucacagggcagcaggagaaagaaugagugcaagcaggggaaaugccagauguuuauaaaaugaucagauuuugcgagacucacuaucacaagaacagcaugggggaaaccaaccccaugaucugauuaccuccaccugguccugcccuggauguauggggauuaugaggauuacaauccaaggugagauuuggguggggacauggagccaaaccauaucaggugagaaucuugggagccauccuagaauucugccaagcauagcugguaacagaagaugagaacaaaaauucucaaaagcuaagccaaaauuaaauaguuuuccauccuauauuucugucuccaaacguuaugcuacuuguaaaauacacagggauaauuaggccaggcacaguggcucacaccuguaaucccagcacuuugggaggucaagaugggaggaucacuugaggccaggaguucaggaccagccuggccaauauggcaagaccccaucucuuaaaaaaauggauaauuacaguugcaacugagaaaccucccauauuugguaacugucuacucuuuggcuauuugugguacucauuuauuauaaggccuauguuacugacugggaauaucuacuucucccuucgcagucuuuuauucaauauaaaccauuccuaccucuguuugcuguacucuuggcugccuugucuguuacuguuagauuaauauuuaacuuacuaagguccuccucacuccacaaagaccuagccucuuuauuacuuuuuucccgcuauuuucagccauuacuuuugugaccuugcauaaauucacacuagaaaaguguaaguauucaaugguuauauagcuuccaacuuuguuuuugcaguuuuauaaccuuauuugauguauucaaugaucaguaguuuguucucaucuacacugaaugacuauagauuuuuuaaaguggaaacagguacauagguaaccaaaguauacagcuugcuugggaaccuucauccucauuauguuucuggacaaccacauauggauacaguaugggacaucccuuaaccuuaggccuagucagcuuuguugaaccuguuaucaauacgcacaucuggaguucccaucuccuucaugauggcaaauuucuggaucucucugagugccccaggggcaugcuucuugaagcccacucauggaugugcuucugaguguugaugguguauucuugugucaccaccucauugacagcaggagagcccuucuucuucccacccuucucugcaggggccauucugccaggccaaaguuggaaaguaaccuccaucuuaacuacccaagaaagaagaaaaacaaacagcauagcuuugguguaagcaaaaugucaauucuacagcuacauggucaauaaguauacacauaauuaauauuucuacaauguugaauaugauuauuuaggaaaacaagucucagaguuagaaauacccacuucuccuuugaucuggcagcuuauauucuucucacagacaaaaaucaaaagcccuugauaauuuugccugcugauugggaggcaaugcugauagacaaagaaguagaacacuaugaaaagaaggccuccugauacaguugcuagucuuuccugacaacguggcauaugguuccaaaucuucaaacagcuaucauauugcuacacugauuuaacaaggugaucuguauucucccaaauuaaauacauguagagcacuaggauaccuucuucugagaaaagggguauuuauuuucuuucuuugauacuagauuuauagcauaacaguuaagccugcaaguaccaacugaguuucuacuaaguguaacacauugucuaguaggugggugaugguagcaaagagaagauacaugauaaaucagucaugaauccugcccucaaguuauauauaauaagugaaaagaaaauccugggagcagaaucgacccaauuuuccuuucucuucugaugucaggugggcucugaacacaauccucauaauccccauuuccuaguuuccaugcaccauugugaucccuccccuugaguaugggcaggaccuguggcuuguuucuagucaaaagaauaagcaaaggugacacgacagaugggauacauguacaugacuaugugauuauguuacacaaacuugucauacccauuuuguuggagucucugucuuuuaccggcuuuaaggaagcaaguggccauauggccaggaacugcaggacgauucuaguugcugaagcuggcucuggacugauagccagcaagaaauugaaacccucaguccuacaaccacaggaauuaaauucugccaacagcugaaaugagcuugaaaacaucuccuucccuaauugagccccaguugagaacuaaguacuggcaaauauguugauugaagcuuugugagaccuugagcagaggauucaagucagcugugcccugacuccuggccccaaaaacuaugagacaacaaguacacauugcuuuaagccacuaaguuuaugauaauauuguuauacaacaauagaugacuaacacaucuuucuucuuauauuauucaaguugcuaacauaucauaagagguaaacucaaguauucugaacauccagucaccacuggugacaugaaauccccagcccacaugcuagagaaaaccagaguuggucacacagccagacccuuuuguaagauucaagcggcaauuugccaccaauauugccaaaauagccaguauggcugcccaauuaacagaucaaaaacuaaagaucagcugcuaauuccugccuuguacauucucagagaguaaggaccuuccauuucccgacuaaaugcucagaaugagccaucaggccuguuagguaaaaaugagaaauuugaaggaucaagcggccccgcagacgcugguagagagggcaagcuuaagguguagaagaaaacugucauucccacuuaauccaaaaaaguaaaaauauaugccuccuauuuucuuucagauauaauaaccaccuuuucuuaaacaauagcuuauuugggggccugcauucauuacaaacaaaccagaguaggcuuauauaucaucugaagguucuuuuuuaaaaaauuucuuuugagacagggucuugcucugucaccuagacuggagugcaguggcacaaucauaacucacugcagccucgaccuacugggcucaaggaauucuucugccucagccccugaguaucuaggacuacaggugacugugaccacagccagguacuuuucuauuuuuuguagagaugggaucucacuguguuucccaggcuggucucaaacuccugggcucaagcaauccucccaccucagccucccaaagugcugggauuacaggugugagccaccaugcccagcuaauuuuuauuuuuucuuuuuuguagagacaggggucucacuauguugaccagaauagucuugaacuccuggaggauaguaauccuccugccccagccuucgaaagugcugggauuacaagugugagccacugugcccggccacaugaagguucuuuccauuguucuuccagaagucucaucaucacaggcucauuguaguauaaauauuuucacauaaggaaugaaagugauguguuagcaugaucuuaucaggaucaagguaacuaaaaacaaaugacaagguuucucuuuuuauuauucaacauugagaagcagaaaaguguucaacuguuacuguauuuauuuaaugcucaccuuuuaaagaguaaauucaguuaguuacguguuauaaaaugugagauaagacauaauccuagaguaaugaaauuuucuccuuuguaaaaggagauucacuauaauuuuucauguaaagggaacaugaaaccaauaaccuaguuccaaauggacagcuaauaaaauuaaguuugcacauuuaagagaaaguuauuuuaauuuccuuuaauuguauacaauguuaaaaaggcuuuuugcaaaucauuaacaguuaagacguacuuucauugacaauuuagguagacaaaauauucaauguugugugacaaaaucauucuuauaacauuaguaaaugcauaagcacauuuccaaaaauugcaagaaauaaaagccaaauaauuggaaagaauacacauuuacucuaaguaaagcuugauuauacgcccagagaugagcaugcaaaguauagccuaaucuauacucccacaaugccucaagguaucucugagugcccuguuugugaacaucugggucaguucuauggcugacaccacaauguccuaaauagggcaugacaauaaaugaaauguacaauaauguaaagcaguauaaccucuagauacaauaaggcacuaaauguaacaacguuaaaaaucagcaauauagaagcuaauaauaaaacaaaacaaaaacauuuauggggguuucagggggaaaaaaacuaggcagaguaaaugaaagauaaucuguagguuaccucuauucgcuccuaucaggggcaagauucacauccuggucucuccccugcuaauaccugaugaaucaaacugaugaacauacagccaaucaacgaagccaaaaaaaaugauacuuaaaauaaauaccugaaaagauggaucccacauuacaucuuacuuaacgcuuccaacuugcuaugagaaagauacuaagauacgcaaaguugaaagugauucaaauuccacacuaacaauuuaaaugccuuguaagagaaagaauauucacacauaauaauacaaagcaaagcaugagaugagucaugagaagauacaaguaaagugggaccagagcuuagagggugaaagacgacuucuagcuaagauaaggaagggcaucacagaggaaggggcauuuaaguuagauuuuaaaagauagaauuugaaaauacagacuauaguagccuucauuucaaucaaaagcagcagcauaugccuucauaacugcaaugaaauauuauguacguaauuauugaaugucucucuuccucaauagaugucaaguucugagagggcugagacuauacuuuuucaauggucuccuuaguaccuagcagaauaucugguaugucacagauguucaacaaauauuuauuaaaggaauaaauaaacagaggcaggaauauagaggacaaaucgcucaauuugccuaguaaauauagaagacagggacaugaagaacaaaagaucacuuaaggugaaaugacagaagaccuugaaaagucaaacugaagaauguuuauuugguuggaaauaaggagucacugaagaucuuuauggaauguagugacauaacuagaucugugcuuucaaaaguauaucuaaaaguaauguacauggcagacuacaaaaaagauaaaaugaagaagucaagagaucauuauaggagucuagaucaaagauaacaaggaccugaaguagaauaaaggcagugggaauagaaaguuaaaaaaaaaaauaacgacagggauauuaaacagauaaaaucaauagaacaaucaguuaguuauccauuccacaaacaucuuuugagcaacuacuacauaucuaccagacacugccaggagcuggagacaggaaaaauaaaauaagcuguaguccuucaccucagaguugagagucaaucugucaucucaauaagaaaaacugauugaaaacugaucuccuagcuaagauaaggaaaggcaucauagaggaaggagcauuuaaguugaauuuuaaaagacaguuugaaaauguagaauaugguagacuuuauuucagcccuuucagaauaacacaauaaaugaagaaagggagaagucaaugccucucuuaaauuuugagaacagaaacuaagaggauggcaucaccaugcagagaauggaagaacaaaacagaagaagguggacagggaggacgguauggacagauucugacacacugucuuuguguggaauacgcaagugaaaauguuccugaauuaguugcaaauucagaacuggaggacagagcacagauuagggcuuaugauuugaaaggcaucuagcauaaauaugagagcugaaauugagagcagacaagguaagaaagggugaaacauguagaaccuuggagaugauccauauuuaacgagaugagagaaggcaaagggaagaauuaagagaaaauuaucagaaaaucaaaccaagccaaaccaggaaagaggagagcaaucagaggcaaaaggaucaucaggacaacaauaaguguuuccagaagcauggaccaucaacagcauuauuugcaacagagaaaucacggaaaauuaggacugacaaaaaggccacuggauuugggaauaaaagaaauguauuagugauauuugagagagcagcagagugauaagggaaaacucaguuugcaaggaguuaagguaucagugaauggugaggcaguggagauagcuggaacaaacugcucucuugaagucugaaaaugaaggaaaagaaaaugauggaacaauagcuugagggacaacagaaggaagaaaaaaauuuaggcuaaggaaagauuauaugaguaugucuuuuguuggagaaaaaguggacaaaaaaagcaacauuuuuuuuagaacaggaaagagcagagauagaagauccaguaaaggcauaaaucaaagaugcauaaaauacuugauguauucauucaauaaguauuuauugaaugcccaccauaaacucaaaacuggagaauauacaccggagaacaagcuagguaggaucccaagcucauggagcuuguaugucuaagcuuccagaggaaaaggaagaauacaguggacaggguagaaugccuuuauucuacccuguuguugcagaacagccacagaguuuggauggaauuaauuccacugcuaccaauggucucagaaaucagcaucaucuuaucuguguuaucaggguauuugauucacgaaugaccacacaaccuaaguugguccuaucagaaugaaaccugggacuuugauuaaauggaaaagaggacaauccugaucgacaaaaugugcugaggugaggucgggaacuguugcauacauuuugcuaccugaaagaagcccacuugugcugaaggcaacauagaggaggauugagcugagagaauuauggcuguaaaaaaugaaacucugaucaaaccacaucugaaacccauccuuucuuuggacuuuucaguuacaugauccaaaacaucucuuucuuuguuuaaggccauuuaagccgagcuuuuugauaauuucaaguaaaaccauccuaauuacaaauuagaugucacuguaggcacaaguaaaacgguuauaaaacugcagcacaaaauaagaccugcccagugcagauaccagagacugugcccuuucuccacucuucuggcuuuagcugucuguauuagucaguucucacgcugcuaauaaagauauacacaacacuggguaauuuauaaaggaaagagguuuaacugacucucaguuccacauggcuggggaggacucacaaucauggcagaaggcaaaggaggagcaaagucauguccugcauggcagcaggcaagagaaaacuuguguaagagaacuccccuuuauaaaaccagaucucgugagacuuacucacuaucaugagaacaguaugggaaagacccacccccaugauucaauuaccccccaccaggucccugccacaacaugcggggauuauggaagcuacaguucaagauuuggguggggacacagcugaaacauaucacuguucaugguucuaagcuuugaaacuacaacucauucucuuuuuuuuaaauuauacuuuaaguucugggauacaugugcagaacaugcagguuacauagguauacauaugccauggugguuugcugcacccaucaacccaucaucuacauuagguauuucuccuaaugcuaucccuccccuagcccccaccccgcgacaggccccagugugugauguuccccucccugugcccauauguucucauuguucaacuccugcuccuucuccuauaaauccuuuccccacuccuccacccaagguuauuuucucuucaucagccccuaaacuucaagagaucuuagcagccugggagcauaagggcacucuuccucucagcagcauccaaauuuaccccaucuucaugcuccagaauuaagugagaggggccuaugacuugagcaacagucaccaauaagggaauucuugggccuaggcccagcgaauauccuuucugcaaguuugccccuguggcuguaucaacccugaguuuccaucuuuucguaucaaucuggcugacuucucuuccuuugaaacuagacucacagugcaucuccuccuggaaggccuccuucccaguggcccuuggccgucagaugcugcuccucaggguucccaugaaaaucaauacucaccuccuccuagccacacagacauggaaggacagagcuagauacaaugugauguuguucuuacugggacaaggauuacacuuuauuuuauuuguguauaaccuacaugugugggggaaaugaaugucacuuguaauguggaggaaugggugcuggacucgcaggcaaaacacaagacuuccaggcaugaggggauuucuuacaaguugcaggaccucuccaagauucuuaaucuauaaggacuuuaucacuggguuguugugagauuaagaagcauacugaaucugaaaaguauuguaguccuuugagaaugauaccuagaaauauuuuuguuggauauuaugaauguucagaggaggcaagagaugccuucuugcuagggauugcuagggaaaaacuggagacauagauaagugaaaaacucaagaagaagcuggccuuuaagcugacuuuggagaauguguaagauuuagacaugcugaaauggggauggggagagguagccaggugaaggaagccaaaagcugagaagccagcaucaacuuagcagcuaauuuuacuaagcaaauaugugccaaccacucuucuaagugccaggguuacaacagugaaaaauucagaggaggccccuacccuaagaggguuuacauuccaguugggaaagacagacaauaaacaaagacaaagauaugaaaugauuucuguuagagguaagugaugugaaggugaugugcuauggggacuggaggggaaacauuccagguaagguaguaaaggccauucugaggugaugacauuuaaccugggaagaaagugauaaaauagaguggagcugaggaagaauaugccaaaggaaauaccaggugcaaaggcccugaaguaggaacaagcuuggcguguuuguaaaaccagaaaaaaaaaaaaaaagccaauguggcuacagcaaaguggacaaaaacaaaaguaguaugagauuaaggcugagguuauaucuaaguaacagcacggugucaguuuagauugaaguuuguaguaguagaugauccuugaaaacaaauuugggcuagaauuagaaaaucucagacaccaaauuaagguggauauauuucauucuucaaaagcaauugucucacaauauaaugagccaggucugcgaggcaaguccucagggaugcccacagauauuucucauaaauuaggugacucuuguggaggucaugggcacuuaauccagaacaccaaggcagcaaggcaaagcagcugcgagacuguuggugacguggaacacagacugagcagaaaguucucuagcucaauuuccccuguugcaggaagaaaugaagcccagagaagaaaacaggccugggaggagagagaguagacaucauaacugauguucaccaauacgugguucuccucuaguucugcccaaacaagaaugauaaugugucacuuugggaccaaagcauuuaauugcugguguuuggcuccccgaaccugccauggcaaucacuuguuaccauggagguguuauagacagguacaguguagaaugcagagccaauaucuggagggaggcugccauggagaaucccccagauccacucuggugguguuaacucacugagaaauuggagguuguuuguuauggaaggauaaccuaaccuguaaugauuaauacaggauauagacagaguuuuuaaaaagaccagaaagaguagacauucuugcucugaguggggaaaggaggaggagagaauaugagauacuacucaaugucucugacagcaugcauuuuuugccccaauucuccauucuuggcuagaucagugaccuuuaucagauauguaagccuugcacaaaauaccauagacuggguggauuauuaaacagaaauuuauuuucucacauuucuggaggcugcaaaucugagaucagggugccagcaugguagaguucuggugugcagauggccaccuucucgcuguguccucacaugacaaagagagaaagagagcaagcucucuggugucucuuccuauaaaagcucuaagcccaucaugagggcccuacccucaugaccucaucuaaaccuaauuauaucucaaaggccccauccccaaauaccaucacauugggggucagggcuucaauauaugaaauuuugggcaauggauaugauuccaucuauaucugaguguuuucucccacucuuugguuuacacuuuggccaugugauuugcuuggcuaacagaaugagcuggaauugacaguauaugccaguuccaaagccaagccuuaaagagcccuuacauguuaacaguuucccccuugcaccucugcuaugggcaugagaagaacauggcauggcuagaccauuccacaaaggaggacagaaauacauggaguacuaccaccacugcaaacacauauugcaacaaucugcaacaugcagaaccacgacccaccaagccugcagcauaaaugacaaaugauuauguuuuuaagacagcaaguuuguggugguuuguuaggaagcacuacuggggcaguagguaauugaucuauauaaugacuacaggaaaauggccaaggaggaccuguggcucuuuaggaagagucuuaugcuaacaaagcugccuaggaaaauuaaguuguacugcuccaaagacucuucucuucaaauccuguuuucuuauuuaccuuuuccaguucccugaaauagguccuaaauucaacucugauacuggucagcaagguuugugaagaagacaaaagcacuggggagggggauacagaaucauaaaguaauacaaaaaaaaaaaaaacagaaaagaaaauuucaggggagaaaaaucaagugcaauacaaaacaccaaaggaaaugagaucugaggucucuaaguuuacuaagaaggcuagucaucaugaagccauuuuuggacaccagggagacagaggcaugggaguucaggaaaaaacaaguggcaagaaaauugagacagugaguuuaaaucauugaguuuagaaacguaacaaugaaaagaauaaaaaauagagcaacaacuaguggagcaggaaauagaauucauuuccuaauacagaagaccuauauauauagguuucuauaucagugcuauaucagugcuauaucaguuuucuguugccacaaaacaaauuauuacaaacuuauuaucucacgguuuuguaggucagaagucugagugagcuuagcuggggucucugcuucaagucucacaaagccagcaucaaggugucaaccaaacugggcucuuaucuggaaguucuagagaauaagaccuccgggcauauucaggugguuggcagaauucaguuccacacagcaaauaggacugaaguccccauuuccuugcuggcuauuggcuggagguugcucacaacuccuagaugcuguucucuggcccugcaugugcucaucuccaucuucaaagucagcaauggugcacuggaccuuuaucauauuuugaaugucccugacuucuucuucuaauagcagcuagaaacaaaucuguucaaaggcccaugugacuguauuagacccagauaaccucccuaccuuaaggucaacugauuaggaaccucaauuauaucucaaaaccccuugugcuguguaaccuaacauaauuauggaaguaacagccaucauauuuacaguccuagaaauuauggcagaaaucuuagagggccaucuuaggauucugccuaccacauguacacauuuaaaguugaaaaagauccaaaagcgaaaagaccuugaagaagauuuuaaauagaaccuuguauuacacaaauuaccuauaaauaggaaggaaagaaaucaaggaaaaaguaugccauccuggccauagcaaaaaaaaagaaggaugccuuuuauuggagauuugaagaaagaauuaaaaaaaaaaagaaaaaaaaaggcagaggcaaaagacaccuuuuaugccaacuauuuacuuugccaaaauuaguaucauuuuaauuuagauacaaagaaacauauucuaggcucuuugaaaaaguuccuccagaugguuacaucucccuggagugacagcaccuagcguagccuugcacauauugggaauucaauuaaacacugcugaccaucugauugagaauucagaggcuggaguagcugacucaauauaaacauauggcuuaguucccaucaaaggaaaaaucaagucacucuauucuccuccccaacaucgcaccuccuuugcaauguaggagaaaacagauaugaacuaauaaaaauagacgauguaacagagauuaggaaacaggcaaacuggagaauacaaaauuucucuaauuuuaccauaaaaucagaaugcuucagcuaaggaucagcacuguaaauaugucauucuuaauucaauugcauucaaucagaucaauacuuuccgaucauggcuucaggauauuuaagauggggaagacacaaucugagcccagcugcuaaguguugggggauaggagaagcacacaaaugacuauacugugagguugagcuauauuaauuguggaaagccaaaugaagauaagaaaacaaauuaaaccacuuuuaacccucuuaagagccauaugaaauauuuauacaugagaaaaagccucaggcagaucaaaaauauuuuucaagaucauauaccaaguauauuguaggguacagauucaaauucaagacugacuccaaacucagucucucccaaagaagaggcaaaucaccucugguuggcuaguuggaugggaguuuggaggcugguggagagaaaccaggaacaguuucuuagggaagcaguuauuucagguaaaacuuggaaagauauacacaguuuugaaaagcugagauggcaaagaaggagaacauuuccaggaggaacagcaaaaagcacagaagcaagaaaucaggaucaacauuuggagaauggugaguagaucaaguagcacaaacucuuuacaaauaaagauagauuggaugcacauucuggaagucaaauauugggguuaauaaguuacuguaauaguucagggaagagccuaaacuagaaucucagacaugaaaaaggagaaaaggagaagaggggacuaaugugaggagucagauggaagauuacucucuuauguuuacauuacagucaacaacaacaacaaaaaagacagccaaguccaaaaacuaagcuuggauucaaaagaaaaaagucaucccucugccacccucuuuugcccucuagucuagagguuaguaaacuauggcccacagggcaaauucaacccaccaucugucucuguaaauaaaauucuacuggaacacagccguguccacucauuuacggauuguuaauggcugcuuucacccuauaauagcaaagacuaugugguccacaagaccuaaaauauuuacuuucuagugcuuuacagaaaaaaaaaaauugucaacgcuugcucuaguuccauacuccacaagccacucuuauuuguuuguuuguuuguuugugacagggucucacucuguaacccagacuggagugcaguagcacgaucacagcucacugcaggcuaaagcaauucucucaccucagccucccaaauagcugggauuacaggugcacgccaucaugcucaguuaauuuuuuuuuuuuuuuuuuuuuuuuuuuagcagagacgagcucugucuguguugcccaggcuugucucaaacuccugggcucaaacaaucaccugccuaggccucccaaagugcugagauuacaggcguaagccacuucaccuggccuguuccaauucuuuuaguagcuuguucucaucuaaauauuaagcuuauuuggauauuuccugacugauaaauuaucaagacuaucauuugaauuccuauuauaguaacugagacuuuggcuugcuugcaccaucagccuuccccgcauccuccccacucuccuuccccaccacacauacuuuccuuuccccguaugaauauauauuuauauucguaguguuugcaacauuauugugacuacauaaauauucuucauuacugagccagauaauguaauguaauuauguuuauguuuccaugcuuauaaaaauguuauuuucugaaguuaauaguuaucauuuguuucauuugcuuaguuuuucauuuaccuaucacuauuuuuucugaguccaacacauuuguucuguucauuuuuuuccaaacauucaaacacaccaaauacuucauuuuuauuuguuccccucaaaaccaccccccccaauaacccuccauccuuuuucucuaaucugagugguugcucucaaggccuagugaacaguugcuuuucuggaacuucucucugcccugccauauugagucuguucuccugaauccuaugucuuucucuuuauugauuuucucccuuguuuuauggaagcucauccuccagaagcuuucuaugaaaucacacauaagauauaaauuguuuaauccuuccaggacuuagaauuucuucauucuguccucauaucuaauugauacuuucagccggauagagaaaucuaaacugaaaaggauuucccccucagaauuuugaaagcauugcaccacuguccucuaccagccaguguugccauaagaguuugaugccauucugauuuccauccaucucuaugugacuuguguuaaugcuuuguuucauuuuauacucccuucacaaagcuuuuaggaccuuauuuuaaucuaugauguucuuacauuucagaaugacauggcugguauucuuuucucauuuauugugcuagauacuugggcagccuuuucagucuagagacuuacauccaccgguacuaggaaauuuucuuguaauauuucuuugauagcuuccuuccuuuuucuuguccucuauuuguaucaggcaaccuguagcuauaauaaggcuucauaauaaaccauccuaaaacucagagacauaaaacaauagccauucauaauuguucuagaaucuaccagucagucaggcaguucugcugaucuugguuggauuuggcuagggaguucuuuuugguguugacuagaccucacacagguaucugggguaggcuggcuguuagcugaauuuaaaugguauuuggagcuagugcaguggcucauaccuauaaucucagcacucugggaggcugaagcaggcagaucaccugaagccaggagcucgagaucagccuuggcaacauagcaagaccuugccucuaccgaaaaaaaaaaaaaaauuaaaauuagccaggcacaauggcccaugccuguagucccaacuauaacucaggaggcugagccggaagaucacuugagcccagcaguuggagguuacaguaagcugugauccugccacugcacucuagccaaggagacagcgagacucuuuaauuaauuaaugguauuagguaggacagggaccuguuucaugagucucauccacaagcauguuuucaugauaaucacagagguuucagacauuguauacacguaucaaaauaucacacuuuagccaauaauggaugcacuuuaaaaaaagaagaaaaaaguaucacccauaaauauguacaauuauaugucaguuaaaauaacaguagaagaaaaaaugugcuuuuuaagccucuguugugucaaguuuucuauaacaaaauugaucaaauugggucacauaaccaaguccagagucaguauggagggcaccugcaaaaggcuuggauacaugaauucaugcauggaaccccuauuggucagaucuuggaaaugcugaauugauccucuaauuuucuuuucuuuccuauguuccaucucuuagguuuauuuuuuuucuuuguugcugcugcuguuguugaugauccacuuucuaugagauuucuucaauguuauccugaaacuucuaaaauuuuuuauguuaguucauaauaaauuuuaaauuuccaaacuacuuucuuguuaucuaauuuuaccuguuucauagcauccguucuuguuuuaaaaguacaauaucuucucuuauuacucuaaugaaauuaguaagaguuuuuggaaguauucuucuugaauugccucugcuucccucagcaggugaagggaaguuucacccaacuucccacagcagagaaagguaucugggugaucuaaaggcucuuguacuuucaaccaagauccauguucugcucuguguuuuacucccaguuuuuguggugccgggaguuuccaaaugugagucucuaaaggguuugcaucucaucaaugucuuuucuauagggacuucagaaaauuaaagguaacucucugcagguagcauucuuccuuuauuuuucaucuuccaaaauuuuguuaagaucucucuucugcuaucccaauuucuuuauccuuauaaguuaauaccuuuuaaagucuucuacugccauuucagugagauuugaggaaggaaagaagaggaguuuacauggucuauagacacucucuccauuugcuuuuggacacagugaauuccaaguaacaccacaauaauaaagcagauauccaaugauugaaaacacaggugaagcucaagauaaaggucagaauuagagauguaaauuggagaacugcuuauacagaaaugguuucuacaacuaucaaaggaaauaaacaaaauauaaaauaaagacaaaauauccaaugauacaauauuuagaaaugccuaagcuaggaaaaagaaacuaucaaagagcucaaagaaggaggaaugauaaaaauagaagaguaaguggguuaguacuaagucacaaaggucaagggagaaaaagguuucaagagaaaaaaagacaaucaaugauaucaaaugcugcugagaaacacaggaagaugaggauguugaggacauaccauuuggugauuaggaagaugauggugaaguuuaagagaguuguuucaauagcauaugaguacaaaagauaaagaaguagauaguaaaguagauaauguauuggugguucuuuuuuccccaauaaucugguggccaguggaagacaaaaagccugagauaagugagaggagaauuugaacauacaugaaaguuaagaaaaguuuuuguguuuuuuugguuuguuguuuaaggaaaaaaaaaaaaccuuagcaagaguacaaaaggaaagauuugaggaaagaauguaaaugcaaagaugaggaaaaucaaaggauaauaaaggacuggaggagaaagguaggauaugcacucaugagcacacaugcagagguucaucuuagaaaaggggaaggcauucuuacugcaaggcagauaugcagggaaagagaaagaauaaaagcagagguagagagagacaccagaaaaaauucugaaaaccucaugcccaaauguccucaagcucaguuaaauaagaaaccaaguuaucugcugagagcaagaaugaaauuuauagagagugaaaaagguuuggaacagcuggucugguaaauguaauaggggguuugugggggaggcgguauuuauuaauuuacuuaagaaauagcggcagcaagaaaagucuagauaaagcuauucuaaguucugggagacucuaaacaaaauauggauuuagaaacagcaaaauuucuguuuuucacaauaguagcuauaauaaugagagaugcucaguggguaugagguagguaaugucaagugaucagaauaaaauauccaaaaauuaacaaaaccugaauuuuucaaaaggacuuccuuuuguauuuuacuuuuuaagaagaaauaagaaaaagaaaacuaauaaaucuucaauccaguucuuucaacauuuauuccuugcuaauuucugacuaauaaaagcguuaauuccaggcuaauuaagccuucuuaacugaccuucaaaguucuccucaacuaugccuaacuauaucaacuccaaucuccuuuguccaaacacuacuccuccacuacaaucuaaaauaguugcauuuccaugcauaguaguucacauuugcaaauacaaaggcugcugaaucuuagaauuuauuuaucucuaccaaugaccaauuguucacaauuagguuacuuuugguccugauuccuuuuggaauuuauauggaaagauguaacauuuacggagccauucauuaucacuguugccuucacccuuuccuuagcuaacagcagccacuugauucauuuaccucuaaagcauugguucucaaccagaagcaauuuugccucccagagaacacuuagcaaugucuagagaugauuuuuggcauccaguguguacaggccagggaugcugcaauccuacaaugcaaaggaaaaccccaccccguccccaacaaaaaaaaauuaucugguccaaaugucaauaguaccaagguugggaaaucaugcucaaaagcuaccucauucauauucuaagaccuauaaauaggucaacaacgaaauaaaaccugccuuuggcucaagcucauucucuccucugcuccugaucuccuacauucccaggcccuuugucugccuugaccauugagacuuugauugccuuuuucccagcaaggcuaugauauccugauucucagauccuuagcucccuugggccaucugacaccuaagaugcaguugccccugugaaguuccaaaacuccccaggcuuguuucucacuggggggucuuuaauccuuguuuucuggacuugagucuuugcacggucuggccucuaacauaaccugacuaauccuaaucaucuauuucucccuacaccccagggugacaauaugguuugacagugcacaucagagcagccuuuaaaaggccuucucgagaccauccuggcugacacggugaaaccccgucucuacuaaaaauacaaaaauuagccgggcaugguggcgcgcgccuguagucccagcuacucgggaggcugaggcaggagaauggcgugaacccgggaggcggagcuugcagugagucgagaucgcgccacugcgcuccagccugggcgacagagcgaaacuccgucucaaaaaaaaaaaaaaaaaaaaaaaaaaaaaaaaaaaaggccuucuccugucuaacuuuggagucucagcauuccaucucuucuuccugcagucaccuaaggggcuguuaccuaucuccagaacaacaguuuacauguguuaagaccucauuauaugguugcuggaggaaaacaugaaccaauaacuugcaggcuugaguuacaaagaacauacauuuaaaccaacugaauucuggaucuaacaguucuuucauucaguuaccaaaauauuuauugaaguacaguaccaggcauguggggguggguggcuuaaaaaaaguauccauaaauagcucacagcuuaguauauaaaaucagauauguaaauaaguaaucuguaauuagacuaauuacagucagauuauuccuauuuuauaauaucuaaagaaaauuguaaaagaaauaaaauccuuccucagaauugacagaacuaauggucuuaaaauaaaaguacaugggaugaggcugggugccauggcucaugccuguagucucagcacuuugggaggccgaggcaggcagauggauucccugaggucaggaguucaagaccagucuggacaacauggugaaaccugucucuacuaaaaauacaaaaauuggccaggugugguggugggcgccuauaauccuagauacucaggaggcuaaggcaggagaauuacuugaaccugugaggcagagguugcagugagcugagaucaugccauugcacuccagccugagugacagagggagacucugucucaaaaaaaaaaaaaaaaagcgcauggauaaauaaaugagcaaaugaacaagcagauggauaaaugagaaaccaaauaucaaacaaguaaauuuuuucugggggucuuaggcaaagugguacaucauguaaaugagagccucauuauucuacuacaucuccuuucuuuucaucuuccuuaaaugucauucucacuauaaaugcuaauugguuuagcauauauaacaaauuaaucugggugauagaauaaugcuacaacacaauccaugcugaaaaaucuuugcuucucaguuuugcagauaaugaagccucuaaacagacauagcccaccaguauguagacagaccaggacugauacuaggccaaaagacaccauguagccucuccagauguuuacagccagugugcaucugacuggucagugcuugugccucaucagugguaaguuguuuuaaugucacccuugaucaguacauucucucaauuuuagagcagcaggcagggcucccaagaagagauuucauaacuauauuauguucauucucccuuuaaaaguauaaaaauuccaauuaccaauugacauagcagaaagcauccaccugguuagacugacuuuuccucugcauaauaccuuguuaauccaucauaaugauuuauucauauugcugcugcacugagauaucagaugcuacaacuacgauuaucacuguuccucguaaaguggagucuuacagagcuggcuuugaacccaagcucuaucagguacugucuacgugauguucaaccucuucuaggcugaaguacgugagacuuuaaccaaaugcaauugaggaaaauaauauuuaccuuagagguuuguugugagcauugauaaggagacgauauaucuauacagacuagaacauaccaggugcuuaaugaauccuagcuucuccuuuuagccaaaucugauacaaacauauugaucaaguucuuucccuuccuuccuuucaccaugugaugccugcuccccuucaccuuccaccacaacuuuuucuuuucucuuugcuuaauuuucuuuaagucccuccaccuuaucggcaauuuacuuuuucauuuaucaaaaguuacuaagagcacgagcuuaccacugccucucccaaaauaucuccuacaaaucucuggaauccauagugaaaaguagaaacuaugauuccaaauuugccuuuacccuaaacacauuguuuugccuuuguuuuaaaguggcuuuucccuccucaucucugauaauuuuccagcauuaagagcauuggcuuuugagucaagcaaucuuggauuccaaauccaauucuguugcuuauguagucgaauuacuuaccugguugacuuauuaaauuucuguggcucucacugucccaaaaacuagaacauguauggcaaugggcacaaugccuagcacauaauaggugcucaaauauaucauauuuaauuguucucagcacuggcauugcuaaccaagacuaccuucucagucaacaauuagucucaaagauacaauccaaaucaugucccauuagcaugugcccuguucuguauuuauucacucaacuaaucaucuccugaaugcuguauauguucuaggcauaaaauaaagacauuuguacagcacuuucaaagauaacuaaaccaaaguuucagacuuaaaggaacucauugucuagugggaaggcaaacauguaaacaaauaauuacacggcaguauacuaagugcuaaaaauagaugcauguacaaggugccagggaagcaccauagagagagaucaggcaaagcuuccuugaagagaugacuaugccagaguugagucugggaggaugagcagggauucacugagcacacaagggaaagacggacauucugggagagacaggggcaggcaacaguggaaaguccaugaugccugcugaaaacaccaaguacaggaauugagucggguuggagagugcugcuacaaagaacuggugaaaaaauggggcaguuaggagggagccaaaccacaaaaggccucaagugaugugccaaagaguauggacuuuauucauuaagcaauggcaagccacugauuuuuuuuguuuuugggggguuuuuugagacagggucucacuuugucacccaggcuggagugcaguggcacgaucucagcucacuacagccucaaccuccugggcucaagugauccucccaccucagccccccaaguagcugggacuacgggcaugcaccaccaugccuagcuaauuuuuuuguauuguuagcagagacgggguuucgccauguuggccaggcuggucucuaacuccugagcucaaacaauccacccaccucagccucccaaagugcuaggauuacagauguaagccacugugcccagccucuauugauauauuucuaagucaaagaauaacauguuuauaauggcagaggaggaaucagguuggaaggacuguuauuggaaguggugauacugaguggacagaaguaguaaggaaaaacgucaggcauggcucuagaguuucuaguuuaaaugaugcaccauaguuccuaacacaaaugaugcaaguaacagagcagaacucuggguacagauaauuaauguuuugcauuucauaccuccauugaggaggagauguucaauaggacaccggggauaacaugucuagcgugcaggagagagaaaugaauuacagauacagguuucggguagauuuuggagaauaauaauuuuuaaaaccaaagaacaugcuuuuuuuuuuuuuuuuuuugagacagagucucacucuguugcccaggcuagagugcaguggcauggcgcgaucuuggcucacugcaaucucugccucccggguucaagcgauucucaugccucagccuccugaguagcuuggacuacaggugcaggccaccacacccaguuaauuuuuuuuuuuuuuuuuuuuuuuguauuuucaguagagacggaguuucaccguguuagccaggauggucucgaucuccugaccucaugauccacccgccucagccucccaaagugaugggauuacaggcgugagccaccaugccuggccaagaacaugcuuuuuaaaagaaauauaauucauuuagacuucucucccaacuucaagugaaaagauuacaaauuaaaaaccuuaaauuacuaucuauugcauauauauuaaaaucuaacauuaaaaaauauggaaagaugucaacacauuuaaugaaaacaaaaaacuuuaacagagguaaguauuguauauuuauuugucuauuacuuugcuuaagcagucugcuugcuaauauaaggacauuuuccuuaccuauaagaguaacguauuuccaaaauaauguuuucauggccaaaaaaaagcauaacgcuugcuucaucuucugaauaaacaaguguguuuaauuuccugaguaaacauuagucauaguugacacugaacagcguccaaauucaaggaaggaguuaagaaauuucuaaaaccccaagagcaauauaccucacccagagaaucuagugaagagcuuauuauaaaggacuaaaagucaaugucauaccaaaauuuuaaauaacaucaugcaucccucuacuuaauaaauuauuucaaaaucaggucacaauugacagacacacuaucuugggcagacgggagagacuagauaagcagggaaaauuuccuuuucucuacugaagcauguccaccaacugucauaucuggaaaacagccaaaaugagcacuuuauuugcaaaaagaacaggagauuuauaaugugagcaaaaugugugcuauauaaaugcagaauauagagaauuauuuuaagauucauauuucuguauguuuagaaauaauguuucaaagacguagauuaaaaccacaaguucaucuauauaaaaagcucuaaaagccaaggguggcaacgcuuaaaucccuauagauaagcuuuacccuuuucuucugggcugugaccaucuaugcgagguaagguuuccuuauaaacuucuaagacagauaaucuggccucacagguaucuaaaugaauuagccacauaaauuacucugagaaaaccacagccaaaucaugucucucuuaaccuuccuuuccuucugcucccuaacccucuguuuucucuuuagucacagagcauuuucuaguuuccugaccacgggguuuaccagccaaagcugacacagcugaguugagaagggaaagcagcugaacuauaaaggaaggaaaucagagagaaaagaggcagggagucuggaaaugcuaacuagaggggaaauaagaaaacccuggacugugucugaaucuguagaaacuugcaacucuagauuaauguccucaacucagguguuggcggcccuuagucaacuaaggguuugcgaaaauuuuccaaauggguuccucgcuaaucuaaaauaaauacauauuaaaaauaguaauaauggcagagucucaauaacauuuauagccaauaaccagggaaaaggaaggguaggcauucauuuugagugacuuuacuauuggaaacuccuggacaguuacagcauugcuauuaacacaauugucacuuuggauaagguguccaacugcaucacacaguauuuugguucuuuaaagaaguuaggggcugggcaugauggcucacaccuguaaucccagcauuuugagaggccgaggcggacggaucaucugaggucaggaauucaagaccagcccggccaacauggugaaacuccaucucuacuaaaaauaccaaaaauuagccaggcguggugacaggcgccuguagucucagcuacucaggaggcugaggcaggagaauuguuugaacccaggaggcagagguugcagugagcccagauugugccacugcacuccagccugggcagcagagugagacucccucucaaaaaaaacaaaacaaaacaaaacaagacaaaacaaacaacaaaacaaaugaagugagagaauuuaaacagaaaggaagugggaaagguaaggugaagaaagacuucugguuugaguguauucucuuaaaaaguucacaaaaucgcugagguaauaaacauuuuuccacaugccucuuuucugagauuuuguccaccuucuccuccagccaugagguggggcucaaggagacucagcagccccuaguuuaugcuacaagauccuaucucccugccuuccccucauccucacugccuugauuccuggucuuuucaaggccuggcaguucaacauuuccuugauucuaugaaagacuucuauagucauaaauucccauuccccuuuaaagaaaaagcaagcaagaccuccaaggaaggauauauuaaacauggaucuuguacccuuuucugcaacuccuuucaucagugagaugaugauaauacuauagauuagauuguggagaaaauagguaucuauccaucccaagagucaagaguuuuggagggauuuuuaaagguaauccaggaacaaauaggauagguacucugcauguucccuuguucugcugaugaaugucacaaaauacaaaguuuacgaagcauuucuauggacacccaaggacaccauaaaaacagaaagccaagauacaaauacuuugaaauacugugaaaagguccuacguuauuagagguauugauaagaaaacaagauguuaagaaaagaguagaaaucacgaucucuuuagaucccuagauguuuucuuguguauuaaguaugacauuuuuuaaauccaggcugguuuaguuguuuuuuuuuaauuuuacuuuaaguuccaggauaugugugcagaacgugcagguuuguuacauagguauacaugugccauggugguuugcugcaccuauugacccguccucuaaguucucuucccuaacccucccacccccaucaggcccugguguguguuguuccccucccuguguccauguguucucauugcucaacucccacuuauaaaugagaacaugcaguuugguuuucuguucccguguuaguuugcugaggaugacggcuuccagcuucauccauguccugcaaaggacaugaucucauuccuuuuuauuuuauggcuguauaguauuccauggugcauauguaccacauuuucuuuauccagucuaucauugaugggcauuuggguugguuccaugacuucgagauuguaaauagugcugcaauaaacauacgugugcauguaccuuuauagaaugauuuauauuccuuugaguauauacccaguaaugguauugcugggucaaaugguauuucugguucuagauccuugaggaaucaccacacugucuucaacaaugauugaacuaauuuauaugcccaccaacaguguaaaagcuuccuauuucuccacagucuggccagcaucuauugucucuugacuuuuuaauaaucaccauucugacuggcaugagaugguauuucauugugguuuugauuugcauuucucuaaugaucagugauguugagcuuuuuuuuuuuuuuuuuuuuugagacggagucucgcucugucgcccaggcuggagugcaguggcaugaucucggcucacugccggcuccgccucccgggcucacgccauucuccugccucagccuccggaguagcugggacuacaggcgcccaccaccacacccggagaauuuuuuguauuuuuaguggagacgggguuucaccguguuagccagaauggucucgaucuccugaccucgugaugcacccaccucggccucccaaagugcugggauuacaggcgugagccacugugcccggccgauguugagcuuuuuuacccguguguuggccacguaaaugucuucuuuugagaagcgucuguucauauccuuugcccacuuucugaugggguuuuuucuuguaaauuuguuuaaguuccuuguaaauucuggcuauuagaccuuugucagauggguagauugcaaaaauuuucucccauucuguaggcugccuguucacuccgaugauaguuucuuucauugugcagaagcucuuuaguuuaauuagaucccauuugucaagaguucucuucuuaagguaguaaaacuaaaauucagaucaucuuuccauugaguuuguuuucccaaaccuagggaaggagagcaggaacugguaauagugccugcuguuuauuuuuucuuaaauguggcaugcaaagcugaaugaucuuuuaaaguacagaauauaacugcaaugaauuauuucugcaauacuuccaacuauuuuucccauuucuuugcaauuaaugauagcauuuuuuuggcuauagcaaauguuuacuaaagagcuuccuggacguuucuuugcuuagauuuauuucuaggaauuauaguuuccugauaguaacuuaaagcuugggaaauucccaguaugaauuacuuacuguccugguucauuugaagcaauaaucauuuuuauaagaccugugcagaugugccauauuuuauaauauacuugugucaauuuccagacauauuuuuaugacauuuuaaaaaucauagugggaauaucauauaacaagaaaaaccuacuugcuggaauccuuaucucuaucgaauucugcaaacucaacuucuucagugaaugacaguuaauaucucaguucuuuuauaacucuuuuucggcauuaucaucaucuuacuaaaauucuugagaaugcacuuugcugauaauuaugauaaagaaagaccuucagcuaaacagcaaaaaaauauauaaagauuuucugucucucauucuggaggccuacuacauguccacaacacuauacaugaaaaaaagcccauuaaagaaugcaaagugcugaccagccuaucaaauuaucaucaucucuccuccaaagugcaaggagaaauaguauccaggagaauugccacacagugcucaugcuuuggucauaaucugauguuaccuaaaaucauuaauugcccaauuuucuuccaauacaagguacagccaaugcugacuuugaaagagauauuaucauugucaucaccuagauaaaaagaagagccuccuccacuuucucuuccacucccuauuccucuuuuccuuccuucucauuucccuucucuuccugaaaaauucaguuccuacacuauuaaguaacacagagaaagguagguguccacaucagaggaaagauggaaggcacaguggaaagguaggagguguguccauauuggggcaggccuaguguggcguaccauagccuaagugagagggcaucccuucuggcaugauaugagaggguuagaacccacacagggugaagagggugcccauguggugauggcagaggggaacaccccagcaugggaugucaguauccaaacagaaugagagggcauccacaugcaagggugaccuagugcagggggauuagaguccaagaaggaugaaaagauuauuccccuguagaugcagaccaggagagagucagauaugaaaagggugaagaggugucucugcagaaggacagccuaguguggggugacagagccuaagagggaaaaggaggacauuaacagaagggaggggacgauaguggagaggagauugauagcauauaagacgacuuaucaaauaaguauauauacaaagauaacagaagccagacuggaggaugaaggaaguuacaauaaacucauauuuuuaauaacuauagagauguaaauauguguacacagugaugugaauauauucacucccuggcugagaggaucugggagauaugacacuccaaaagccaugagcauaacaauacccaaaucuuagcuucuaauggcccacuuuccaauaaaaggaaccaggccacuuggagaaaagguugauuccagggcuaaggcaggaaaagaugaguccuggaacauuuuaugaugccaaaagcaaggaaaugcucaaggaauggcucaaaaaaaaagucagccuaaaagggauccuacuaagucugagauaauuuaagcaucaaaauuaauaaugauagcagugcauuauaaccuaggcaauaaaacagcaaaccaugaguccacacugauauaaauaaaugaauaaaagaaaguuugaugaggaaugggauaucugcauaaauguaccuccacacaaaauaguuauuaaagggggaaaaagguaauuauauauauagaaguuugacaaccaccaucauaagcaagugauuaaaaugaacauuaucagcaacgggacagaucaaaucccaugccaccugacaggauacaaugaaaagaacagagcaucccucuguggcauucccaccaaaggugcacaaccugggccaggcacgguggcucacgccaguaaucccagcacucuggauggccgaggcaggcagauaacuugaggucaggaguuagagaccagccuggucaacauggugaaaccccgucucuacuaaaaauacaaaaauuaggcgcauauuuguagucccagcuacucaggaggcugaggcacaagaaucgcuugaacccgggaggcagagcuugcagugagccaaaauugcgccacugcacuccagccugggcgacaaagugagacugcaucuccgaaaacaaccaaacaucaacaacaaaaaaagugcacaaccugaauguaauaauaagaaaacagcagguaaacccaaagugagggacaucuuauaaaauaacuggcuuauugucuuugugucaagaucacaaaagucaaagaaagacugagaaauuauucacacucaagaagacuaaggagguaugacaacuaaaugcaguacaugauuuugaacuuaaucccaauaaagacauuauugggacaguuggcaaaacuugaaugggaucugaggaauaaauggcuguaaugugacaaaguuaauuuucuuauuuuagugacuguauugugguuaggucgaagaauguccuugucuguaggaaauacaaacuaaaguauucuggggugauuagguugacaacuuacuugcaaaugguucggggaaaaaaaagguuauuuaaacuauauuuccagauuuuccauaauaugugauuauuucaaaauaaauuuuaauuuuaaaaauaaaaauauuugacaguauguaguucuaccuccaaacauuaaagaauuaccugaaccugacucauggucggauuuagaucugauguaugaugggagaugagagccaaaugcugacaccagacugcucaaacgaaaaagcuaaauuugugaguuuuuaugcccuaguaaaauuagauacuacuguauaguuagcuauuaucucauguaaaugauuuuuguaagggccuagagagaagagucuauuuuccagccuccaaagcaccaucaccauacuaaaugcauaguguacaccucaagauauuuccauaccauaaaaauaugucucaaaauauuuuaaugcuuuuaaaaaggagaaaauaguaaugauaggcuuacuaggaacccauuaaucucauggauuacagcacagcacauacaacuuccguggaacacaauuuuuuucuguucaaguuaucuuugugaggaauguacaagauagaaaacaaauacuaaaucuuuggugaccaguaccacuccuaaaagcaaaaggaaaaaagcaauccucugccucugggaucagaggaagauuggccaagcagugucacucccuauggccugucuuggugccuacaguuacaccauuaaagauuuagguuaagacaguguaaacaaaugacuuauuauaaugcaaauauuccagaguuucccauucaauaaaagauacucaugaaauauauaauuaugauuuauaauuaugaauaauuuauugaauaucuaaauuauuuauugcauagauauuaaugcuuaguaauaauaagcauuuuauuuccuccuguguaauaggcacugugauagauauuuuauauaaauuaucuuuaaccauuccaacucuacaagauagauguuaucaccuccacuuuauaaauaaggaaacugaagcccaaagaaguuaaaucaccugcauagcgccaaauguccuuucaguugcagagucugcauucaaacucaagacucggaauuuuuccauuacgguuuuuucuuuucuuagagauugggucuugcucuguuacccaggcuggagugcagugguguaaucauaguucacagcagccucaaacuccugggcucaagcaauccucccgccucagccucccaagucacagggauuacagguacaagucacuccauuacauucugcuucuucuuucacuauguaauuuacuauucugaaaaauagaaccuggcgcaguggcucacaccuguaaucccagcacuuugggaggcugaggcgggcggaucacaagaucaggagauccagaacaucuuggccaacauggugaaacgccgucucuacuaaaaauacaaaaauuagcugggcaugguggugcaugccuguagucccagcuacucuggaggcugaggcaggagaaucgcuugaacccaggaggcggagguugcagugagccgagaucacaccacggcacuccagccugggcgacaagggcgaaacuccgucucaaaaaaaaaaaaaaaagaaaaagaaaaaagaaaaauggagaucuaugguaugagggaauaaaaugccauauaggaaagcuucuuauugguacaggauaaaacuaaauuaugagacuucugaguuugggguagaagaagccaaagaaugccuuagaaccaugaaaggaagaaaggcuaagcaaagggacauaagggcacaggaagaggggaugagaaaggucuaaggacaaacugccugguuccccaguuuuccuacacagccuaacacuagaguugacaaaagucccugaauuaauaaugagcucaguuaaaaacgacaggcuuagauuuauuggccugaaagagauggaucauaaaugagggcugugggcugggugugguggcugacgccuguaaucccagcacuuugggaggccgagacggauggaucacgaggucaggaaaucgagaccauuuggcuaacacagugaaaucccgucucuacuaaaaauacaaaaaaaaauagcccggugugguggcgggcgccuguagucccggcuacucgggaggcugaggcaggagaauggcgugaacccuggaggcggcacuugcagugagccaagaucgugccacugcacuccagccugggcaaaagaccgagccucugucucaaucaaucaaucaaucaaucaaucaaucaaucaaugcuguggugaacacuguacuuuccuucuuugugugaaaggaaugaggacaaauaaaucccacguacaugguuuagauguuuguucccuccaaaucucauaccgaaaugugguucccaguguuggagguggggucuggugggaggugcuuggaucaugggaguggaccccucaugaacggcuuagcagcauccccuuggugaugacugaguucuccaaauuuacaugaaaucugguuguuuaaaaguguguggcaccucccugcucucucucuugccccuggucucaccauuuuauacacuggcucaccuuugccuucugccgugauuggaagcuuccugaggccucaccugaagcagaugccagcaccaugcuuccaguacagccugcagaacccugagccaauuaaaccucuuuucuuuauaaauuauccagccucagguauuucuuuauagcaacacaagaacugacacacucgcccaucuggaaacaugggauggacaaguuauuaaaauaccuuugaagacaauagaaguuagacaauaucaagcaccuagaauuuuggggguaaaaaauuccacacuggguuuuuguggggguuguucugguucagguuuuuuucuuuuugcccaggcuggaguacaguggcaugaucauagcucacuguagacuugaacuccugggcucaagcaaugcuucuaccucaucccccugaguagcuaggacuauagguaugcgcuaccacacccagcuauuuuuauuuuuuuauuuucuguagaaacaggaucuuauuauguugcccagccuggucuugaacuccuuggcucaagcaauccucccgccucagccucccagagugcugggauuacgggugugagucaacacaccuggacuaacacuguauauagugaaaauaacugacaagggcauauuuuuaaaaugucuuuaggugauuuacuuuaccacucaguucaguuuacuguucaugugcuaucaagaaacaaauuuaaagcaaaauacugccaauaauaugaaacugauaagcacacaaaaauaauugagaacuauguaggaacugaaauauauuacuauauaauuuuguagaaaauguacuuuccauuuacauguuggaaauauauugguauauucauauuuuaacauaagauaugcauugaucccuauggcacuaggaagcaauacagcacaauugaaagauaucugggaucagaaacaccugaauuugcuucuugaaucugcaugaguacugauuauaaaacuacugacuuuguaacucugggcaaguuauucaauuuuucuaaccuuuucacccauaaauaaaaauggggaagacauugcaagacuuguaaagauugaagaauauaauuuuauguaaaaaaaguggccugugugauguuuacaacauugcuuauaauaauaauaaagucaaaaaucauccaaguaucuaucauuaagaaaauauuaaguaacaacaguauauacaccagauuagugguucucaaauuuuagugcacauaagaauguucuaggggguuguaaaaugcauauuuccaggccuuacacuuagaaauucuuagaauacucagaaauccuggggugggaucaggaaauaacacguuuaacaaacaaccauaggugcuucugauggaggacaucuaugaaaaguaugcaguagauggaauacgaugaugccauuaaaaauaacuaugaagacuuugaaauagcauugaaaagguguaugauauacccuuaagugaaaaauucaggauccaaacuuguacgcuuuaucugauaacuacauuaaacaugcuuaagaaaaaaguuguuuuuagcaauaagauuaaagguaauuuuugaucuuuuacucaaaguuuuaaauagucaugcuauuauuauaaaugaaucacuaacacauuaaaauugaaaaaaaaaaacacauuggauccucauggccuucaggauuaggcucaaacuccuuagggcaacacacaagguccuucuaucuccagacuuagcucuuguccaugcuccauaucaaacuacuuauaauaccccaagcuauauucuauauuuucacacacuauuauugaauauacuguuccuucugccugaaaugcccuuucuccaacuugucuggaaaauuccuauucaucccacaagauucaagcacuaccuccucucugcaguuuccccugaauacuccuccaagucaaauucugggugccuccuucuugcuccuaguauuccuacagcauuauuugguauuuccauugcuccauauaucacccuguauuuuaccuuuuugcugauagaucuaucccauuauucugcaaguacaugggguagguagagaugaucucauuuaguuuuagaauccacaaaguacucagcaaauacuuguuaaaauaaguaaagaccuauuuuuuguuaucacuguucuuaguuaucaguuuucuaaaaaauccugagugcccugcugguuaguuggauaacacuuggcucaaugauuaaugagcuuugucuaauauauacauauauauauacacacacacguagcauaaaacaaacccaugaaaaauuuuuaagaaauaguuuaaccauuguuuguaauucuucacguucucugcuuaugucuucaaaguuucuaucaaccuucaggaugacagaccacucuggucaauagccaaagcaggcuaacaggaauaacucugcucugggcuccuccauugcuggaguuuacccagccaaagaacaucccugcagaauucuugcugcuucccccaaacacacucccacucacugccaucuccgcacuagcaguaaaauaucuauauaaaacagagauaauucuguaaguaaauagagcaguuuuuuaguauauucaaaacacuagauacuauauuuaguauauuuguguaauacauaaaacauuucaaaugcagauuacuaacuagagguaccaaacaagaaccuaaagugacuaauaguaauucaggccaaaaaaaaaaaaaagaaagaaaaaucaauguggaagaauacuaauugagauccagguaucagaacuucaaaugcuuucccuguaccguaaaacauaaguuuuaggaauaaccuggaugcugaagccaacuugcaacacaauuuuuuuaaaaagaaaaacaaaauacauuuuuuaacauuugaaucucaagccacauuaggcauuaaagcugugauacaacuuuguuccauaucucugucaccugugauauaauaaauguguacagaaauacuuuuagugcacacuucauagauacuguacuuuuuuaaaaauugaagauuuauaggaaccaugugucuaacaaguccauuuuuccaauuaggccaaugugcucaguucaugucucugugucacauguugguaauucucacaauauuucaaacuguuucauuauuuuuauaucuguuaugaucaucugugaacugaauaaugcuguguguguucucaccacuccaccaacuggccauuccaucucucucccucuccuugggccucccuauucccucggauacaacaauauuaaaauuaggccaaugaauaacccuucacugaccuauaaguguucaagugaaaggaagagucacacguuucucacuuuaaacgaaaagcuagaaaugaauaaacuuagugaggaaagcauguuaaaagucgagacagacugaaagcuaggccucuuaugccuaacaguuagccaagcugcaaaugcaaaggaaaaguucaugaaggaaaugaaaagugcuacuccagugaacacaugaaugauaagaaagccgaagagccuuauugcugauauggagaaaguuugaggggucuggauagaagaucauaacagcaacacaacauucccuuaaggcaaagccuaauccagagcaaggcccuaacucucuucaauuccaucaagagcugauggagcuggggaagcugcagaagaaaaaucugaagguagcagagguucagggggcuuaaggaaaaaagccaucuccaugacauaaaauggcaaggugaaguaguuaaaugcugaugcagaagcugcagcaaguuauccagaagaucuagcuaagauaauugauaaaggugacuacacuaaacaacaaaauuucaguguagaugaaacagccuucuauuggaagaagaugccaucuaggacuuucauagcuaaagagaagucacugccuggcuucaaagcuucaaaggacaggcucucuuguuagggguuaauguagcuggugacuuuaacuugaaaccaaugcuuauuuaccauuccaaaaauccuagggcccuuaaaaaugaugccaaaucuacugugccugugcucugcaaguggcacaacaaagccuggaugacagcacaucuguuuguagcaugguuuacugaauauuuuaagcccaauguugagaccuaccacucacagaaaaaaagauucccuucaaaauauuacagcucaguggcagugcacuagucacacaagagcucugauggagauguacaagagacuaguguuguuuccaugccugcuaacacaacauccauucuguagcccagagauugaggaguaauuuuggcuuucaagucuucuuauuuaagaaauacauuuuguaagguuauagcugccauaccuagugguagcuauagaaccacuaagaacauuugcgggccaggugcaguggcccaugccuguaaucccaacacuuugggaggccaaggugggaggaucacuugagcccagaaguucaagaccagucugggcaacauagggaaacccugucucuacaaaaaauuuaaaaauuauccaggcuugguagcacaugccuguggucccagcuacacaggaggcugaaagcaaagaaucacugagucugggaggucaaggcugcagugagcacagugaucaugccacugcacuccaggccugggugacagagugagacccuaucacaaauaaauagauaaaacauuugugguucaugggaggaggccaacauuaacaggaguuuuggaagaaguugauucuaacucuuaugacugauuuugagggauucaugauuucaacagaggaaggaacugcagaugugguggaaauagcaagugaaauagaagugaagccugaaaauuggacuaacugacaacaaucucaugauaaaauuugaacagauaaggaguugcuucuuauggauaagcaaagaaagugguuucacgaguggaaucgacuccuggugaagacacugugaacauugcugaaacaucaacaaaggauuuauaacauaacauaaauaaagcagcagcaaggcuugagaggagugacuccagugacuccaauuuugaaaguucuaccauggguaaaaugcuaucaaacagcaucccaugcuacggaaacaucuuuugugaaaggaacagucaacuaaugugaaacuucauuacugucucauuuaagaaauugccacagccaucccaaccuucagcaaccaccauucuaaucagucaccagccaacaacauugagacaagaccuucuaccagcaaaaggauuacaacuugcugaaggcucaaaugaucauuagcauuuuuagcaaugaaguauuuuuuaauuacguacauuguuuuguuagauauaaggauguugcacacuuaacaguacaauauaguguaaacauaacuuuuauaugcacuggauaaccaaaaauuuuguaugacucacuuuauugcaguggucugaaaacaaauccacaauaugucugagcuaugccuguacaucuaaguaauaacgucugauauaggcaaauaauauauguuuauaucuaaaauggguuuauauaauccaauaaaaaauucuagagacuaaaugaguagcaaaaagaaaauacuuuucuaucaccagccauauacucucucauuucucaugucuccagucaaaucccuuccccuucagccuuuaagaaggaagaauuagccaggcauggugguucacaccuauaaucccagaacuuugggaggccaagucaggaggauggcuugaucccaggaguucgagaccaacccaggaguucaagaacagcaaggcaggaggaucacuugagcccucaacaacagaccccaacagacaggguuucccuauguugcccaaguuggucuugaacuccuggauucaagugauccuccuaccuuggccucccaaagagcugggauuacgggcaugagccacugugccuggcccacaaauguucuuaauggugucuagcauggucaauccuuuccagaagguuuucaauuuacuuugcacagauucaucagaagaaucacuauguauggcaggaguuugaggaacagugaggcucuguccuuauaaaaaaaaaucaaaaaauugguugggcaugguggcacaugcugguagucccagcuacuuggggucuaagacaugagaaucacuugacccuggggggcaaugaggcugcaguaagcugugauugcaccacagcaccccggccugggugacagagugagaacuugucuccaaaaaaauggaagaauuaccaccuguauccaacauucucuuacgagccuggcaaaauccacuccauuuguucugccagaagaggucgauggcuuuacuauuuuggccuaauguuuuguugccucuuuaaaugaaaauacgaaaagagcugcuucuuucuaaaagcuuuaccaaucaauuacaacuucacuaugaauuaacugucaggucccacaaacacuuuuuggugguaaagaaaggaaagaaaaggcacuggguccaugacguuagaggauaaauuaacauugagguauaagcauucccuuuccucugcagccucaccagcaucuauugucuuucgacuuuuaaauaacagccauucugacuagugugagaugcuaucucucacugugguuuugauuugcauuucucugauaacuagugaugcugagcauuuuuuauguuuguuggccacuuguaugucuucuuuugagaaaugucuguucauguacuuuacucauuuuuuaauagaguuacuuguuuuuugcuuguugacuuaaguucccuauagcuucuggauauuaggccuuugucagauacacagauugcaaauaucuucucccauucuguagguugucugucaguguggaagguaguacagagauuucucaaagaaccuaaaauugcuaccauucgacccagcaaucccauugcuguguauauacccaaaagaaaauaaaucauucuaccaaaaagacacaugcauucauguucauugcugugcuaugcacaauagcaaagacauggaaucaaucuagaugcccaucaaugguagacuggacaagaaaaugugguacauauacaccauggaauacuagguagccauaaaaaagaaugaauccauguccucugcagcaacauggauggagcuggaggccauaauccuaagaaaauuaacacaggaacagaagaccaaauaccacauguucucacuuauaagugggagcuaaauauaaagcauauguggacauaaauaagggaacgaaagacacaguggacuacuagaggguggaagggggguagauuaaaaaacagccuauuagguacuaugcucacuaccuaggugacaggauccaugcuccaaaccucagugucaugcaauauuuccauguaacuaaucuacauacauacuuccuguaucuaaaaucuguugaaaauuuuuuuuaaauauucagauaggcuggaaucuagagaugaugccagcuggcacaaaaacuggagccagggugaacuuguaguaauuagaaaaaaacgcuuuuuuucugagaugugauugaggaggguuaaagggaauguggugugggaaauagaaacaggaaaggagguuggcuguuuaugcucacauccaucaaucaagauuugauccaauuugaucaaagaaugguaacaagucuaagcaguuuguuucaguucaguuaacuagaagugauuaaccacuucaaauaaagcuacucucauaacacaauagaauccaaauaacucuacugcacagcuuaaucaaaguuccauuucacaacuagauccaugaagacaugucauuuaauaagaaacaugauucauaagaaucagauucagagaugaacacucuggacagugcaguagaagaaacagagugucuuagucuauuuuguguuccuauaagagaguaccugagacuggguaguuuacaaacaauguauguuuuugugauucacauuucuggaugcugggaaguaaaagagcaugguacuagcauuugcucagcauuuggugaggaccuucuuauugcaucaucccauggcagaaggcagaagggcaagcaagcaugggcaacagaaagaggaaauugggcugaacucauuauuuugugaggagccucccaugacaccuaacccacucccacaauaauggcauuaauccauucauacaugcagagcccucauggccuaaucaccucuaaaagaucucaccuguuuguuuuguuuuuauuuugaguagggucucacucugucaccuaggcuggaguucaggggcaugaucauugcucacugcagccucaaacuccuggguucaagcaauucuccccacccagccucucaaguaguuggggcuacagacgugcaaugccacaccuggccauuuuguuuuguuuuguuuuuuauagagacagggucucacuauguugccuaggcuauucuugaaccccuggccucaagugauacucccgucucagccucccaaagccugcgauuacaggugugagccaccacguccagacagaucccaucucuucauacugucacaaugacaaauaaauuucaacaugaguuuuggagacaacacucaaaucauagcacuguggaaaacaaaauuuauccuuuggucauauuuuuugauccaucuucaaauaucaauuaaaagccucauccagauuuaacacaaauguaaaauguauuugauauccuacugacaccaaagaagaaaaguagacucuuaagaaaaguuucuagaucuguauuacacaagaaaauucaaugaguuuucaacuggcauugugccucugccugcccguacggcuuacauaaccauguccucacaugcaugagaaagaacuggaagauagaagcgucuucuuuguaaauuccuuuuucaaauauaaaauauucucccauaucaacauaugaugaguaauaaaaacucacuguauuuuaauuaacuaacaucauucugcaauauguccaaaacggaaacuaaagacacucuaaaaugcauuaaguguuaaauaucuucagguuccauagguugaaauuagucuuuucuaaccuuugucuggcauuauagucagcuuccauuucuaguuaaauacucaggaauaauguucuaucauaggcuucugauagaauuuuccaaaauuaccucaaaauuauuucaguauauaacugaacuaaucaaauuguuuacugucaccugaaagguuaaguugcuaaagucagcagaggcacuaauaaauauuauaugcuucugccuuaaugucagugaagacuugcaucagccuuugucaucuguaagaaaucgagucacacaagaaacugugcaauggauggacagguugaguaguagucacuggcuggcugcccuaguucacugcuacacaucacccucaguguuuugaaaagggagcugaaaacccugcucaguggagaaagaggucaauaccaaaauucacccuccuuucuccuuacuccccaucaugcagcuggcacuguucacucuggcagauacagcucccugaacauaauggugcaaucaccacuucaaacaucauuacuaucuaaaauagauaacccacuugcaacuugacuauuuuuauagauauaacauuuucauggagcuuaacugcucuauuugugauuuauuccauuuaaccaaugcaguuucccugaaagugaguuucuuauaucagggucccaauaaccacaauugcccaaauaguugugaaaauuacaguacuuccuaguugucuguuaucucccuguauucaucaccaaaaugacaugagcugaauccuaaaucugaaaaauuauaagcucucugguuuuuauguuuuuggugaccagaagauuguuuugcuccacuucuuauugaucuacuuuuucacauggggaucuuaagaacuguauuauuuauuucugacaagaauuuacuaaauacaccuuauauaaaacucaacucuucgaggcauuaagaaaaucaaauaaauugaggcauuaauaaaguuuuaucacuguauuaaaauacaaauaauucucuauccuauacucagcaaaaaauuaauuaaauauacauuuuaaauggaaauuaguuuuguuuagaauaaaagguaguugugccaaaggaagagagguuuuuuuuuaagauuuugcagcugucucauaaaagauauguuaaauaaacugaaauuucacauaaaauguagaggaagaaaaggagggaggcaacucaauuuuagugcucugaugagcucagauuucuuuaaggaugaaaggggguaguaagagguauaacugcaagcaaacacaaaaaaagaaauauauacuuguccaggaaaaaugcuaauguccuuuuuagcuaaguuugaaaaagagaaaagagguguaacaguucacuaauuucaccuucaguucuggcagaguaaaaggaaaacuguggguaguuuuaaaccacaagauaauuuucuaugauaucuaacaaugccaagaaucuaauucuucccaacuuuuauuuugcuucuauuuucccuauugagaaccauuuucaaaucagaagggauaaacaaauaacuucaggagauuacugaagguccaaacgagaccauaagggacaguaagcugcuuuaaauaaguaugcauauccagacccagaagaauuagaugcaagaggguagaaggaauuuuugccaauacuaggaauuaccaauggcucacugccagaaacaagccauaauaaaguagacugauuuugauggaauuuaaaggauagaucaaaagaaugccauacacuuaaauacagugugaauuuagaaaggcaguagauaaaauaccucacaauauucucacaggaacaauggagagaaauagcugauugucauugcguggcuucaauccugguagaaauaccaugaguaaagacuguuacuuuuaaauuuauacuaaguugaagagaggugcuuuggggauauagcacaguguguugaauuuagguuauagaaaacaugcuuauuacaucucuggaugauacaggggagagaaguuaauacgcugaaagacagacucaagagucagaaagaagaaaaaaaagagucaaaaagauauagagaaauuacaaauacaacauaaaacaaaucagauaaaaaggaacaggaauaauuuaagcucaaucaacacuuuuaaaaguaccagaaaggggaccuggcuucacaggucauugaaaaaaaaaaauaccaggaaauuuuaauugacuguauguucaacaugagccaacaccauuacauggcccagaaaaucuugaccuguagguaggucuuagaucaauaauaaagagauaauaauuucauuguaucauguuuuaauagcugcuauuuuauuuuaauuacauaauacauauucauuacagaacacugaaaauaaagcccaaccacaauuccaccacucaaagaugaauacuaucuucauuuuggcaucuuaucauuccagacuucuuaagcacauuauaaguguucaaacaaacuuauuuuuucuugcaaaaauaagaucauacuauaaaugcuucuuguaaccugcuguccuugguuuucuuauucagccauaauguucuacucuggucaagggacaucuacugcauuuugugaauuucuagucaccauacuuuaagagggucauugcaaaauuugagaauauguaaagaaggaaagagagaguagagaaaaguaugaaaacuaaguucuuaacaucuaugcugucuugccauauaaaagguuaacagagaugauagcucuuccaugaaaaauacuuauaagaaaacaaaaauacaugcaucuaaagaacuauccugcagaugaauuagacugcuuuauauugacccauacagccaaucuacuaccaauugcugaaagucacagggaaguggauuuuagcucaaugaaaagaaaaauuuuaaaauaauuacagcugucaaaaauagaaugaaucuagucauuggaagguuuaacagggcuggaauaacuaacagguaagaaauguuacagagaaaauuuccgcacuaggugagaaguuggaagaaaguucccuccuuauuugacgauucuaugauugcuaugggaaauuuacucccaguccaauaggaagcaaaucuuuagucauuaaggccuuaaagaauacagucaagugcuuuagaggugcaugaaaaauauuaacacuaacgaugaacaccuauaugcuaaauguuuugcauucauuacuuuauacuucauuuaauccuuauaaugaucuuauaugauagguacuauuauuacuauuuccacucugauagaauagugaggcuuagagagguuuuuaaauuuauucaauggcauucuuacauuugcugaaaauugcagugccacccaaaagcauaccugauuccccauuacauaguuacuguugaaaggauaauuucuuauuaccaguagauaacaaguaaucagaagcaucuucagaaaaguucuugucuagugaacccucaaagggcaguugugagauuuuuuuaauuagaaaaaaauaccaaaauuuaaggaauuucaaauuauucuucauagcaaaaaauguucagauuggccugucuaaauuggccacauaccuuuaaacuuuugugaauaaaacagauucaaugaaugagacuuaaaauguuguaaaacaaaucugaaucacagauuuucaaaucuuugccauuauuaauuaagugaccaugggcaaguccuuaaucuuaucuuuuuauuccuucaucugugaaaugacaauggaccuccuaaggcugacacaagaauugaaugagaugacacguguaagcacuuagcauagggucugacaccauuauuacacaacccagguaauaaagcaagcggggaaaaagugccaaacauauucuacaguuccuucuaaaacauuaagaaauuucaaagugucauuauguuugacgggggacacauuuuccauuauccugccaauaaauuucugaugacaaucauuuuugaaauaaagugacaacuaaauaaaaugugccuucuuaggaaugucauuuuaugcaaaugauugcccaaagaauacaauuucaacucucauuuucuucagacacuauucaguauaagauggauaaaagcaaguuuaaagguuauugguuuuguuugugauuuuuacaacuugguucgaaguacucuaauaaacacauguuguuuacuuuuguuuucuaugugcaaucuuuguuguagagcuacuacuacuacuacuacaccagcaaaagagaaaaccucucacucaagauauacacugugggucacuauuuugauacuuuaguguccacuaacauuaaauacuugguguuuuaucccuaaaacuugacaucuauucuuuaaaaaaaaaaaaaaaaaucacagcugggaaaggaguauuuaaaggauguuugcuuuugaguuuugucacaaggaguguuuuuaaaauacgauuuaucacaauaaaauuaagugaaauucucacuguucucaaauaauuccucauguuuucccgaagaaauuguuuauuuugagaaaauucuuucagcauaccaguuuuuagacauaaucauuuuuauaacugauggauccacagcaaacguuguuauuuuacguguaacuuaaaacuguaaagagauaaauugcuuucacauaaacuacaugugacuacaggcaauuauuagagcugcaaucugaaauaugcacacauugucuaccuguguuugaaagagaagauuauuuaacaagggaguacacacaagucaucucuaugaccuauugaaaaaaugucccauaaauauucauucuucugacaugaacuaucauuccaauaaaaugucacugucaacgaguauauagaauaacauauggggcuuuuuaaaaucccaucgacuauuuuucaacucaauuuauuucacuguaauagaaacuuuccauuuucccuuuuagcuagcccuauaauuaauugcacugucugaccaccacaaccuaugagaacuuguguaaagaacgcaaugucaucacccaaaaguuucuauuaagcacuugucaaggguagcauggaacaguuuuuaaaaaaccagggaaaucacuugggcuuucuaaaauuuuuacaacuauaguuggguuauccaagagauguuuuaaggcgaagauaugaaugacaauugaugacuccaaaaauacccaggauaaauuggauagccacgauuuuagaaacuaaagagcuucccuugaauuguaucuagugaauacucuccaggcuuccucccucccaguugauuucauuuguccaucaauacaacuuuuaauaguuucucaaguauggaaaucaaccccgcuauuuccaagguacugcugaaugaagaccuugacauuuuuuuuaaaugucaucuuagaaagauucuccaagcaauaccagucucaccuacgacaucuucacguuaaaaggccucuaccguacuccauauacaguaucccaauaccaaccuggcauccuucauccugagcuauaacaaccaaguuucacucagcuauguccagguaacugaaaguauugcuggggcugccuaaccugccccaucaaguuuuauacacacccugugcugaagacaucucaccagaaagaagguucacucacuucauuuugugggaucauaacccacggcacagcaaacgccuucugcaagagaagguaggagccaccgaaggcuguggcuuuugcaggguaauugcaugcacgcaagagauucucugccaauuucauuuaacuagacaaaaaaggcugcguucaaagcugcaaauauguaauaaauguugauggaaagcgggcggaacgucgauuuucuucaagcaacacuaguacauguacaaguucugcaccagggcucagaggaaaaguagcuuacugacgcauugauggaaggcuauuuuaaaauuacucaaagaaucuaaggcaucaaucugacugggaggcucauaccuccucuccauacacgcagucuguuuuccuaccuaauuuaagaaugaaucgcuggcagccaccaggugcaauaaccgugaggaggaggacguauauccaucacaaugcauaaugaggugugccaaccccggagcuggugcccguccuuaccuuagcagauuagacaggggcagggguccggauccaccgcccaggaucccuccuuuccugccagacaggaguuucuccaccagagccacauuuccagugcgagcagcuuccagcagcuccugguccuuccccauagucucucaccgacucccccacagaguccuugccccccucggguccuccuccccacccacccccacuccccaaaauccagggcccucuucgccccacccuaaaauaaugcaagagcuucagcacggagagcucccugcagccccaggcagggagcacgacucucuccuccucuucggggcgcagcuuuuaca

SEQ ID NO: 21267 - RNA, 141742 nt, Homo sapiens
ucagaaaacuuccagcccgggcagcgcgcgcuuggugcaagacucaggagcuagcagcccgucccccuccgacucuccggugccgccgcugccugcucccgccacccuaggaggcgcggugccacccacuacucuguccucugccugugcuccgugcccgacccuaucccggcggagucuccccauccuccuuugcuuuccgacugcccaaggcacuuucaaucucaaucucuucucucucucucucucucucucucucucucucucucucucucucucucucucucucgcaggguggggggaagaggaggaggaauucuuuccccgccuaacauuucaagggacacaauucacuccaagucucuucccuuuccaagccgcuuccgaagugcucccggugcccgcaacuccugaucccaacccgcgagaggagccucugcgaccucaaagccucucuuccuucucccucgcuucccuccuccucuugcuaccuccaccuccaccgccaccuccaccuccggcacccacccaccgccgccgccgccaccggcagcgccuccuccucuccuccuccuccuccccucuucucuuuuuggcagccgcuggacguccgguguugaugguggcagcggcggcagccuaagcaacagcagcccucgcagcccgccagcucgcgcucgccccgccggcguccccagcccuaucaccucaucucccgaaaggugcugggcagcuccggggcggucgaggcgaagcggcugcagcggcgguagcggcggcgggaggcaggaugagcgcacgcggugagggcgcggggcagccguccacuucagcccagggacaaccugccgccccagcgccucagaagagaggacgcggccgccccaggaagcagcagcaagucaguacgagggcgcggugggggcaccagcccaccccguccccacugccggggcccagacacgcgcggggcggccggagugcgggagcccagucgccgcggccgucgcacacugcccgccggccggccggggggagcggcgcagaccccacgagugcgccgcgcggccccggggcgccagcaacccuccgggcggggagguggggagccgcggcgggcggcccggggaaggcgggagguggggucgggcgaagcgcguccucggacuuucgcuauugugcacggccccgaguggcgcggugucgcccagugacuggaagcgaccgggauccgacaaacccgggcucgcaggcgcuuuccgaguugcuuuugcaacugcccgggaggaaggaggugccggggacccgggcgcuucggccgaucugggcugaaggggcuagagucuugggggccggaggcucuuucucccgccucccggggcugcucgcgggucgggggcuggcgcgccgcagccgcccccuuggcgcccuccuccaagcucucgguggcccaagacucgcgcccucccgacaaagaacgcauggagacccggcugccugguccuuuuugggcucuuuaaauaugcggcggccgccggagggagcccggggcaggggcuacggggagccugguuccccgcaggacgggguuaacucgcccagcuaagggcgcguugaaaggaguguccaagagagugcaggguagccagggucgcuuccuugucaggggcccggucccccuuuugccccuggaucucgcgccucagagcugcagccauuaaaugcucuucuccaaggccaguggccggggguugaguaggggacgaucgaggggcgcccgggacccugcggaguggaggguuuugucugcggaugcaaccaauuaagcgugcagccggcgcuugcagagcugcgcucagcgcgcagggcuggggguuuuguucgcuguaauuuccaagccgcggcgggcagaguuggagcgggauaugucuauugagaacauuuaaacuccacuuucucgggcuuuaaaacuugcucucugcuuagucuuaaaucgcuuccuucauggcaaacacgccgauuagaaaauaauccuagagucccaaaguuguccgagagcaagguggggaaacugaacaauguuugcuugccagugcauuuuagaaaaauugagaguuguaccuuuuugaaaucaucaaaggaaacaagccgaucuagaggccccugaguuuucccgcucugcccaagcgacacuuuacaccgcauuugaauccuguuuuacaccucccaggaagucucugcccucccccacuuguuucccacccgccacccaguucuaacucacuaauugcccccccuccaaaaaaaaaaaaaaaauccaaaagaaauuacaauggggucuggaggugauuggauacuuuaccuuugaguuaaggcagaguucacaaagaaagaaaaauuugucuccgauguguuugcucucgaugugcccacuggugcuaguggucccacagaagcuugcagggaaccuucccgaauucucuaaaugggaugcgaauuuucauugaggacguucauggguuuuaaguuaauuagucucacuuaaucaccgaaucugaaugaaaugugaauagaugauucacuggauaaauauuugggaucuggaauauuaaucaucgcauucucuuaaccacuugaguauuuacuacuuggcauaggagccauuuaaaguuuugcuaaaccaagugauugcuuccauuucucauucccagacacuccauuccuccucgcuuuuaccuccuuuuaguuuucuccacuccacccccauaagaguuuucucaaaagaaaguuuugaagaaaauauguuuauuuuuaucaaaagauauuuaaauuuagacuggaggccaugccugcaucuccaaaaggaaguggagaauugaagcaauuaacuagaugauucaagcaaaaccucccaccauagauuuacuauaauuauuuggaaauuuuagggggaauggaguuauuuugaacugaagaacuugaauaauugcuccaguauuucacucaaaaugugucaguugaaucauaauccaccuagaaggcagguauacaaagaugauuaaaggccaccuuuucaauauggaagauuguugaaauaucugugaugguagcuucguauuucuguuguuugaaaugcuaguauaaugcagagugguguucguuuaaaaugccuauuauuccuaugaguugccaaaugcauagcccuguaaacuuuacaccuuaaaaguauaugacuuucuuucuagaacaugccucuucagucuuuguuaccauuuuagguuugaaguagaaucuaguuuucauauacaaaauagaguuuccucuuugaacccuugcauuaaaaguauaguuauuuccccuuucuguaaacucuguaccaucaucauccauuuaugcuugaacugaacguguuccaacagcucuuuugagcagcacaugcagaaaauauagcuaaagagucagggucaauuucuuucagacauucuugccacaacagcauuuuuuuuucccucacaauuaggaaccaaccggugagcccucuccuaagagacccaggggaagacccaaaggcagcaaaaacaagagucccucuaaagcagcucaaaaggugagauuucucaagucaagcucuccuaacuucaucaaugacugacuacaggagccugccuguaacuuucccauucuaacuccgcagccaggaauuugucccaacuggguaacacaagacucauuucuuacauuuaacauuaguuagaugcgaguuaaccuuuuuuguaagcagaugcucagcauaaaaaguuuaugaagauacuuaacaguguuguuuuuaaacaaacagccaccaaauaauuugaaccuuaaaacggguagaagugaggaaggaagggguugcggggggggcgggaugaaaaugacacaauuaauauuugcaccaguuguaaauaguuaaaaacaaaucaaaacuauagauuuugccuggugguaaaguuuuugcaauuuccucugaaaaaugauaaagauugauuuacuuugugcuuauuacauggcuacugcaaaccaaaucccccuauuaaaguacuuugccaaauagacgauaauuagaaguaaaucuaguugugggauaguggaaaaauuccaugaauuuugcagcuuuaauugugauaauaaaguauacuguuuguuuuacaauaaaccugcaguauaguauaucauaaucucaaaaugccuuuucaucaagugacauagaaaugucugaauuggacaaugagacuuuuuaaaacaaguauuuggcucauuuaauaucucuuuuugggcagaauggaacccaguuaaguguaauauucaguguuuaucuuaauaaguuuaaacuugcaguuuaagauaacuucagguuggcuguguuuaagcuagcaaagaggaacuaugucaggguuaaugcauguauagagaaguaccagucacuuuuuugacuuuauaaauaaauuggaaaaaaaaguuucugcguuguauuuguagguuuguguaguaauugagaacaaaguuucaaaaaucagaacuaaauuuggauauaccuuuucaccgguuuuggguacuccauguacaguauuuguuagaaaggacuauaugcucaucguuuggggauuaauguuuugugugauuuucuuugugacuguggguacuaacuguaauguauguaaacugccauagcaacuaaugguacauauaaaguuauuuaggaaguuacucugaguucuugucuguuuuaacaguuuugaacagaguugaggagcauauuuuuaauauauuuaaauuuaauugcuucuuagaguuuagauuuaauuguuucuuauuuaaucaauaaacuuuaaaauagcucuaaguaaccuuguuauuuaaaaauggcaauauauaaucugguauuuuuaauaugaauacuuuacauuuguuucauuuuaucucauuuauaaauuaacuaaaauggacugauuuuaccaaggaguuuuucuauguuguguaaguguggaguuuaccuaauuuacuuuuauucuaaggagaugcacaaaugaauaucuuguuagauagcugacacgcauuuaagcugugguauaauuccucugaaaaacacaucaugauaauaucuccuaggaagaaaucuuuaaauuucaccauaaauaaguaauuugaaauuuaauacuaaaaaggaaaaugaauugucucccauauuuuacuauauuucauguuuuuuggaugaauagauagaaacgcucccaucgccuccgcuucauuuuaaaaagcuuaccacugacuaacaaaauuuguauugagaaaagggaagcugaagcuagugccuaguuuaccaccuaaagcaaaauuuuuaaaguugaucuauuccuaaguaaggguugauuuauuuuuagugacucuagugacaggcauuuguaaaugaccccccuacgccgcucaucuuucugaaaauucuucauguguaugcauacauuauuccaauuuccaaaacagaaguaggcuuucuuuuuucuaaagauuccuucuccagaaucuuucauucuuucagacacaauuauuuccuacaaugguguuauaaaaaucccucuuguaauaaaaaugaauaaauacauuugcccauaacaugacuuauuuuucuucaguuuuauaaauuacgcuucaucuggagaagagaauaccuugcaaaauaaugaaugacauugaugaaucguucauggcauguguaaacuuaagguauuuucacuuucaaaucagaauuuguugaguauguuacuauucuauauaaauaugauuuucaaacauuuguuuauuaagcauauauuguguucuaacaaaacauauauguucgucaggauuuugcaaugcaaaucuuuuuagaaaaaguuauauuguucauaacauguaagauaaacauacccugugagacugaccagaauagauaugagaagucuucuaugaguaacaaagugaguguuuuccuguaaacugagacccaucacaaugcaaaauacauugcaaagacugguaaguauaugagaagaaagaagccuaaaauuagaggagcugcaaugcacacugaaauccugaugguuauauacuuaaaauuucuugcugcuuggaguuucuugacuuacaaaguuuauauuuggauucaguaauuggccuugggacauuugaaaacaaagcuguugauuugaaaauuaacagugugaaacuggacaaugcaugcagaauguugcaagaccaagugaaugacuacuaaauuagccaucacuucaauuucaaaccauauucaguagaaaauugauuuauauaauauguaaaacaaagacauuuauaagaacacaauuuccuaugcuuggaacuuuuggaagagaagauaauuauucuucaaucuacuuaauauuccauuaaaacuaauuacuaugcaugaccauuguguaaugauucuagucauuccucagaacuccaaucugagugcucaaaauuugucccugaaucaguuucauauaguuaccugaauaaaagaaaucagaaguuaaaguuuuccugaauaauucauuuguccauguguguauacgucugugugagcauaucuuuacccuuuuauuuauuuuuuagucugagguacaccuaugaccaguuaugucuuaacuuccuuuuuuguuuuguuuugcuuugcuuugcuuuccugguugugguggauggaaaucuuugcauuuuuacaguucccagaugguuagagagaaagaaguuauaaucuccuuuaguuuaggguuuuguuguacuuuuuuaaucaugacagaauacuggagggguugucacuaauucuucaguguugaaggucucaggucaaauucaccuuuaaguuuuaagccaauucucauucacauauuuuaggaaguuuuuuucugagguugaauuaaauuuuauuggaaggaaaaugaaaauaaaaaaaaaagaucucaggugugagauaacccuacuucaucaugucauauauuuguucaccacccuuuugacuuuagguguaauggacagaucuaggaagcaaagugcagaaugaaaauaucuagauaaaguaguuauaguuaaaauaauguguucagaguaaauguuuaaucucuauguuugauuugcuauaaaaagaaggccugaauuaauuagauacuguaaagacuacuucaugcuccuucuaaucauuugcauuucucgaaaugugguuugcuuuucauaaucauuacccacaccaaucacagauauuuuaaaaagagagaagauaguuuuagucaccauuucagaaaaaucauucagcauaaaugcugagugaggacagaauuuucuucagaauauaguaggccuaauuaaaaggagaaaccaaagacauuauuauuggugaguuaaggaaagguaacuuuggaaguuaucauauaauucuggccuaugguuucuaaauuaaacuacuaugauuuaguuuaauuccucuguguuucaaugggcagguaaguuuuauugugggauucagggcccuaucugaggauacaaaugaauucaggcggauucagggcccuaucugaggauacaaaugaauucagcaggugaaauuaaguaaaguccaacuguuguuccauuaucuugauauuuaggcugacuuaccuaaacaauugacuaauuuuuuucuuucacuuugccagggaagacaaagccuuacuuaaugcaccagcacauucuaucugguaaugcuuuuaaucaucacagauuaugauccaaauaugggagauugaaauacauuugaauuaucuuaugaaguaauuuuauuucaagggaccuauaguucuacuucucuggaagcucucauccuucugaacucuucugaacuugaagucuccucauuucucuggcugaccuacauuccuggcucauuuuuaucucaaguucucaacagaucauuuugcuaaggagauagaauauaccagauugguauucuauugcauuucaguucuuucuugagaauagaugggugcugaagaggauuuuaugucaguuaaaucauucaaacaugucuugucuuguuaguugacuuucugcaguuuacagagcagaaggcacaaaguggaaacugaauuaauuucacugauucugaagguuuuaguuaugaaucuuuguucugccaaccaagagaaaaggggaaauagagaacuguuauuuguuagggcauugcauuauuucauauuguuuuaauacacugagcaauuuugaauggcauauucuauuuaaauuagggaagaguagugcaggcauucucuuuugucuaggaucauguuugcucagaagguaacuccugugaucaauagcaaugaucucuuguaucauugcuauugauuuuuaugauuacaaagaaguagagagaagauuuggaggagaagaaucuuaaacuuugaaaaugauaacuuugccugucauuuggcuuugguuuuaauuuaguguuuguauacaugaagauaagcaugugcaaaauaaggacaccagaguugacaguaaaggcuaacuuggguaauaggcaggaacuacaaugggugauggaaauuacuuauauuuucuauuggaaaauauauugugauagcaaauuguaaugucucuucaaggcuaaaaguguugcauguaaaauuaggaaacuuacagaacuggauuaucaaaaagguaaaaugagaauuuccucaguacuuagugggauugauucguagaguugauuuugauaucaguguacauugauuuauacuguuuauauuuuuaaaaauagcaacugaaggaaauaaaaugugcuuucuaggcuuuggauagugggcuucaugcaaaucaagauacaugcaaacaagacagggcaccaucacacccaaauauuuuucuaguuuuuuuuuuuuuugguacagaugcacugauggauuugcagugggggauuucuggcuauaucacaguacauaaaaaaaaugaugagagaacuuguaauagcaaaaaauuaauagccaccuaaaccugacccugaagucagaauugaauuauucuuaguuuccaaccucugcucuuguccauguguuuauaggaaacuuggaaauacauuacuuuuaacuaauuugauuuucacccuagaagguuaucuuuuauuuuuuaaauuuuugaauggcaguuuuauuuuauaugggaauagcucuccaaagaacagacacuucacugcauugaaaucagauugggucucaguucuacuaccugugaacaugggcagguugcuuaaucucccauuuguaaaacgggaaguaacaccugcccugcccuacugaaguaagauaaugcuuggaaagucacuuuggaaacuaagaaaauugguaaguauuauauuuguggguagcauuuuaaaauaaggggagggaaaagaaauuacauuugacuaagugcuaaaugccauagcuuuugucaggcacuuuauauauauguuagcuccuuuaauccucugauuuaggcauuguggucuucauuccacaaaugagaaaacugugauucaaagauguaaacaggacauaucugauauucaacucugguaaaugguagcaccuggguuugaauucacuuuaauucuaaagcuuauacucuuuccacuaccaugugcugaauguucuguaaaauauuuguuacaagguagauuucuguuaucuccaguaaccugaaaugcagguuggaaauuacgcuuugggaaaccuuugaagggccacuccaaagguuauaaagggauuggaaauguaugccuucugcgacugauacccacaagacuucugguucccaaauaauaucauggggcuaugucuuugggaauuguaacacauccagaaguuuucuucuuugcuaaaugagagggcuaggugaaauuaucucuaguuuuacugaacucuagaauucugaugauaagagggaaauaagacacacauauaaacacuuuuccuuccuuuccucuugcccucccucccucccuucuuccuccuuccuuuuuuuccuuccuuccuucuuuccuucccucccucacucccucccuuccucccuuccucccucccucccuccguuccucccugccucucucuuugccucccuccuucccuuccuucaacaaguauauagugaacaccuccuguacacgaggcacuagugcuaagcacuguuuucaagcucaagagauguauuugcuagugaauuucuuuccuaauuaguuuuuaaaauaugcaguacauugaagagccuggaguacagaacuucuuagagaaagaaauaauuauauuucccauuuaacauuucuccuaaucuucauggacuugcuucuaaauauaucauaaaauuaaguguacaguuuugaaucugaaguuuaaaacauaaaaauauuaaugagggcaaacaagggagaaaugacacuuuuaaugagauaugauuguuguaaauauucgcauaauagugcugguaacagucugaaauuucaguucuuaccaaugagaauuccgaccauaucucccuuuucucucuugaugugagcaauaaauagugagaauuaguuaugccucuguuauacauggguuuguaguauaaagccaaauucuauucuggcaaaggaaaaccaaauauacacuucuacaguauugcauauguuaaaacaaaacaagccuccugaauguuuuguuugucuuuuuugaaaaauaauauccugaagagcauuaaacacaggaaaacaauauuaaagcugauguuuuccaauauguaaaaauccuggaucuaagcugguuuacaaacuaaaacccuaacuuguuuugcagccuuuguggaguuugauuagaaugauuaaauaauguggguuuuaaagaacaaugaaaaccucccagauugacgccacacagcacagcuaauguguuucuucuagauguagucucagaagaggguuucaguuuacauguaacacuggccugaacgaccaaggagcaaguuugcuuuuaacaaguccgagugauaaucgugauauuuugcccuuuaguuaauggugcaaauuuuauuucucaauaggcuuuuuguaaaugagaugcucauuuaaaagucaucuuauuugcagggcuuuuucuguuuuugagagauuugcuuucucugauuuugaaauacagugaaacucuuucagaaaaaaaaccucucucuucaauagauuuuagauacacccagaucacaucauggccccugaaacauaacaaccgugcagaaaaagccugguguagcacuguuaacuucuaaggucaauaggcuccuucucccacccugacuucacacccccuuuucaauaaaaaggauuucuauuuuccauguuuguguaauuuacuacuggguuaacugugcaaucuuacaguugcuuccaaagauuaagucagaugcugcuucugugcuagagaacuccacacucauguauaacucacuaugcaauagccaaagggauccuuaaaagccucauucuaaaggugacagaugggugugaaggaauacuugcauugaccaaggcuucugugagaggaaacuaacuugaagaaaaacucccuuucugggaggcagaggcgggcggauuacgaggucaggagaucgagaccauccuggcuaacauggugaaaccccgucucuacuaaaaauacaaaaaauuagccgggugugguggcaggcgccuguagucccagcuacuugagaggcugaggcaggagaauggagugaacccgggaggcgcagcuugcagugagcagagaccgcgucacugcacuccagccugggcgacagagcgagacuccgucucaaaaagaaaaaaaaaaaaaaagaaaaacucccuuuaaggguuccaucuaguuaggagugaaagaacacuuauggagcaccucaugggaggcaggaacuucuaaguacuucuaggaaugaugucucacaggaggagucaucuccauugcacggaugaaaccaaauugaggucuucaaggaccugcccaaagucauaaagcuaaaauggaagagcaggaauuggaaucuaagcguuccaagguagagucugugaucuucucagggcaccucccucuccaugaggcaaugcucugaagaggguauuauuuacuugacacucugggcuuucgcuaaauucaugcccuugggacugaagguaagacaaugccacuaaccucugacaacaaaugauuccuuuguggagccauucaaaagugauaauaaacaaugauucagaguguccaaaucagaugguuagauagaaccccuaaaggcuaccagguuuucuuuuguccugggaaauuaacugaaucagugacaauuuuaguuuccuaaaguauuuuuuuaugguagcaaaugcuuguauacuaccggguaguagcauuguuaagaggcuaggagcacagucuuuacaguuagacaaaacuggguucaaaucccaggucugccacuuaccugcuuuguuugugaccuugagccaguuguauaccuaaccuaucuaagacuuaguuguucaucuacaaaauaagaggaauaauaauacccacuuuauaaggcugcuguaaggauuaacguaacacaugugacugacaaucgagugccugggauauuuuaaaugcucaauauuugugaguuaacauuacagucauauagaguuugcguuaauucaugggaccuguuggauaguaaugccagaucagggagauacuauuuggugagaaauguuguggcuuauuuuaucucucaucuaccugucugucuaucugccuauccaucuaucuguuugucaacuaucauguaaagcuauuuguuuuuaccaggcagauugaagagaaaaagaggaaaguuucauuuggcaguguagacagucaauaucacuguaccaaguacccccaccggcugcuaacucagauaacaaaaguaaaauguggaacaagguauccugguucaaguuaccuguauuuguguguuaauauagccauggaugauucuuauacaugaaacaauauguacuaaguuuucuuuauccuaaaaagcaggaacacguuuuuauagauguaugugauauguguguguauugguguguuguuguguaugaagauuggacuagggcugacaaaaacggaaaaacuaauugcuuuauaaauaauguuaacaacugugauaucagaaaaaucuucugugaaguaaagcaaugaaauaaacucucaagauagaaauguauucauguuaagugugggauuaugguuaauaaaguacauuuuuaauuaaucauuauuucuaggcacauauaguuuuaaucacugggacaaacugaugauuucugccugcuuuuuuuuccucugcuuuaggugaacugauugacaggugauuguuucaggcaaggaacauuaaauuaaacauguagaagugugcaaauauuuguuauuuugaauuagaaugcuuguguauucuuuuucacauuuauacuugcuuuugacuaccaauauagguagaagagcuuuguaaauuguaaaguaauaugucaauauuaauuuuugcaacuuuaguugugacauggaaagaaucuugaucaucuuaagaaauauuaauuuucuaaaauacuaacuuauguaguuacagaauguggggauaauguuuuuaauauggacagaaauaaaagcaaaauagcuuuugaaaaagcauuuucauguauuucagaagagaucacuacagggggugucuuuuagggcgagggguugcauagauaccucuuuacaucaugcaaugaagaagaaucuacucagaaauguggaaaaagauuaaccuuagaggagacgaaguuuguuaaaaaaaacaaaaaaaaaaaaaccgauacgucaucugcaaagcagaacauucuuacuucaaaugugucccuuggugcaguacuuauaaacaaugucagguagaaaacuauaaugacuuccuuuuucauuugcagaaagcagaagccacuggagaaaaacggccaagaggcagaccuaggaaaugggugaguaauaagauauaauuuuucuucuuuuuuuuaaagaaaaauuucuguuguauuaaaugagaaaaguuuuauuucgucgauuacaugaauuuccaacuucugguuugaugaaucuuugaaaggguuaagucaagagacaaauuaucaucacuuccuaccacuaggcuccagguguuuacguagaacacuuuucuuuccugaagguggacucauuuuucuaucucuuaucaacaucaaaagaggcuccacucuuccuucaaauaggguaacaaugagaugauuuguucaguagauugaguaacuaaaguuaaaggguauuaugaagccuuggaaguugauuacaaaugguguuaaaauucauacacaauguguaugugauaacuuuuuaacguuuuucuuuuuucuuuuucuuucuuuuucuuuuucuuuuuuuuuuuugguuuucuccauggcuuuuguuuggacacaucucauuuucuagaugguuuguguuuucuuuuucacauggcuuuguuaggaagcaaggguuuauuuugaguuuuucuugcuucccuuaguagucauucuccacaugcaaacauuagagauagcuguauccauacaagugcaccugauccuauaggcacacagauccuguaucuuuugaggccagaaauucaguggucacugaagagcuuugcuaauuuuacugcuugaacuuuguucccuuguuugcuguguuacccauguucuucuggucugucuuucccacugacggagaaaagaaguccuaaaaaugaaugaaaucguuucucaagaaggaugagggcauccuuuauacccaguguugcauaugauggguucuuuggcuuugcuuuuuccucuuccucaauucuuucuucaugcuucaaauuuuaaaaagauuuuuuuuuucuguuaugcuggauuauauguuccuguuugccauuccuuucuccucuagaguucugcaucacuuucuauuuauacuuugguauugccuuucuuuuaauuuauucaucuuauauuuuuccucugcucaacauguguugggauuagauuucuuagcauaaggaaaugggaugaucuuuagaugaaaaacaucucaguguuaaaaugugaccuuaaaguaaggauauuucauucaaccuucuguucauuaaauuaguucucuccaaaccuacuuaucaaguggugaucaucuagcgugcuugauuaccuuuaaaguuagggaacuugcuaccucucaaggcugccucuuucuucuaggaaagcucugcacauuagaaaauuguuccaucugacuaccuguaacuuccguccacugucucuaggucauccuucugggaauauauagaguaauuguuuucacuuucacucaugauagcccugcaaacgguugagggcaauuaacacauacuguuuguauguaucuguguuuguauguaacacauacuccaguuuucucauuuuuuccccauaaaggaacauucuuguuauucuuuucugaacauguuuguucguuaaucuuuugaaagaugucaccuagaacuaaauaucauauuucaaguguggguuccauaaacaguggguuuaucaccuuccuuguuguacauaugguuccaguuaucgauugcugcauaguuaaccacucuaaaacuuaauaguguaaaaaaacuauuuuauuaugcauauggauucuuugggucaaggauaggcaggguagagcagaaagucuugucucugcuccaugaugucuggggccuccacugggaagacucaagcaucaggggaugacuuuaauacuugggauccagaaucuggagcuguuucacuuacaaaucuggugcuuuaucaagauuggcuggaaaucugggcggaucugggagugcgugcacuggaucacccauacauggccuccccaggauaaucaggcuucuuacaugcacucaggacuaccucugggaauuuucugguaacugaggaggaagcugcaaggccuuuuuugccuuagacucggaagucaaaaacugcugcuuccauuauacucuaaugagcacauuguugacuaaguugauacuggcauacauaucaaauagagaucugcuguuuucuaagcaucagaacucugaaaggacaucccauaccauugaacuaauuaauaagaaagacguguauaaucuuucuaauaggcaacauaauagaaaauagaugaguucuuugaagccaugggauuaauguggcuaaaaugaaauuaaauugcaagcgaauacaguggcaguuaaccagcaaacuaaccuccaucauauggggccucuuaacucucucagccuuucaucuccucugcccuugggcuguccuauaauggucaccaauucaccuccauagguuagaguccugucuucuccgaaccuuccuauggcuccacaucuggccagcuaguuaauuacagccugcccuaguacuucgaagucauucaguuuacaucuaccuuucuuuacaguuuucuuucucaccacacauccuuaaacaguugaugauucagccaagcaggaguaaacuauagagcaauuaaaggauauauauguuuuuuuucuuaacggauucuugcuaauuuaggggggaucuggauuucaggcaucagaucuuccugcuggguaagaagcacaugugaggcccccaccacagaaauccuugccuuucugagaauagcugggccauuuucuuugacucuccugguuucuaauuuuuacuggcugugagaauggaaaauauuauguggugaauuguuacaagucccugauuugguccccaaagaagaguuguucuacugagaagaggaaauaaaaggaaauuguauauuuuuucuagacaguguguuuccucuuugcuuguauaucuucuguuggguagaguaugcagccagucacagcaaggcauuccguucaauggcauucuuugcuggaaagcuugugcugaagaaauaaaucauugcguuuuccauaggaaaugggcuuauacuuuauagcaaguucaauucuuuccaacagugucauucaccgauuuccuugaguuagagauauauuuuugaaccgacuggauucauuagguauauggguuagaagccaaauuguuccccuuuuauucuugugggauauuuugcuuuguuuuaaaguucuugugcuucuaaaacuuguuccaguagauauuauagauucauguaagaggccugggaaaagauaccuaccgaggaauccucugaucugauguaauugggauccauauggguaggugugggagagaaacuugcaucagucuugcuuucagaggggaugaagcauuggccaauucagugaucuaacgaguguguuaacuagauuugcuuaagaacacuucuauuguuuacuuuaauucccuucaucuuuuuuuuuuuuuaucccccuaguuugaacuggauuucagaucuauuguuuuuaugagguggucugauuuucaugugugugcguguguguguagaagaggcuagagguaaauugggucucuuuuuuuccuggcuuuuuauaguuaagagcucaggcucuggauucagauggcuuggguucaaauucugguccgucacuuagcuaacuggagucuuaagaaaaucacaugaccuuuaaagguccaguuuccucaucugcaaaagguauauuucucauagaguuguaaggauuaaaugagauaaugcaugcaaagggcuuaauaaagagcauggcacauagguagugcucaguaaauguuggaaauuaugauuaauuucacuguacacuuucauuuugacauuagcuguaggcuaaaccuuaauuacuuacagccaccaguaguuacacauagaaugaaguaacagaguuauaugucagacuaaccaaguacccuugacaguaucauuauguccucaauauauuuaugcugaauauuaaucaaguuuaagaacugcuuauaaauaauacuaaagaacauuuuaauucucuuugcuauuaaggaggaguuuuacauugcagcuuagaagccuuucuuccaauagcagagauuuggugucaugugguguucaucaguuugaaaagaaguauuucugcuguuugccucaagauguacauacagagaugugcugauucucagaacuucuauagaauuccauuagccaguccugccaauugaaauuuggcauuuaauuauuugcauuuuucuauucuugccuaggaaaggagcucgucacauaccuaguuuagugauggaaaguauuuggagaaaguuuuagagaguggggcucaggcucaagaauacaaugaaguaauaaaguuguuaaccucauguauaaaauccuccauccagauguugcuuagugaugcagcuagugcuucuggaggaaaagaagcaagaaccaaauaaugaagacuacaucaaugggaacaagugauacuuuuagguguuuuguucucagaauauuuuaaaagaaaggaaauuaacaacagaagaaaaauauuucccuauaugaauuaaugguuuuuauaagaaaaauaucuuucuggagauacuaagauugaccuagaaauugauccaaggaccagaugcuuaaaguucacuucaauuggucacuagaaagaucccagcaauccccagcugguuucucaggcugcugauucccuuuauuugguaauggggugugugcaguacguugauuaaaaaauaugcauuuccauuccauugcuuuugaaggggggcaguugucuuucucuuauuaaagagcuugugauacacaggaaagugauguaauuuuauauauuagucaaacgugaggauuuuagauaagacagcaaggguuuuuuuccccuaguuuguagaaaucuagaaauuuaagugaugauuugaggaucgagaagggagaacugaaucaaaauaaaaucuacuacacacauucuuugguuuuggaauucuuuggcuuuauucuaaagaucccaagcauuaaugcauugaagaacccggaaaucugauuuugaagcuaaaacauuaaguuuuacauguccauuacuguuucccuccagagagguuugcuacuuacacacacacacacacacacacacacacacacaagcacacacacacacacaaaacaaaaacuuuuagcuguuuguaauuuaagacuuuccuuguugaaaguggcugggcaugguggcucaugccuguaaucccagcacuuugggaggccaaggcgggcagaucacuugaggccaggaguucgagaccagccuggccaacauggugaaaccccauguccaucaauaauacaaaaacuaccugagugugguggcccaugccuguagucccagcuauucaggaggcugagguaggagaauugcuugaaccugggaggcagagguugcagugagcuuggugaucaugccacugcacuacagccugggcaacagagcaagacuccaucucaaaaaaaaaaaaaaaaaaagaaauauauaacugcaauguuuagaaagggauauccaauaaugcagauugaagauaauugcaacuuuguacuggagucagaggggaagaaauaacuuugauaugacaucaaaaacugucugcuaauggaaugugugaaggugaaaucauuuucccuuagacccuugccauuaucacgugcuuuaaaaaacaggagaugcucuuuuuaaagcaacugcauuuuuaaaauacaugcuuaguaauuaaauauaaauuugcugaugcauauaaugcauucaaaguugguaaguaauauuuucugaaacuaucuuuuccuuugcaauauuuuaugauaaaaauagaguacuuuucaaauuuuuucccuauggggaaaaguagcuuaaucuuauuuuaauaguuuaccacaaaauucacuaaagagauuauuuaaaauuaaaagauuaaauaugaaaacacuaauaagucauaucuaaaagugaagaauugaauuugaucauucauguuuugauucaauacuaacaucuuuuucauuuguuuuaauauguaagugcuauucuuaauuauucuguuaaaugaagacuuucaaaaaaagagauugauaaucugcccuacuuggucagccaguucauccaguuuagcauggccaaccucuaccagacccuaaccauuuaggauuauaaaaacauugacugcagagucugaagcuccaguggcuuugcugcugugccaaaauagcaucgacuaucaccaaggaagaagagauuuuucucacuuguguggaguggcaaauucuagacaggagguaguucauaaaaauaucuuauuucuccauaugcuaucaucagaucaauagaguccuggccaagacaguaaucucaauuuuuaauucuaauaaaaugacaaauguagaaucagugaccauuuuguaugacaacaaauguauguaagacuuuccuuacacaguguacuaucccuacucccauacacauauuuaccuacauucaccuuacuguaaguauuuauggaugguaguaaauauuucuaaaagguuggaaauccccaugcuguauauuaauaaaauuaauaugccacguuuuuuuaacuagguaaacaaguaaaaugauuauauuccaggagaacauuuuuguuguguuuuuaaagguggaggcugcuuuuauaagcguuuuuguuuuuguuuuguuucguuuuguuuuguuuucgagacaguuucgcucugucacccagguuggagugcaguggcaaaaucucagcucauugcaguuucugccucccggguucaagugauucuccuaucucagccuccugaguagcugggacuauagucccacgccaccaugccuggcuaauuuuuguuuuuuuaguagagacgcaguuucgccauguuggccaggcuggucuugaacuccugacuucaggugauccucccaccucagccuccaaaaguguugggauuacaggcgugagucaccacucacggccuuuaagauuuuuuuuaaaaaucaaggaauuccugauucuaaacucuucaauacuugacacaaacauuuaaacauuuuugacaaaagaugggaugaaaucaagccuacuccuuguauuccagauugaaaaaaggaccucugcguuuugaugggcugaauaccuuugggcagguugcuuaauuuauccgugccuuuucucaugucuaagugccugacaggaacauucuguccauaacuaauggcugucaagcauuuaugguuguaaaacacaaaaaccuuuauugcuccagccagcucuaucauccagggacugauuauugaguuugugaugauccagccucuuguccccuucuuugcuuuguuuucucuccuccccccugcugccugcccuuuggccauuucacugcucauuagcgccuccaccagauggggggcagggucaggaacagggggucagcucugguaaaaggcuugguaagaaggaggcugagaguaacagccaacauaagguuuucagauuaucuacauccaggcucgcccccaacccuguccucaggaaucacugaaugcagccaugacacugaaauuuguuuuucauucauuauuuuuucauucuuacaauaaacgugguuuuauaaguuaguuaaaaagucuuuuucaggaugccguaguaaacaagagucccuuuugagcauuuccuuaguaaacgaugaauggcugcuggucaagcuuguucuggcaagucuuuagccucuguucagauucagaagaauggcaucaaaucuaugcuuacauuagacucagguuguggaauguaguucuuucaauucagguuuagugaauuugucuuaugaugcugaaagaguccuguuuggguguuaagaggccacagagcuaacccuaacuauaugaccagggaaagcccguguuaucacauuguacuguaauuucagugcauuaacucagaaaaugcaccucgagugccuguuuaaacgugauguugugcagaaggaacagcauguacaggacagagauagagacggaggcuacugaaacacuuuuuuuguuguuguuguucaccuauuugguugcuugucucuuucuuggcuggaucauuuaaacccuagaguuccaguucugagacccuuugauuuugugauuuucccauuugucuaaacauuuugccaaagccuucugacacgauuauaaaucaagucugugcuggguccuagggaugucaaggcugacaagauagguggggcugccuuuggggaauuuauagucuggggagcucuaaagagauaaccugauaccugccagguagauuauuauucuaugcuucagauguuaggaggcuaaauuaaauuacaguuuucaaguauuuugagcucuuuagaauuuaaguccuuccauagaaguaauuauauugcuuuccaaauccuaaugacacacuauuugaauuuaccuauauuaacaccauaauuugaauguucauguauauguauacauacauacuauauauauacacacacacacuuauauaugauauaugaauugguugugcuaugugcugugugccugggguuacauucucucauuaucuucacagcaaauauauaagcuaauacaaaauguauacagauuugauuuaucaaaguagucaaauuucaucuaguuaguauuggguuaaaaagauggguguuaaaucgucagguacaggcuccaaaaagagggagaaaaagggaaucagaaaaaaacaggaaaauucuguugagccauuuaacauauggugaccuuauuuuuccucuuugugcauacucaauauaauuuaugcuuaucaaauaauuuuuaaaucaccaggucuuauagcaacuuaauuauauacuuuaauauuucugaauagugcagcccuuuguguuuuaaaaugagcucuuugaggguugggugcauaucuccuauuuaucuuuuuaaccucagcaccuaggacauaggagggaauucagcaaagugauuaagagcucagacugccuggguucagguaucagcuuaaucaaggcaaguuguugaucaucccagccccaguuucccuguguguaaaacaaaggguaaucauaguuuuugucugguaggauuguuucauaagaauuaaaugagaagccaucaaaaaaacuuuauucagcaugugucaagcucucaauaggucauaauuguugauguuaguacagucucaggcccauaauggugcuuacuaaauguucggugaguaggaugacaguuuuucuuuaguguguauaaaggauggccuuugaauuuuuguuuuccaguaaugaauguggauuugaauuacauucuuugacuuaaaaaaauccaaacuaaugauuuguauuuccaaagaggcuacagcagguuuuuuuuaaaaagcacaaccuauaggcaucaaagcaguauuuguaauaauuuugaauuccaucuuaugccucuccacuaaagaaguaagcugcuagccacuaucacccaggcccaauagaaacuucgaaugucuugcccuauguuaauguuuccauucccucacuccuggaaauagcauucugcuuuccaaaauagacucuuaugcuguaccuuagaaggauuuuugucacaauuuuggaucaucagaaaaacagaagacagcuuuauuggccaaaccucaugaacuaauuuucuaagguaguuucucuuucucucucucuuuuuacaaaaacuuauuuuaauggccuauuugugucccauuuucuuucuguuaauuuuuaguacuaacaugagaauaaagaaaaguaaaaagucaauuacucuauuuguuucuuucaagggcauuugaaagcacuuaaagugauacauuaaggcaguaggguguacaacuaaagauuuacuggggacaacaaccugaaauccuaggcuuaugucaacaugggaguaaguacuucaguuagaauaauagcuagcaauguuacauaacuuaaaaguuuaaggccgggugcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaggcggagcuugcagugagccgagauugcgccacugcaguccgcaguccgaccugggcgacagagcgagacuccgucucaaaaaaaaaaaaaguuuaagcauuaccaauaacggaagugcagguuuaccaaguucccagaaaacccaaauaucuucaauauuaaggcaguuccccagugcaggaagcacuaaaucccaagaaggugagauaauaacuguaugugcauggaggaacauggacucauacgauuaugguugguaauguucuagaaagcacuguuuguuuugcggucccuuauuauuuccuguucagaaugauucugaugucagaaaagauacauccuacgcaguuugugucagaagcugauccucgaguguaauuuccuuauuacagggucucugucccuacauuuucuuuccugccauuauucucucagguaguccaacuucaguauuccuuaaauucucuaguggaaacuugaugaggcauuugcaugccugggcccacucuccuagggguggaguuagaauguaugaacauggccaucucuguguccccucauucucuugagagauggacauucuuggcacuggaugcacaccuuauaaguuuuaaggaaaggaugaaaaggcaaugagugauaaugcuguccaucuuauaacauguucauucugugcuauuaaucuaaaauuucucuuuuaagagaaaguauaguuugauuuacaaaucaauaaauaaaucccuuauuccccuuucauaucuuuggacuacauauuuuccauauauauuuggugaaaaauaucucauucccaguccuaauucuccuuauuauaauuucuuacauagcaaugugguagagcuuaaugacauuguuuggauuugcuauugagauuuuccuaaaugagaguggucaucuccagacuaccaaaccaagacaaugguaggcucuguauuuuuuuuuuuuuuuuuuuuuuuugaggcuggagugcaauggcgcgauccuggcuuacugcaaccuccgccucccggguucaggcgauucuuaagccacagccucucgaguagcugggauuacaggugccugccaccacgccuggcuaauuuuuguauuuuuaguagagacaggguuucaccauguuggccaggcuggucucaaacuccugaccucaaaugguccgccugcuucagccucccauagugcugggauuacaggcgugagccacugugccuagccucuauuuuuuauuuaguauugcccuuccucuauuggugguugaauuuuuuguggauauuaaaauuugucaucaaaucagccaggcuuaaaguuuugugccuuccauccuguuuagacaauugaugagcuacauaaaaccauuuaaaauccauaauuuuauaagcaauaaauagguaauuuuuucuaacauguagucccccucgcuauuaaaucacucaucuuaguggagaucaguugggauccuuuucaacuguuaagaccuaugggaacaaagcuguuacagcuaugacccuauuugcacuguuggaaguucuuagggagccacaguauuuacaggaaacuaauucacacuaaacucacuuguacugcauuguuuccugcuaugauaaagcaaauggguuauguauauuauugcuuuaauagaaugaucaaugcacuuagauuguguagugugagagagcuuggccuuacauagucacaguaugaagagaccgaauuuuuuuuuuuuuuuacuaaaaaaaaagacuuuucugcugggauuguaauaaugugguaaguauucagacuuacuauuugcuaucuuugaaacaaauauauuacaauaaacauuuagagaagcugacauuuuauauccauaaggcaaacacaaaauuucccaauuuguaugaaaauuuggguguuuuauccugugcuuuuauuuauuuuuuuauuuuugagucugagauauuuuuguguccaagaaaauguuuagauuaauucacuugcagucuugaaguuaucuuugguagaaaaacauccuuauguguaugaaaaaagcaauuuagaaaggagauuucaugagcauccuugacagugguguacaaguuuaaucgucuuuccugugacaggagggucuucauguauucaaccuagaauuucuccuuuuacgguucuuaguccauuuccucuugucuuguucuuaauggugacagagaacaucugcuauguuccucuucaaaauauaucuuccuacuugggguacuguaaaguguacguacuuugggucuuaacauaucugcauuugagucugaaccuuaucacuuacuaaccuuaggccuuuguuaccucucugagacuaaauuucuucuuuugugaaaugaggcugguaauaucuccauuguaguuucagcuaaaguauccaguaccuaguaaaugcucaaaauaccauuauuuuggccuggcacaguggcucaggccuguaauuccagcacuuucggaggccgaggcaggucaaucacuugaggucaggaguucgagaccagccuggccaacaaggugaaaccccaucucuacuaaaaauacaaaaaauuagccgggugugguggcgcaugccuguaauccuagcuacuugggaggcugaagccggagaaucacuugaaccugggaggcagagguugcagugagcugagauugcaccauggcacuccagccugggugacaagagcgaaacuccaucucaaaaacaaaaacaaaaaccaagaaauuagacagcugugguggcgggcaccuguaauuccagcgagcagcuugaacucaggaggcggaguuuggagugagccaagaucaugccacugccugggcaacaaagcgagacucugucucaaaacaacaacaacaacaaaaaaucauuaguuuuaaacccugugaaaauauguugucagcuuuccauuuuccacaauaacauucccaagucuuucucacuauguccuguuuuucuaacccacuaaucacgguucugaaugagacuucaaaugauaugguagauggaacacuacguucgugaugaaaggccuuucugacuugcauucugacuuaaugaauuucuagcuuugugaccuuggacaggugacuuauccuugaaccugcuugcucuuauguaaaagagggauaauaauugucauaucuucuuugucuuccugucuggguuguggucagaauaauauaagaaaguaauuuguacuuuguacaaauuuguacaagguacaguuuguacaaauaauaauuuguacaaauaauuugaaaguaauuuguacuuuguacaaauuuguacaaaguacaauuugugcaaauaauuuguacaaauaauuuguacaaauaaagcaccuugcaaucauaagguaacagcaguaaguaucagcaauuaaaauuucauacacuagcuggaugcgggggcucacgccuacaaucccagcaccuggggaggccaaggcagguggaucaccugaggucaggaguucgagaccugccuggccaacauggugaaaccccaucucuacuaaagaaaaaaauacaaaaauuagcugagcaugguggcgcgcugcuguaaucccagcuacucgggagacugaggccaaagaaucucuugaacucgggagguggagguugcagugagcugagauugcaccacuguacucuggccugggugacagagcgagacucuguuucaaaaaauaauaauaauaauaauuaaaauuucauauacuacaauagggugaaugaaauuguuccuguuauuuauauaacuucuaacacuuagcuugcuaucuucagcuuuucccuugucuuaucuaaugguuuaugaggcauuuacucuuuuuccauuuccaucugcucuuaugguugaaaggcuaaaacugacaacuuucagauguaucacagagacauaucaaaagaauuccaacaugaaagguauuggguucaugugcagaaguagugaauaaauaagcaggguugggugagguuaagagagugccacaugaucuaugugguaauaaauaggugaagugcccaggagagagagaugagcagaagagaccucuccaguaguagacauugaagaggaggauuuuagaauucgucucuuaagacauucacugccaaguuccaacagaacaucauggacaaaacauaucuaaaugagaaggaaacuuugggacauugaggauggcuuggaguggaaaugaccuggaagguugcagugaucccaggcaggagaggacaauggccgugucugcagugguacagucugagggggaagguugccgacugacguguggggaacugggaguguggcacuggagaagaccaguuggaaaauugauuguccuggcugugacagcugaaccaugaggacugucuaagagcacugaaacuggggagaaaagaaaguagccuggacaugguaaugcuuaaaugaauacuuacaugugauaccguaauuaucaacagauuuaaaaucuguugaauauacuguucaaguuuaaaucuguugaauauacuguucaaguuuauagaagcaagaaacuuccccccauauuuguacuguauuaaucuuuugguuuccuugccucaauucaguuuuguuucauauuuaauuauggggcugaaaguacauaaguuugaguagucuagaguggaaugugguuaaauaucccugcagauuacuuuauguguuucaguauucuaauaaaaucagccgcagugauccauaugggauuuguagaugcuguuuucccgaggcccuuuucucuauggcugucugugaccuuagccauugacucgcuuaaucguuuuuggccuccuaagucagugauucugagcgggcagagugguaaugugaugucaugucuggggcaugagccugcauccucgccgcacaggggucccacccuuccuggucuaggcagcucaaugcacagugcuuggcgcaucgugagugcucaauaaauucaguugcuuuucccgucucucucuggaucucaaauagaaauauccaaauuugagaaugccaccaaagcauuaaguucccuaauuaaaguccauaguaaaagcugaggcagaugugugggaaugcaguuccagacacuguaguuaaucuaggagagaugaucgcacuguauuuacaacaaggcuucccaugcucaugaaucauaagaacucuuacaggauuaaugaguuuuaacuuaaugcagaauuuuuaaacuauguguaaugcugggacauuucaaaguguuugucaugaaaaauggcugaugaagguacacauuucgagauauccuguguuccaccuacguuguuuguuaucuuguugacaucuucuguuccuuuuacaaaaaggucagaaggaagucccuccacauuuucuguagauugcuagauaagagaaacaucaauauagaaaggaacauuuugauagccuuacacauuuauguuuuucaaaauaaaaaaauucuuuaaauaaaacuuucuuucgugcccuuucucugguagagagaaaaauuagcccccuuuucuuucagagacgugccuugugggcuuugaccaguuuuccccuaaugcuggcauuuuguaaaacuguagaacaagaucucaauuaggauguugacauucacacaauccauucaucgcgauuagauuuccccaguuucgcauguacuuauuuguguguguguaugugugagcaucaaguuauauacaacuuuaucacauguagguucauguauucacuaccaaagguauuauuauuuuuuaaguuccagggugcaugugcaggaugugcagguuuguuacauagguaaaugugugccauggugguuugcugcaucuaucaacccaucagcuagguauuaagcccaacaugcauuagcuauucuuccugaugcucucccuccccacuccgguauucuuuuaagacugucaguugcucaggaguuuguggcacaucccaugaugacauacacuaaauuugucuucucuaaguacacaagaacuuugcaugacuguaggaauguggggagaggaauucuggcccaugguuccugucuuuggcugugcaguuacucuuucacauucccucauuauaaaggucuggcuggcccuggcaaaaucauaggugggcuuugcacacagcuaacugcuugccugaaguaacuuacacuuuuguacugcauucagaguucugccaacuucagaggccaggaaagaaagaaaggauuggccugggaguguaacacaccugcuuuuccugaaggcacauacaacaggcguauuugaguaccugcuugcccuuugggauauauugaaacacaugccuguuucguccugaaguuguggaugaauaccuucauccccuggaaauuccuuguuucacauagauuuuaaauguccuugcgggcagauauucacugagaaaacuguccuguuaauuguacuuuggcuaucuggcccagucucuagaacaauuauaguagaaccaugucaucuugacacauuuaggaagauccacauuugagaaugccacuguaauguuuagguuccccaaauaaaaauuucauauuacaacuaugucucucucuuuccuuucucucucccucucuuucucuuucucucucucucucucucucacacacacacacacacacacacacacacacagagcaaagcugugcuaagaugcaaacacuaggcagauggccaaguugccccuccaggcuaaaugucucaggccugcacucuagucugagaaaaaauggauuugcaaacaguucaaacugugaauauuaacauuuaagaauggccaaggucuauugcauuccacuagucacucuuagaaucugaguguuuguuuagguaaccagaacacagaugaugaugaugaugaugaugaugaugaugaugaugauaaugauugaucauaauaacugaagaguaaaacacuaucaaugugaucauuaugggauucuuuuggagaauacauuuaguauauuuggaccaaaagcccuguuggauccuaaaucccagcuaugcuguggcauacaaagagcuguuuuuucuuuuuuuuuuuuuggacuaaugcuuuuugacuauuggcacuucaaauaucuacgaauuacaagugauauucuuuauuuuuggugguaacuauuaucuuauuuaaacaaaaaucaugcuuuugaaucagcuguagacauuuuugacaaucuuggaagugcagaaaaaguuauauuugaaagaaaauaauuauagaauaucagcauaugcugcuguugcuuccauagcaaacuccuuugggccuuacucaaccaaaauaaauguggccacauugcugcaguaagcauggcuugaggcaaauggaagacugcaguucuguuuccuguguccugcuuucugucccugagguccaagcaaugccagaacagugaauuugaaaguauuaaaauguuggucugugugguccuuggucuucccaucuauaaagcuagacuugguguagagauuauauaguuaaauccucuuauauucuacaggugacaaaaugaaaacccagagcaauuguguccaguucaaggccacacaaccuuguuagcucugacaagagccagguuuccugacuucuaguccauugcuuuucccuguagcgagccgcuuccucuugccucacccgaucuuccuuggauuuccauugggaauguugaccacaguucugauaaaucucuuccuucagguccuguguuaguuucuucagggcugccauaacaaagugccacaaacuugggugcuuuaccacaacagaaauuugcucuuucacagucuggaaacuggaagucugacaucaugguguuggcagggccgugcucucccugaaggcucuagggaagaaucuguuccaucucuuucccuucacuucuggugcuguuggugauccuugaugcuccuuggcuuuuagaugcauugcuccauucucugccuugguugccacauggugguaacagcaguuccugugugucugugucucuuuuccucuuauaaggacaccagccauauuugauuagggcccaccccacugacuucauccuaccuugauuauaucugccaagaccuuauuuccaaauaaagucacauucauagagacaagguggguuagggcuucacuauaucuuuuuaggggacacaauucaacccauaacaguucuuuauaacuuuaaaccuguuagaaccaggcugguauuuguaaugcauaaugagaaacugcagugaauuucauuaaguguaaagcaucauauccaacauuuguaguuuguuacaauaacacauucaaaagauuuauagacugcuuuuggugugauuuuuggauuaauucccucuuuugaagacauuuguugggcuuaguuuauuuuaaggaaggaaugaauagaccugaaaacaccuaauuuuuauuuucaauuuagccuggaagcuagcaaaagcuuuugcagagaacugaaacugugucacagagcaccagcacuguauuuguuaucauuuuggccuucaguuuuauuaaugcuuguuugauguguuaagccccuagcuaagacaaaaagacagaacuuuaggguuuuuguuuguuuuagcaguaauaaagucuagaauaaaauguuugcucuauaauauuuaaugguguguauucaauuuuuaaaccaaaauuuaaaagaaagaaaucccauucucauucagcacugucaaauguauucauucccccagacuucacugguugaauauaauaauuuguguguauaaacagucuuccugacugcauucucuuuaauauucauuuaucaauuugggaggaaauuuccaaauaaccuuuauuugcaccuuaaaaaaauaguuuuaaacgaagucaugggaauggauugcucugucuuuuacugacuuuuauauaugugauuccaaaccucccuuuaaauuaaugucuuuuagcuucaaauauaccucuucccauaaggcuaguccccauuuccuauaaucuuacagaccuaggagaacaauauuuucccuucugucguuuugauaauuacauccucugugcucagugguggccuauuaacucacaugaauaccaugggcuugcaaaauggccucaaauuuccauauauuggaacugugagaacuuucuauaauggugcuuuagcaauaaugauggaggugcaggcauuuccugaggauuaaugaccagcugggaggaaccaguggcccuuggcucugccucccagccagccauuaauucuaaggaaaugucuuuugcugaggucguuacugcuauuauaagcuuaaaauggaaaaacauaauaggcauaugaguuauuuuuauggguugaugcaguuuccaaugguguguacuaauuugagaaaaugaauguguauacauacaagaguaagucagauuguuagacucaucccucaguauuccauauguuuugugacugauuuuacaguucucucuaccuuucucauuuacaaaaaaaaaaaagaaaagaaaauuugauucagcaauuccuaaaaguauuguauucagugacaucuuuggaaacaccaguuucuguuaucaacuucaaauaauagucaaguuuuauguaugaucuaaagggaaaacaaguuuguuuuucaauccugugauaauuuuucuuuuagaaugaaguguugcaagaaaugaaaaauuaaaaaaaccacucuguaacaauuuugcugugcuucuuugauuuuucucuguuuuuguuuaauggguaccuuauauuuguaccuuuacauauugaauucaugagagaguuaugcacagccuaguuauuugacauuccagggguuuaaaaaaauguauauuaaauauugcaguaauggugaaugcuuuaacauaaaaccacaaaaaaccuccuaaaaauaaagccaaagagucuaaaucucgcucacugugcuucuuucugauuauuuuuaaaaggcagcccuucuuguacaguauuucuacuuuuuauucuaaucaacuggacuguugcauuauuuuuauguagauugcuaacaagguuuuugaagaaacacucuuaaaagucauaaaagggaaaaucuugacaguucugggauauugccacccuugaccuuuuggagaaauguagacagcaucucccaggcaugacgccuagggaucguguuuaucugucaucaguuggugacuccauguuuauugagcacuggcuauaagccagacuuggugagggacugaaacaauuacaagacacaguucugcacuggaagaaauaggaaucaaccuaagauuuccuguccugcuaggucaucagguuccugucccacuacuuuccuuccucuaccaaauucacuuauagccuccaaguaguguaacuaucaauagcaccccuuucacuccccaaaguguccuaauuuggagaguaaguuguaugaucacccuaccuacagucugccuguuuuccaaugcacacuuugucucuccccugcucuuguuacauguguguccugaggccacuuccagauuguucuuccucugucauuacuccagcaugucauugcuuugcucagaaacugcuaacugggucuucauuugugguuaaauaauaccauuuuucuuauauacauguagccgaaagcucuauuuccaauauggaaauaacuaagaguaaacauccuauuccaugaacaggacgaacacuuucucaccuucacuuuuaccugcaauuuccuucuuccauuuucagcugcuuaaaaucuucuuuaaucuucaaaguccaguuuagacagcaccuuuuaugaauuagcuccuuacugcccuagucagaagugggcugucucauccuuguaggaggguaaacacgcauugcagaugcuucucaacuugccaugggguuauguccugauacacucauuggaaguugaaaauaucaucagucaaaaaugcauuuaggccgugugcaguggcuuacucuuguagucccagcauuuugggagccugagaugggaggauugcuugagcccaggaguuugagaccagccugggcaauauaguaaugccccaucucuaaaaaaaaaaaaaaaauuaaaaauuagccaggugugugguggcacacaccuauagucccagcuacucgggaggcugaggugggaaaaugcuugagccuggcaugucuagccuucagugagccaugacugugcuacugcacuccagccugggcaacagagcaagacucugucugaaaagaaaagaaaagaaaagagaaaaggaaaaagggcauuuaagacaucucaccuacugaacauccuagcuucgccuagccuaccuuaaauaugcucagaacaguuacacugccuacagucugagaauauuuacauuaaauaugcucggaacacuuacauuggccuacagucaucuuacacaaagccuguuuuauaagaaaguguugaauaucucauguaacuuacugaauacuguacugaaagugaaaaacagaaugguuguauggauauuugaaguauaauuucuacugaacguguaucacuuucacaccaucguaaagccaaaaaauuccagucaggccaucauaggucagggacugucuguaugaaugccuugcuuucauuauagcauucuccauuuucucuuguacugguaauuuuugaacaguuaucuuuaccaguuuuguaaacuccuugagaacaguuuugcauuuucuucaaaaccuaggacugugguauacaguaaccgcuuaauacaauauuuguuaaaugaagaacaaaaaauacguggcuaggcuacucaggucauucccacaaaaugauuucuuuaaacugcguaauuggaaguuuuuguuuuuucaaaaaaguauguccacaguauuaugucauuaauuacuauacccugaggaauuacugcugcugcuaaucucuuggauucaguacuuagagacauaaauauaagugacauuagcacugcuacuguucaaugagauuacaaaauagaaaguagacauagaagcagauguuggaaaauauucucaaagauaacaaaauguagaauaucuuacuaggccugguucagggacauaggcuaagcugaagcugccacacaugguguuugacuucauggcacacuuuucugcagaacuggaaaaagaugugucuacuuuggggcauuuucuucaaaauuaagaaaaaaacgugucuaugauugauuuuaaaaaagauaauuuaggccaggugugguggcucaugccuauaaucccagcacuuugagaggccaaggcagguggaucacgaggucuggaguucgagaccauccuggccaacauggugaaacucugucucuacugaaaauacaaaaaaugagcgggcauggugacacaugccuguggucccagcuacuugggaggcugaggcaggagaaucgcuugaaccugggagguggagguugcagugagcccagaucgugccaccgcaccuccagccuggcgacagagcaagacuccgucucaaaacaaaacaaaacaaaacaaaacaaaaaaagguaauuuaagaaaacaauacaugcuauuguauuggauggauaaaacagagcguuccaugugacaaaaccuguauguaaacguauuucuuauuuuuuaaucaucauuuuauauaugugggucacuauggaacacugcguucagaaaauaaauuacuuuucuuuuucaaaauauugcauugguaguuucaucucguuuuagguaauauugauuuauccuaaauugguaaaaaaaaaaaaaaaaaaccuagauacuauauauauuuaauuuaagcaccuuguaguuccauggaaaacaaacugauaaaauuuuaagaguaaauugaguaaauaaauauagauuauacuuaaauuuuuuuucucucugugaacuggcuuuaaagauaugcuuuaacauuuaauauaacaacauauuuuugaaaaaaaaauccguuuuugugcaacauguuucuuuuuuuuuuuuuuuggaaugaaguuucgcucuuguugcccaggcuggagcgcaauggcgcgaucucggcucacugcaaccucugccuccccaguucaagcgauucuccugcuucagccuccugaguaucugggauuacaggcgcccaccaccacgcccggcuaauuuucguuuauuuaguagagacgggguuucaccauguugaucaggcuggucuuagucuucugaccucaggugauccacccgccucggccucccaaagugcugggauuacaggugugagccaccacgccuggcugugcaacauguuucuaagugaacaguaugacuucagagagucauacuguuuuaagagaguuaacaaaagaauaagcauuggauauacuuaccuuuuuucagauguuauaacaaauuuaccaaaaugcaccauacacacacacacacacacacacacacacacauuccauaacuucaaacaacagaaaaugggauucugucugucucugugucccacaaucaguaccaccaccacuacuacaguuugcuuuuauuauaguauuaucaauuuucugcaaauaagccuaaaugucuuagguaguucuacauuuuuauauuacacaguaauugaggaaaaacuaaauauuuuugaaagugcauuuaaaauacuacuuuagaacaauuaaucuacuuggguguacaaaaugaaagccaguuguuagaaaucucuuauacuacaaaaauuaaaaaaguguuaagcaucaaggauuagaccuggacuagaaguaugugucacuugguggaugaccaugcaacucaagaagaggaagaguggauuuagaauucaagauagagaugaaacacucauguacuuagugugugugaaguuuaggagagggagcugagcugauggagccaugggucacaguagcugaagccauggcuguggauaaagaucccaagagaauguggaaaaugaaaugugauauagaaaguggagaagaaagggaauauggggaccacugcacacaaaggagauaauauagguugucaacugccaacggcaguauguggaccaguggucuuuaccacauccuucuccagcugucccaccguccacacgaacuuacgcaugcuucccuugcucuacccacccaugcucagcucaugguaauuggcauggcuguuucauaucuauuaggucacuagacugagcuuaccacugggauaaucaacaacagcagugaacccuaaauccugacgacacuaucagcacuuaaguagagcuggggaaugaaacuagaauucuuuuggggccagaucauuaacucauaucuagugacaccccauuuugccucuggaaaaguuaagguuuuguugugcaauuagcuuuacagaauggagcauuucuguugguuuacuaaaacuguuaagccaaaauagggcacaagugcaaguccuggcuccagaaguuggcuguaccuuccuuucugcaguacaaggugaacaucuguaaagaagaaugcaaugucccggguguguuuaaacugacugccuuggccucaaacuaaaacuguuaagccaaaacagggcacaagugcaaguccugguucccgaaauugacugcaccuuccuuucugcaguaugaggugaacaucuguaaagaggaguacagugucccugguguguuuacacugacugccuuguuuucaaggaucauuagauuucaaagaaaaaaaaaucacaacaauauccuuugcauggaccagaugaugagaaacuaaauuguaauuugggauucauucacaagaaaaguccugaaugguuuucccauggacaggaucuuggagguuaggaauaccaaauccugugcccagcucagucucacugacuagggaauguugucuuuagacuacagaagucgcaacccucaccccaaaacaugaaguauucaaaccuuuugaagggugugauguuuccagguaauuuggcuuggcacaggaauugcauuuaugcccaacuuuggcuaagcgauuuuaguaguccagcaaaaaugcucuguucuguaaagguaauugcaaaacaauaucuucauuucuccagauggaaaaugggauaugaaaauccaccaaaggaaagaaauaucauuucccgcacuguggcucugcaaucuuagaaggguuccaugaauauuauguaugugcaguaaacauuuaugaccuuauuuagguccaagcagcaugagggauuuugugcuaguaguuguugaugagcacuacaaauagggauccuuuauaucugagguauccauaguaacuaaguagggcccauuuccaucgugcuuauuugcuuccaaccugccaaccaugcuuagacucugagggcuccaggauuccuaauucauaaaaaaaacaccccagagagguggguaagugcuuuucagaaaaagcaaacuuaagcaagugauuuuaagagauuugaagagugcuacauggcagccaagaugauaauuuuuuggcccaaauauaaauuuaauugaguaguguuauaaagacaaaauuacauagccagaaacagaauuaugagcauuaggaaaauaauaguguugucuuccaucuccuugaaauccccuguuauguuacucacuccacuguugacuauuuuguagauagcacacauucaccuugcauuuggcagagaacaccagcuuugcuaugaaugcucacaauuuuuguaauacagggaaauauuuaacauacuaggaaaaaaagguuuaaauucauuaacauuacuauuguaauguucauauacuccucuuuucuuaggacacacuacaaaugauuuuauaguguuuccauuuaacacacauaguagcuuuucuucuggauuguaugugcagugccauugaacagaagcauaaaauugucaguggccuacauuuuuuagauuauuuaacuaugauuagaaauauuuugauccauuuuuucacuucagcucuuuuucauauuagugcacacuugacccuugaacaauacagguuugagcuggacggguccacuuauaugcagauuucuuucagugaaaguuacacugagugcuucugccucuccugccuccucuuccaccucuucucccucuucugccucuguuaccccugaaacagcaagaccaaccccuccucauccucagccuccucaacaugaagacaguaaagaugaaaaccuuuaugaugauccauuucuacuuaaugaguagugaacaaauuuucucucuugcuugucuuauuuuuuuguaguuuacauguaguuuguaaggaugcaguauauaauaauaucacauacaaaauauguguuaaucgacuguguuaucaguaaggcuugcagucaacaguaggcuauuagcaguuaaguuuuguggagucaaaaguuuugcguggauuuuuguuggauuucugacuucacagggagucagugccccaaccccugcauuguugaagggucaauuguauuuuugucugauuucaugagggugaacuuuuuauacuauacuuuuacagauagaaaugaaaguacuuaguaauaauugaacauauguacaguaaaaauauuauagcuguuguuuuaaaauaauuguauuaaauugaaacuuaaguuagucuucaggcuuuuuaagguuuucaaauuugaacuggaaugcaauucagaaugugcuagaauaacauuucuccauuucuccagugucaagaugggaaggcauacauucuaagcgucuguaucuccaucuauuuuucuuuuuuuuuuuuuuuuuuugagacagagucucgcucugucacccaggcuggagugcaguggcucaaucucggcucacugcaaacuccgucucccagguucacaccauucuccugccucagccucccgaguagcugggacuacaggcaccugccaccacgcccggcuaauuuuuuuuuuuuugguauuuuuaguagaaacgggguuucaucauguuagccaggauggugucgaucuccugaccucgugaucugcccaucuuggccucccaaugugcugggauuacaggcaugagccaccacgccuagccauccccaucuauuuuucacuaauauucaagcuagaguugcuggcuaaaaugauggagcaucagaauuugugaacucugggaaucauagcaaguguauaacuauaauuccuuugugucuaaggaggguggaccucuauauuagagagaagauuuacaaacguuggggaaaaaauggaaauugagacugacuccuaaggaaacaucuguucacucacucagcaaacauuuagcccacucugcuaaugcuaggcacugugcuagauauuuggagagacacuggagaaaacuuaaggucccuagucuuguggcucuuacauucuagagagggauuauaaaugacggcguaguuauuaaaaaaauacagaugaugauuucaagccuuauaagagcaaagaagaaaagugaaccaaguuaauguaauggagaguauuggaguaggcgaggcugcuuuagaucagagagucuggguggacuugauggaggaggucauggauagccuugcagcugguagaccugugggcaacauuaacagcagauaggacaagaggguuaggggcuaacugagcauucaccuuugucuucuuuuuccccucgguuaugagugugacaaggcggaacauccaagggauauguugcaggugucuuaagagucagguaaaaggcaagaugauucauuauaucuguucuuuuugugauacccauguaacuaccuauaagcuucaaagugaaauaaacauuaccucuuguaccuuagcccgcuucucauucuucauuacaaauuuaagaaggcaguuauuaaugugaauagucauucuucuuuucagcagugccaacuuuaaaaaaaaaaaucacuaacacuuaccugagaugcagcugacauguaccaagauugcuugccauugcccucucaacccaucugagucaaauuuuucuuucugcugcuguuuuccuucugcugccauuuuucuuucugcugcugucaagauaggaacaugugccuucccaucuugacacugguagagagagagauugagagauugaagggggagaaaucaguucugauuuucuaguuucuaaacacugcagaagaacaaaguagagaagaaagaggagagugugugaggaaagaaauggcaagagguacaugagauaacuuagcagggaguuaaauaacuagcucacauaaugacaaaaaaacauugacacuaaauugagggccugccauuuuuguuaacugguaucccugaauguggcuaauggcacaagcuacguagaaacaggcccuuguccuguuuuugcaaugagcagaaaucuagcccacugagacaucgaguucuuuucuaacuuuuugcucuguugagaacaucuuugcuuuuggauacaaaggcagcaugaaaaucuggaggccuucucaggaaggggaacuucuaggaacuuaaucuguuagugggaaagccaggaaccagcacacuuggagugucaucugagcaggaggaguuagaauuggcuggccaguuuucccuuaaugaguguuuauuauguuuaagcuacagaacuaauuacugugaaaagacauaaaggaaugagaagaccaaaaccguauccucaugauacugacaaaucaguuggacugagcacacaugaaucaacugaagaacacuucugccaaguucaaguuguguaaaaguggaggauaugagucuuguggggacacagaguugaggcaugagcuauuagucagagccguaaggcugccugcaggagaagaacuuuggauggaguuuugaaggaagugaggaaaagaucugaauuaacguauuaacacauaaagcuugucaucugaacaggacuauaagcaucucgaggguaagaacgugccuuuucuuucuuacacauucccagaagacccacauuccucauugggcucucuguaacaguauuuacuaagcacuugaauaacuggacaugggcaccauguugcuaaguugauuaaagguuggucuuccacucugccacuggccacagcacaaagugaaaacagaugucacaagcaccuuguagaucugucccuuuuuucuucugauguucacccuccuuuugagcucuuucuuucuccaacauugcuuacaaaauaaucuuuaugcaucugagagggagcaaauauucaguaacuuucugcagcuguccucacuaaagaggagaaucuguugaaugccacuggaaauguaaggaucucuugugacaguaacaucucaaggggaaacuagugguuaaauuguuaauucuuugagucugaaacuuuuuucauuugcagugcagauaagugccugaucuugcaguaucacguuucugacuucuuuguucuggcuucauuuuuuuuuucccaaaaugccauuuucauuuguucuuagaguucagaacaugucaaagagcuucuuuaagcaguaggugguuuuacagagcccacagagaaggaaaacuaaauaucaucccggaugcaguccacuacgaucguggaggagucagauuacucuccgggcuuugcugugucugcuugugaaacaggaaagggagaacugaggcaaugagucaccucacuugggcccaaagcaccaccuacguugaauauggagaaaaugugaagcaagaguuucuuuuuauacauaaucaccauuuguacauaaucaccauuuucuccaugguucuuauccaauucagugcaucuuaaaggaugguuuguggaaucaugacauagcagaaaaauccagguacuaucagucuugccuguuucuaccuaacucuuucauuuaaacucucacuagaaucuauaggaacuguuagcaucaauuuuaauaaguugucaacuaagugauuagugguauuuauugguuauuuuugacaaaauaauggaaucaucaaauuuugaaguugagaaguaaaguaaaaauuugugccaaaccccaaauguagacaaggucauauuauaaacauuaaugcugucccaaacugccaaugcauugcguagaacugagguuagcagguuaccauugauuuccucuacuuaugcuuuaagagguuggcauugguaagccgcuacacuuucuuggucaaugaggcagaaaccccuuugcaaaacucucaacugaugaaaagauuagcuagaaugacucuaggaacuguuuucuaaggaucugacucauugauuccuuuuuuugguaggguucucugggccaaguuaguucgaguauuuaucauuuaaauuaggaaauuaccaucaccaucaucauguacauucauaaaucaaagcaagauuagagaaggaauaugguggaucacagagcaacucagaaagacgacagcaacaacuaggaaaugaaacaccaugguuguauuucaggaacccuacccagcagauaggaauuaccauagcuccuaaaauuccaucugggugguugauggagccucaauuaaucugacaccauagcccaugcuccccucuugcuaccugcugaaguuagcagggaaaagucaaagagggugcugucaguggggucaauucuuagggaucauagugaaccacccuccauugcacugacucuuucccacaaaaugggcuagagauagcagcucuccuuauguauuuaagaaagaauggucaaaaaauacaauucacauuuuauucugguauauaccauuuugacaguguuucacaauguagguaauaugaaugggaguauuuaaacacaauccuguuuaauauucuuagccaguacuuauuaaaugccuaccaagccuggcauuguucuagagaccucaaaauacaccuuuaaaaacauauuuuauugacaguuguauaaaugaagaaaacaagucucagaaaauuaaagugacuugcacagauacacaagcuagaaaguaauaaaacugaauuuugaacccagguuugucagacucuaaaguccaugauuuucugcuccauguggccaacccaguuagaaagguuauaaaaaaucuuaacaguuuuucagcccuucucacacuuagcuuuaggauuaaaaguauuggucaugauuugcaaaaaaaaaaaaaguagugcacaauauuccagcuauauucaauaaacauuuguugaauacaacguauguauauacaggucauuguuacaggucuguguauaaguaaacacaauaugguccuuagcuuuaagaccuuucagucuagggguagauaugcaugugcauacaacuucuguuuauuuuugaauuucaacuaugugucagguguuaggcugagcacauuaugaacauugucuugauuuauuauuuaaccuuguacgagccuuguaagguagugguuuucgaaauauuuuugccaaaauguaaauaguaaaaaacaauaugugaagccuuuauuccaacuagguaaaauaaggaaggcuuuacaaaggagaugaaugacacuucagcugagcccuaaagaaugaauaggauucuaauagaacagcugggggcaggcgugguggcucacaccuguaaucccagcacuuugggaggccgaggcaggcagaucaccuuaggucaggaguucgagaccagccuggccaccaugcaaaagcccgucucuacuaaaaauacaaaaauuagccaggcgugguggcacaugccuguaaucccagcuacuuggaggcugaggcaggagaaucacuugaacccacgagguugagguuucagugagccgagaucgugccacugcacucuagccugggcagggggagacuccaucuaaaaacaaaacaaaacaaaacagcuggaagaugacaucccugggacagggacuuccaugucaugugaaaaguaggaguaaaucaauggaggcagggaaauguaggguguauuuagguaagagcagcuaguuuggauuggauaguguacauuagagacauaccaugggugaggggguggauguggacagugaaccuaaacgcuuugugguagcaggucacaggggccgugcauacaugcuuaaggagauuggauguuacaggaaaugggaagcuauuaaagauuucuaagcaagagaaugacaggucaaauccgacaugauuuagaaaaaacguaggcucagucagaagccauagucuaaugaccaaugcaucauaauuacuugcuacacuaauuuucuucuuuagaagucagcuuuuaagauauguguuuauaauacagauuuauacaguuuuacaugguugaaacaaagaauaauaauauuuauuauguaagauucaaauuucaguaucaacaaauaaaguauuccugggcccagccgcaccuauugguucacguauugucuauaccugcuuuccuacuacaguggcagagcugaguaccugccacagagaccgucugcccaacaaagccugaauuauuuacucuccaacccuuaagagaagaagguugcugacuccugcucuauugugucuuucuggcccucuuaauccauuuauauagguuucuuccuuuugugugugaauggaaaaugaauuuaaguucauuaguagaagcaagacaccuuuagcuuggccuccagguauuauuuguuuuccuucucaugagaauuuugaauguucuauaucuagauucucgaggcuaaagaauaaugaagcagaaaauguuuucuccauuacuauauccccuuccuauggggauucugaaggugcgguuuucccucuaggugagagaacuacauuccuuuccuaggcagauuccauuuuaguucacacucaggcugucagaugcacagaacaaugucacaugggcuucuuaagaccucuuaaaaaucacuuccaguuugacuucugcccauacuuuacucuguuaguuuuccucagaaaggcuuggcaauagcagaauaaucuuugauuaccaacaauauauuuaauuuuccuauuugauaggcugaugccgcagaaaauaaccaauugccuucugugcuuuguagcuuugugcuccacugcaucaucacuuucuuggguuuaggggucugugggcauagcaaaaggugugacagccuguccuuguuagacugaagccagucugaaguggcagggaggcaacaggaugccagccaaaugaaacauaugcuccagaucuuucauccaguccggagccuagugugacuuggcuucugcccccuucauccuuccuagggucccccuacacaaaauccucuaaauaagguugccaguaaccucuuaacugccaaauccaggggacacuucucaguccccguccugaugucucuucugaaauaucugacacaucagccgugccuccuuauuucacacuugccuuccuuggaugccugaagguaaaccuguccuguguuucuucucuugucaagaaguuccuugcacccgggaggcucuucuuucucuaccugcccucugcacgucgcucgucuccaggguuauaucugagguccucuauuuuucauuccauguguucauucugaguuagcucugugguaucuguguuucagucacugccugcauugacugacuguauucguagcuuaucugagugccaucauacacccggucauccuugacuugucagucuccauuuucaacauuugcaaaguucugccauuuauuacuccuaaaggugccuggagcuauauguuuugaguuuucuuuuccuacauucccacugccacauucuuuguacaagucuuuaucaucucucacuuaaacuauuugcaccagccuccuacuaguuuuccugccgccucuacuuuucuuuguccagcuuaccuccauuaucacugcaaguguuuucuucagaacagacacuuuaucacucuccugccaaacauuuucaaugacuaccauucacccaaggaagucugaacuucuuauguugauuauagcauugggccuaguuucuaaucuugccuccuacuacccaccaguugaaaucuucacuuccuuaggacagaaagacccguuuuucugaaacuuccauuaggucuuucacaucugugcucugguugguauagucuuuaccuuuacuuccauuuggaccaaucucaacacaucucccaagacccaguucaaauacggugcccccgccaaccucucuugaaauuauuuccuuccuguuugccucaugggaauuugcacacaccugagguaaaggacuuuuacccgucuacuauaauuauuuguuuacauguuuuucaugcaugaaacuaugucucaucuaucuuuguauuuucaauacagagcauagugugugucuuauaaaaaguauccaaagaaugaauguguccaagccaugugucugcaccuguaccaugagcucucuagguucuguugucugguguguuacaaauaaauaaugcuuucagcaccaaauacggcagccaucagcagaaauggcuuauuuccuuuucucaauauuuuuuucguacugaaucuaggcuaaguguagauggcuauagauagucauucaugaagucaaaugcaccagugggauuggaggauaguauuuauuuuagaaaaaaagaaagaaggaaaagaggagagauguccagugucacuauuagugaaccacauauauuauacuuuaauuucccuuauaaauaugaaaagagcuugguagaaaguaagauauauaaagcaugucuacauguguuuuaugauguguauacauauauguauguagauacauacauauauuuaaaugugaccauuaucacauuacucuguuauauuuuauuauauucauccucacaaaauucauuguuaaagacagggaacugaggauuuguuuucaagucuugcuugugguauuugcccgugcuugcacaagaguaacaauaauggcagaaucauuuauuagaugacugaaaagagcaggcacacauggagguuuaacauauggucgcuguccuuauggaauucaaaaaucagacaccaaaaaagguagguaacaauauagggcaguuugagguaugccaauuaauggcccacaguuagugagauuuuguuuuuuaucucucuauagccuacuauugcacuuugcacacacuggauaaacaucugcugaaugaguggacaauaaaacagaagcaaauuuguacuaauuuuucaauuauguuuucuuccuuguaugcauuauuguugacaccagcuuguugggaauaagaguaagaauuuauccuuuacaguuucauagaucucauuuaucaccuacaagaaaagaaaacuuauuuuuguuuuauaaacuuaaaauguaaauuaauaaauauauaauauaaauaauaaagcuauauaaauaauagauauauguaauacacagaauuuaaagcuauauaaagucuacuacuuaguugaagacuuugucagucuugcugagacacauugagugaaaauauauauaaaaaccuuuaaugaugugaggugaauacucaagaaauuuuaaucaucuucuuuucagugguaacgaauuacgcucauacaacaaagccuagguuuccagcaggagggaaaccauuugaagauguggugcccuuuagaaauuguuuagaaucuuuucagaaggagguguagugugacuccaggugccucucuaggguuguugaagugagugcaggugaccucuauguacuuguucuucaagcugcuuuauaauaagcagcuugcuacccugauuuacccgcagaaccaccuuaagacuuggcaagauaucuuuuuuaaaaaaauaaaguaauggauaaucauaguucaaacucauuuguuuuucuguauguauacauacagguaaacauuuucacaaguacgcuuaaaaauaguagaagaguuuaaagauuugccccaaugggcucaucucucccuuuuccaguuuggugcuccaucucagaaaaagagagucacauuuugagacagauguagcucuuucuacagauuuuuccagagcaagaaaauugggaucucacacaucugcaguacuuauuuuaucuucucaucucccuuuauucaaccagaaagguuccccgcccccccaguaauacccuuuuagaauuaucauguagcuugaugcuauggccauaauggguuuugucuuguuuuguuuaaucacagauguaaaaauaaaaagaaaugcuuauauuuauuagaguuaauacaaguaauugucccaaaguagucccaaauuaauuuuuacuccccuauucucauaugagaaaauauacugacaguggcucaguaccugcuugcuuugcuugucuuacuggcaauaauaccagauguauuuuauuuaauugaauagcuguguuccugagugaguaaaugauacuauucuaaggugaucuauuuacauacacuagagcuugcaguuuaugacaacuguuaguuuauuauuucaaagacuauacuguguugcaaagaaauauuuuauucagauuuucauauauucaguuuugucuguuuguuuguuuguuuugagacaaagucuuucucuguugcccaggcuggagugcaguggugugaucucagcucacugcaaccuccaccucacggguucaagccauucuccugccucagccucccaaguaguugggauugcgggcauaugccaccgugcccggcuauuuuuuuuuuuuuuuuuuuuuuuuuuuuuuuuuuuuuuuuuaguaaagacaagguuucaccaaguuggccaggcuggccuugaacuccuuacuucaggugauccgccugacucggccuuccaaggggcugggauuauaggcguaagccacugugcccggccuugucugguuuuuuaauaguaggccuacguaugccauuagucaacuuucugugaguuugaacuaccaacuugguggauguuuuucuuuuuuuauuugcuuuuuuucuuugaauuauuuuuacuaucauuagagaaugugcaagguuacuuaguagagaaugagcucaucucugcuucuucagcuauuuuuagaaucugauuuuuuuuaaaagugguuggaggaaagaaaugaaacugcauucaacuagacugaacuuggucaccauuaucauggggauuggugagguuuucucuuuguugaugucuucaguuuucaacaaaauugcuucuuuggaaguuuuugcuuuuucuccuaaacugguuauauaggaauguaguagguacaggucauuccauuauauaaaucuguguuuauaaaugauuuacuuagcuguuccagccuguuaguuaaauauguauuuaaggccuguuuuuucaaaaaaaaaauguauauauagaaaaaaaaauagaagcucacagaauggauacugaguugcugaaaauuagucauuugaauuuaaaucuuuucaggaguuuuugcauuaggaauuuacaccauauacucacucugaaaccauggcauaaaaaguauaauuagucacaucuauuaaaacagugaaagaaaauauuugguaauuuucuauuagccaauaaguuacuuugcauaaggcaauugugaauacucuuucucuuccuaaucuuaauauguacacaacuauacauucaauauuucuuucaagaaaaccaaauccuacaaccccagaaagagauucuaauuugguuguucuccauuucucuuuauaucauuuauaaagcacgcaaaacaauuucuggccucugauuuuugaaaaccauaaaaucauuucaccacuuaagcccaaacuuucuaaaucaaauuuuuacucuaagaacaaauacuuucaccauuuauaaaccuuucaaauuaagguuuugaguagagcuuuccagacagccuccggaaaccauaccccauagcaacacaugucccuaaagcacauuauauuauguggugcucuaccauagaugcccaguauuugccacagaaggaacagaacuugucuuaccccaugaguaggccaauuggucaguggaggagugacaggugagcagucagugaggugcuggaggaggguggauguggggggugugaagguuuaggaguagaaaaaacucacacucggggcucuggguugcugggugcuuucuuugcagcccugguuugugaagugauuuaugggccauacaucaccuuccugguuggcuuuguugacaccuugucacauucuugcuugggcuugaggaauucauuguucuuguuugaacugauaagaacaaaaacaaaaaugaagaaagaaaaaagaaagguuuucucacugagaccuugggaaaagcuaaggggguggaauguugacguggagcggcaggcugcacuuucccaagcaaugcagcccugcgucugcuggcugcugcagcagcagggaagcuuugccuuuaggaguucuggcagaagcuuuauuugcccuguggaaguaguuuccuggcuuggagcuguuccuuuuugcuagaaugguacugugcagagaggccuuaggaggggucaaggagagagguuuuccuuugagaacugggagacauaauggcugagaggagauuccaaugggagguaaaaugaccccggucacugggagaauguaaaacacacggugacuugaugugagcuggucucuccaaaguucaucccgcuguacagcaugcauuuugggcauggugccaugcugaccuuuccccuuuaauguguagugccccaugcuucacuuaguauuuuggcagccugcacacagaggcuagcauuugagcccagugcuuugaagagagcaaaaaaguuucagaaugagaacucuucaagucacugguuauacauaggguauuaucucccacgucaauggagcaauggaugaccugccugguuuuuuuuuuaggccucuucccuuuugucuuugcuucaaaaaaaaaauuaauagauuaaauuauuugucauccaagagaaguaaacaggucagauccuauguuccauaucaugggauuguaaacgcucauauuuccuuuugugaaaauuuuuucuuuaagagcagccaagcaugaacauacugcauucacuaauauucucugucaucaugcuacuguugauugaaaggagaagaaccuacuugcaccccagccaagggugagguguccuggggaguguucacacuuuuguguuauacuguuaacaaguucauguguaauguaauaauaaaucauuuuaccuggaagcgccauucacacauccccacuaugaaccccauuuugaacuggagccauagaaaacuguuuuuaagcuucuuaaaaugguucucugcaacaacguuucuuguagaaugaggaugcauaaacuuguuauaacauacuugacuuuccaaguggucccuguaaacaagggaugcuugaagaacugccaagcuagguagccagagauugggauugaagagcugacauuguucuaacacugaaugcaaauggaaaugaccuaauacauguguaauaguaaagcuaauaaacguguaacuguauagcaauugcaggauuaaaauaagaagcaaauuuuggaaagcgcacacuuuuucuuuugggucaucuaccuugcuaugaagugauauuuugaauaacauuuaaauaucuaaauauguguauugccauuaauauugacaucaaaguuucaacacauaucuguuuuaaaaaaucuacaagcccaguuuccccaguuucuuuauaacucugaugagccugcuaguucugccuuugcuuuuuucccaacuuggaaucuacucugguuuccagaauuagguuuauugacaguguuucacugcucucugcuggagaagcccaaagccaagccaggcaucuaaggcucuaaugacuugcaaggaaugcaggugagauggcucagcugauaaacucccggccucugaaauuaaacucaacacaagacuuauucauacuagucgaagaucacaguuuacaagcuaugcuguacaggcuagaaauggguuucucagagaguaguauagguaagauagaaaguguaauacugccuaagcuccaauuucuugcuucgaauguuguccuuuguaaagauauccuauauaauguugcacagaaacugugcaguuucucaagucaauuuucauccuuccauuuuugacacauagguauaaacuuaauucugguauguacaucugagacaguaaucaaccauuccccugaaagaaaaaaaauaaagacuuuuuuuuauuuuugagacagugucuagcucugucgcccaggcgggagugcaguggcaugaucacggcucacugcugccuugauuucccaggcucuggugguccucccuucucagccucccaaguagcugggacuacaggcaugugccaccauaccagcuauuuuuuuuuuuuuuuugguagugauggggcuucgccauguugcccaggcuggucucgaauuccugggcucaagcaauccacccaccuuggcccccgcaaagugcugggauuacaggugugagccaccaugccuggcaauaaagcacuuuuaacuaaaauauaucaaauuugaaacaaacuauauauaaaguuuuuuucuucuaaacuucauauuuaguaagugcauggccagaaaaaagagaacaagaguauguaccaaguaagcaaaaguguguuaugacauuuuuuuccugaaacuuuucuagguaggaauaaacauuaauuuacaucuucauuugcaugaacacaaaacucuacuauaaucuagaugcuauacuucucaaauuuaaaacaaaaguacaaaaacaaaaacaguaaacacuuuaggugaauguuguguuaaaugucuauauugagcguauauguacacauauauuuaugcauauguggauguguguuuauacauauauucuauguauauauccuugggugggaacagggugcaaagaucuaagcauaacauaucuccacagggauuuauguucuuuucagucugguaucuuuuaacuuaaaaacaacucgaugaauagaaaucauaaaagccauccuuacaacagcauuaaagugcuauucuauucugcagcauuccaagugaauuauugcugugcugucaaagaaaacaaaaacauuugagaaggacuguuuauuuuacagugguugaccaaaaguaugcaagugguuauaaaaaaauguagacagcuaacgaugggaggugccacuugcacauucugaaauccauucacaaaccuuugacacuaacucuugaucacuggagauaauauuagaagcaaagcauuuuucacggggaaaauccuagcacuuugaaagcauuucaggucaaagcaaauaaauaaaaccucuaucccucauccuguaucacuggcaucuccucacucacagaaccuaauggcaugauuguuuuuucccaagaagagcaagaaaacuuugcaaaaauauuucucucagagguuauggcaaugaaggauuuuugugccaugaaacacguguugcccuuuguauuuaaagauuaaaauaaaaacugcuguugacaauguuaauagauucuuucauuaaacaaauauuucauuuuagagcuauaugggaaauuagagaccucaaacacagucccuguauauuaaagauaacaaaauguauacuuagggaagauaaaugacuugcuuaaggucacacagcagguagcauggaaggaugaguuagaaguacuaguucaguguuuguauuuguauguuuugccucagaaucagacaauguacaguuaagaccucaucgauaucucccgguaaaugcuuauuuaauguuuaagaauuuucacugguaaagagauucuuauuccaggagucuaggucuugggguuuagguuucuuuuacuuaaaaaaaaaauuccucugauaagugaggauucauuuaacuuucugguggaucauuagguaccuuucaagaaaugagaauaaucauaacuggcucuauuuaucuuagcauggguugaaagauaugaaaaguuccuugauaugacuggcacgauucuaucccauaaaaccacucguaaauaucaguugaaauaaugccuguagggaaaauuuucaaauguccuuucugucaaugcagaaaugccagugcagcuuguuuucuggguggcauguaaguuguagacaggcaccacauuuuagacauauuaugguggugcggugaauugacaggcaguuuaccaccauuuccauguauuagauuauguguaccucuggcuauccugacacuuugcccccaaaguggagauagugaaagagaaggagagagggagaagaacuccucgcaucugugccccuaccucagcagcuccuccuccuugucucugagggucuccagaguuugagaguuuggugucauguuggcccaagagacuguuguccuuuugacagcucggcuguuuguaucuccagaaugaaacauaaucagauuuuuuucagauguagcaucugccuucccuccaacauccuuggguuaaucacgugcuugcuggccaggauauguaaauaagacuuggcuaaaaaaaacccuuaaaggauuaugaagcaaucuugcuuaauaguagcagaacaaaacaaaacaaaaaaccacuccaacaaauccuccugugugcuaccaaguaauggaaagauccaguuaugacuggaacuguccuggccugaguauuguccuggacccagagggagcgaaggagggagggagggagggagggagaaagagagagagagaggggagaaauaugagaggaggagagaaauugcugaaggagagcuucacucacugacuccgcacacauucccucccagugguugcuaaugaagagcccgugcuggugaaggaagccugcugaucccggaacuggccuugcgcgcaaguggugggaugacagacacauucccuuccuugaacugcacucuuuucccuugcacucagagguggcccgagagagccccgguaggucccggaguauguuuccaugcugcagaaggcauggagagauuccaauugcggggguuccuccguagccuuugcagcugaacgucuccaucuccugucccugggcggucagucgcuggcauggcucuguggaguuuuaccucccaguugucuaucaccaaagcuguccaccuuguccggaggggaaugagcguggaaaccccuggcggcuguacugacaaaagcaaccuuagucaaugacagagcugggcaggcggcgaggucuugcgggcuggccuuucugcugcugguaggaggaucaugugcugcuauuucggaggcuccugccaguuggccccugcccaccuuuucuguucauacugaagcagccaggaacugagagaaagaggaagccucggcugugcuccgggcugcgcugccaggguugcgucuguagcagguccagcagcaaaaacaaaacagggcagagcccagggaggccccagccacagcagcugaguguggaaacaaagcagcccgcccgcccugggaagcugccgcaggcuguggaagggaacuucuagagaggcugcauccucuccaagccgggaaacugaggccuagaagacaugugacguaucugagcagugaccaagccaggaguagaaaugucuccugagggccuguccccacugcuguuugguuuuaaucgcucagcucuuaauaguguaacccuggacaagugacuuacucuccccagccuccaucucaucuguaaaauggggaugagaaaauaccucuaaggguuguugugacaauuaaaugagaaagcauaaacaaagcacuuggcacaaugccuggccacuuaaugggcccucaguaaauguuggcuaguuaugugaaccagaacuugagauggaagugaagcagaaacgauagggaguuguucaaaaauaccugaucugcuagggaaauauuuuuuaaaacaaggcugcuuuucacaaggagggguaggcacacuugaauuaagaucagauugauuauauguuuuuguucagcuuugauguugaauuguuuaaucaaauggcagacucugccccgcuuccaggaagagcucaacuccaacuaggaggaagcagguaaugugagccauggcaucuuccccguuuagauuuccugacucuuuguuuaucuucuuugucaaugugcgucugaaccuucccaacagaguuuaaaauguucaacuucaaagcuaaauucugauggaaaacacuuccuaagaggcugaaggcuuacucuaggggugaaagaagaggaaaggcgauggaucacaccacauuuguggaaaauguuaaugcuaugugaucuugccuccuuagacccagauagaugcaaaggauaaggaacucgguuuauagcaacagauacuccaaaagugcuuugcauccuguucugacacuaacugguugugaaucacuuguuaaagauaaggauaacaacaauaccauuucuugagcccuuacugggugucugguauugugcaaaguacugucuauauauuaccucaguuuccacaacaaccuuaugaaauauuucuuccuuuugugaugaggaaagugagacuuagagagaaguuaaauaacuuguucaagaucacucagcuaauaaaugcuccuaugcacuuagucacugugcuauguccugcuuaccccuuaauguugaccuuaauccuaacuugaauuuagguuaaugucuaugcacugcuuuuuuuucaccugcaaaucaagggcuguacuaacaguuuugcuaaggccacuucuuugaaaauuguaaauauuuccagaaagaggcacaguuuacaauaaacauucuugcuuuccaaauaaauucuccccuauuaaaaucaauguaccaguuguuauuuucauaccuaugcauuguuuaagauagagaguucaggacacaauugaaaacugggaaaaauaaucucgugguucgguuuguuaguuugagacgcagucucacucugucgcccaggcuagaguacgguggcccaaucucagcucacugcaaccuccaaccucccagguucaagcaauucucuugccucagccucccggguaacugggauuacaggcgcgcaccaccacgcccagcuaauuuuuguguuuuuaguagagaugagauuuugccauguuggccagguuggucuugaacuccugaccucaagugauccacccaccucggccucccaaagugcugggauuacaggugugagccaccguaucuggcucucauauuuuuuauauacagauugaauaucccuaauuugaaaaccugaaaucugaaaucuuccaaaauccaaaacuuuuugagcaguuacaugauauuugaaugaacugcucauaagaacauuuuggauuucagauuuccagauuagagaugcugaagagguaaguauaagacaaauauuccaaaaucugaagaaaaucagaaaugcaaaacaguucuggucucaagcauuucagacacucagccuguauuugcaugcucauggcuguugggaaaaauuaacauauucaccaaauugugccuggucaauugauaaugacugaucaauauuaaugcacaaguauaucuacuuuugcugucaagggcaaaauuuaaacuuuacuugcacuagucuuuaucucuaaggaaacuuguacauuuaugcauguaauuugguauccucaagguaaaaaguccaaauagcauuauuuacuaagugaaauuucucuauuaagauuuuucauauccuaauggaauuaugcuucuaaauucucaauauuuauuaguauuguugaaauuuugugaauuagauucaucuggauuaauauguacuagaaucauuaccuguaugaacuuggacgcguuucuuaaucuaucugggccuuaguugccucagcugcaaauugggaaugaaaaugguaucaucauauuauaaugguuguugagaauauuaaaugagcuaauuauguaaagugcuucaaauugcgccuggcacauagugcuauauguguuaauuaauuguauuaaucacuugugacuuccaauugauucuauuuuaauugauauucuauaauauaauuugcuuccuucaucucucauguauacaaauuaaauuuguauagaaagucuucucuucuaagaaauuuucauucuuguacuucacccucucuuuagcucuguaguaaguaguuucuguuuauuuauuccuuagaacuuuaucuagagaagcuuuugauauuaagcugugacauauaacagaugaaauuacagucauugaauuuauuuucucugaauuacagauuauuuuagguagaauuuaucuuccuuuuuuuucuggugcccaagucuuagagaaacauguuuucagcccugaucaugauaaauaguggguuuuuuaaaugacaucacgagauacauauuucucagauacaaaggauuguuguuauguucuuuuggccagaagacacucgucuuccugggaaauguagccacaaaaugcuggguuuuaguuuuauuaauauccuuguagauuaaaaacaaaauguuuucccucuaaguuuuuguucuuuuccauuuggcaaacccggugauuugccacaugagccaaugugugucucauuugcuuauuuucuugugcacuagcagcccuggugauagcaucuggaaugugugcagucccugggaacaaauaacauguuggaaaaugguuuacuugguggcagcaggaucgcucaugcaccugacagcacaugccacguaucucaagccauuugccuuugguaaaaguaguuuuaagauaggcugccucuccccaaauuuuuguccaaauaauaacaacaaugauaagaaaagauuuuuauaaccaaugacuuugagagucagauuuucaaaauuauuuuaauauuugagcugaugauaucaacuaugccaugaaauuuuguuuuguuuugagggaaauuacucaguuaaauggggaggaacccuuaguuccgggaacugcccaccccuuuccuggaaaacacaugaauaagccacccccuuguuuagcauauaaucaagaaauaacuuuagguauccuuaguccagcagcccaagcugcugcucugccuauggaguagccauucuuguauuccuuuacuuuccuaauaaacuuacuuucacuuacaaaaaaauuacuagguuaaacugaaucaagaaaaagaucagacuuugaaaacuugguuuacauauauauuauauauguugguuuauuuucaccauucuuaaaaacuguucauugacuaaaugauacacagauuuaagagguuaagagacugaguggaauuuagaccagacuguucuuaagcugcuuucaagcucacauuucacuuaaggguagggacucccugucacccuuagucccuguuuccuccucgcggggagcuucuuucuuuuucucucuuuuuuuuuuuuuugagaccgagucucccucuaucgcccaggcuggagugcaguggcgcaaucucugcucacugcaaccucuaccucccagguucaagcgauucuccugccucagccuccugaguagcugggacuacaggcguccuccccaugcccggcuaauauuuguaguuuugguagagauggaguuucaccauauuggccaggcuggucucgaacuccugaccaugugaucugcccgucucggccucccaaagugcugggauuacaggcaugagacacaacgcccggcggggagcuucuuuugauucaucauucuugcagggaauuacugagaaggacgugagcuaaaagacaacacagagguguucgaggaaggaggugugaauccaaccaggccagaccauugacuuccagagaaauuuccagacaaagcuucucaacccaccagccaagacccaacccacagcggucacuuucacucuaucuuaucuugaacauacucuugcuuuuucaaggcacagucuauagaauuccacauuuucuguuuuauucauugccuuccucaguuucccuuaauaaguaagcaagacuugaacuacagguuaugaaauucuugggauuaaugacugagcuaauuuagaaagaaaugcauguuccccauggcucaaaaauauagaaagccaauuaccuaacuccuaucuauuugacaauuuaaaugaugcguuuucuauaaagaguucauuacacaaacgcugacucccccccucauaaaauggaugauauuuuagugaggcguuucaaagacaaaagaguuugaugacuugguuuaaggccaguucaaugaaggcaaugaaaaccuuaucuuggcuauucuuuuucaagcuggcauuccaaugagucaccauauggaagaggauuaaggaaaauauuuuauacuuaggcuaggcacagugcuucaucccuguaaucccagcacuuugggaggcugagaugggucgaucaccugaggucaggaguucaaaaccagccuggcaacauggcaaaaccccgucucuacuaaaaauaugaaaauuagccuggugugguggcguguaccauaaucccaguacuuugggaggcugaggccgguggaucacuugaggucaggaguucgagaccagccuggccaacacagugaaacuccaucucuacuaaaaauauacaaaaauuggcugggcaugguggugcgagccuguagucccagcaacucaggaggcugaggcaggagaaucacuugaacccaggaggcagagauugcagugagccgagaucacgccuuugcacuccaucucaaaaagaaaaaaaauuuacaguuaggauuuguaaaauuuuaaaaaucuuaaagaacaauaguuaaaucuuaccuucuauaauuaaaauaauuaaauauuaaggauucuuuggaguugcgucauuaggagcuuuacaguaagauaucuuacuagccaauauuagccugccacaggcaaauuaaaaaaaaaaaaaagcaaugacaacaacauuugaguuuguuaaucuaauugccccuuccuugccaucacuccaaggcauuaaugugucuuuuagaugauugcauuaaguuuucuauuagaauuuccucuccaucucucucauacacacacacucacacacacagacacacacaaacccccuagccauugguguuccugagguuaugaauccccuuuccauagcgguuugggaacauaggauauaguuuaugaguuagggaggcacaaauauguucuuaaaaggaaaccuucaaaccgacugagugcaguggcacacaccuguaaucccagcacuuuaggaggccgaggcggguggaucacuugaggucaggaguuugagaccagccuggccaacacggugaaacccugucucuacuaaaaauauaaaaguuagccgggcgcaguggugugcgccuaugaucccagcuacucggaggcugaggcacgagaauugcuugaacccgguagguggagguugcagcuagccaagauggcgccacugcacuccagccugggcggcagagugagacucagucccccccaaaaaaagaaagaaaagaaaagaaaccuuagaauaaaacuaccuuugacucauagacucauucauccaauaggaauagagugcccguggugugcucuuuuuuuuuuuuuuuuuuuuuuuuuuugagacagagucucacucugucgcccaggcuggagugcaguggcgcgaucucugcucacugcaagcuccgccucccggguucaugccauucuccugccucagccuccugaguagcugggacuacaggcgcccgccaccacgcccggcuaacuuuuuguauuuuuaguagagacgggguuucaccguguuagccaggauggucucgaccuccugaccucgugauccgcccgccucggccuuccaaagugcugggauuacaggugugagccacggcgcccggccccguggugugcuaacucuuaugacaaugaugacauagggacccagggaccacccucccguuagagaugcaccaugcucagcccgucuaacuucgagccugcucuuuccaccaauaaucagcugccuucuguguccacacuaggaggaaggauauaugcuugauaucuuguuuuauuauacuguugaauuucaucaucacccuacucuuacccacaaaaaauacccaaagucuuaaauguuucuuaaaagaaauauuaguugugcccauuuuaaucuccugaacuuuaugacccuuguccaauguucaacuagacauuuaagauuucuuucauuuggcuuuugguaagacucauuuuuggaauuaauacaggaucacuguuuguucuccucaagucccagaaaagaaaaagggacuuuuuccuacaaaucaaacuucagcauaccacgagcugccaguguuauuugcuauuuguuccuugucuuuuccaacaaagugaccuuagcacugaaucaggaaugcuuagauguagaugugcacagaggacccuuuguaguaaauauauuguaaauacauaucuaauagguaaauauacguguauauguauauauacccacagauuuuuaaaaagugaauauucuagagaguuuccauuccaagaaugcucauugaaaacacaguacacaaaaggccaacaaggaauaggauagaauauuccagcuuugcagaauggugagugaauugggcuuugacuuuaaagagguauguaggugaggaguugcugacaaaccuguuugaaagugguuuaugucaugggaaaguacguaucagggcuguugcgaggauuaucuucuuucuuucucacagcaacucagugcgguagacucuguuaucauccucauuucacugaugaacaaaccaaggcacaaugagguaaaggcaucugcuguaggacucaauagcugaugaaugaaagagccaggcagggcagacuggcuucagaauuguacuguuuugcuuccuauuucucccuacauccuagccccacucacauggaaaucacucugaaaaauucuucugucuuauucccuaaagacaguccagccaucuuccuccuaauucuuacccacuuguauuucuucuauaauugcuacaaaaugguccuauacaacaacaacaucgucaacucacagaguagaaaaaaagcaaagaaccuuacaaauuccucugggcuaauuuuaucagcaaaacacucagcaaaaugagaguugcccaaguccugaaaaucauuaugccacaaaguuagugguuaccaaguucagcccacuauuuaaguauagucauuuaaauaggccacuauuuaaaacauuguguuauccucauauacucaacucaauaguacagagaccauguuuuaugucucuuugcacguccagcccuuagcacagcaccugaggcauauuccucaacaauuuaugcuuguuggaugaaugauggacugaauaaauuaauagguguuagcuuuuaguuuuuucaaaaucaugcuuacuuauucauuaauauauucuugugauuugaucaaugcaaagaagagcaagaucaucaucuagcauuauccugaauacuauuuaauauauuucuauaacguugccuaagguauauaucuuuuguuuuguuguuuuggaagcuauacuacacaauugacucaagcaagcuacauauaccaugaaaaucagcauuguucucccucacaacccccaugcacacguacucagcuuucagauagaccugaacuccaugaaagggaaguccuucuuggauuaagcugagauugagaggacuauuuuaccgcuucuucaguauauucuuuuuuuuuuuuuuugagauggagucucacucugucacccaggcugaagugcaggggcgcgaucuuggcucacugcaaccucugccucccaguacaagcgauucuccugccucagccuccugaguagcugggaucccuggugugcaucaccgugcccggcuuuuuuugcauuuuuuguagagacgggguuucacugugucaccauguuggccaggcugaucucgaacuccugaccucaagugaucugccugccucggccucccaaagugcugggauuauaggcaugagccauagcgcccagccgacuucuucaauauauucguauaugugaauugagccuuccauuucuuccuuuaccuccucuuucauccauuggaaccaguugacuuuuuaauguaaaguauagaaacucagccgcucugacccuguuuugauuccaaacccuuguaccuaccagaccauuuaggaagacugggauaaauaagcauuauaacuccagggagcuuucugauuucaugauccauuucuguuucuuaggggccagacagugcuaggcuuacaggagacucaaaaucuguaguuaaccacagcaauaaaugaacacaaaggaaaugcagauguaaguaggggauaaacuuugagugguuccaucaguagugauucaugauguugaacuacaauaauauuuuccuccacacacucucccaguucccauugugacacuggagcagcauuuagggaagacaguuaggcuugggggugcguucuguggucauggcuguggaagauugguccuacggcuguuaaucuggcugacaaauguuucaucaacaugcauuguugaaagugacaugaugcacagugcugguuaagagucgcguaaauaauaaaaugcccaagaugggagaagagcaguuuuccuggcuucuccaaguuugagcugcagaaucagaagcaguagaauagagagagaagagacaggacacuagcuuggguuccagccccaacucugcugcccugugcugcguggcugcagcaagugacuuaucuaauaacugugggucucaguuuccucacucauaguauuaaugaucauuucucaggaguauuaaauaagagcaugaguuuaaagagcccagucccgugcccagcacaacggaggcuacccuccaaaggucagucccuuuuucuguguguuucauccucucuuggcagccuguuugcugcaucucucagcugacuuuugucccuuccugcucacuuagucaauucagagauuacaguuuguacaauaaugcgcugccuugucuucucgcuggugaaucuggaccggagugcucugccucugcgccgacacucacucugauggucuuggcuggaggacagaggcugcuggcaaaaaccuaagagggaacauaccgugguagcagcaugaaagaauuuggcaaggaggugcucgucacaugauugugauucauacuguacucucaaaauguggcaggagggcuaggagagacuuuuaaugccagcacacagagcagagacacucauuuucaaacaucacauucuuuuuauaguacaggcaugccucacagggaaaauauugaacuuggccugccagcaccacgagagucgucccaacugugauuuuauugcuugagucacucccugaaucagauacuggcugcacggaggaagucuucuauuagggaugcuuugaaauuguguuuuuaauuaauuaacaccaacucuggacagguuuuucauuuacuccuagcugacucuuuuuugucuuuucuuuuuuugccugaaacuuguuagacauuuuuguaaggucucaguuggaucgcuuuuaaguauccuggugaaagagucaucuguguugggugaccaaagcgaggggacccuucaaaguagaguuugucaucuccgagagaaucugauccaugggaauggggucgucaggaaaacggucccuaaaagucuggcauagcacuuuuugaugccuucagccguccucaauccauucauccuguuguuaaaacuuaaaacuagagcuggccagcuguugagaaaaguccucaguuuuauuucaaccaaaugaugcugccuccuggggcuggaagggggcugacuucaagcacaauuauaaauguguagcucuuucaagcggcggaaaccuacaaaauggccuugauucacagggccccucuggcucaaagacucucugcuucccgugugucauaaaucuguaucugcaucaaaaaguguaaagacggcaguguauggaagucccucuuccucugcgagugugucuaugacagauuuauacugauggcuacacugcaccccggucacaggcuccuauuauagucaugccccacugacucagcccccauuuccuguggaaggggagacaagguccugcaugaaggagggugaaauuacagcucaacucucgaauugcuguuaguacaggaggaccuuuaagggcugcagcaagacccauuuuguucauagcaacaucuacugucuccucaccccaguguggucacagcuaaaaccuaaggcauuuaguuucaugacaagauaugccaugacaggguacuccagaauucaacaaggccaaauggauacaugcgaaaagaacaaaccaccucauuuguuauaauuuuuguuucuucaaagugguuuucuuuuucuuccugaggguacaaguuucaaauguggaaauuuuuuaagguagcauuugaauccaccucucuauuaguauuugcaaauggaugcagaacaggacugguuuuugaaaccaccuccuuguuagagauuuuucauccuuugcaaacauuguaggguuucagagguagcggcuggugagaacccucuuguguuugacugcagccuucgagguuuagagcuguccugcauuucagggggugaauggcuacugguaaagaggucaaaaugagcuuuauuccaagaguuaagcaaugaaguugcaaaguuuaauugguguaauuuugggagauaaggauggaaagggaaggauguuaggauaguuugaauccucuaagaggagaaaaggcaaaacugauauuugacuuucccacuguauuuagaguauagccuucaugggguagcuguuucuucuuguguuugguauggcucagagcacuugaaaaugucacuggcugaagaagagugcuugugaugauauuuuuuaauucacuuuuuuuguagacuuuaguacuauaaagaaaugauacauagaggggaguaaaaacuugucuagcuaacaauugguauuauaaugguuuugaaugcacaguucugauuaaauuuuauacauuucuuccguuggccaacuuaucgugagccugguuguaugccucugguguuuguaugauauucacugcauuuuuuucuaacguguuaaggauucuauuuuaaauagaaaaucagauugcaguuugaaaaacuuaguuuuaaaacucuaccaucugcuagauuuguggaagaggaucugguaaaugaaaauuguguguguaugugugugguuuauuuuauaggcacugcauauuucuuugaugaucuauuuuccaagcucauucuuaucuuuuagaagauguuucaaggauuuaugcaucuggcaagauuucagagaacucuauagugguggagauguacacuccauuuauagggaauccugaaucagggucauugagagcauuuauuuuguuuugcgcuuaaauuuauuucugcucuggacauuucuuucaaauggaucauuuuuacauggucaaaucuaagcauuuuauucauaagaacucuaauaauaaagcuuuuucaguccagacauagguggaaauuugcaaaaugcaucaggaaaguauggcaauugcuuuucaagccaucuuguauuugagaaaguauugcauucauuaguguuugcaaaacuaccuuuaauggugcaaaaguaaagcugaccucucccuuuuggugcacagauguauaaacuuuauggaaguacaccccaagguagagacuuauuggaguaacucuuagaaagggcaaaguuggccauaaacagugaugcaauaaccccacaauuauguaugcucaauuauuuggaagggaagucugggagaaguguuuuauaugauuacaugggcaaauaagaagugaguguggagaagcacgguccaaagguuugcauuuguuguguauaucccaaauagcacccuaauacagcuuuauaauguaaauccaccgguaccaguaaaacagcauuuaaaacaaauuguaaaaugaacaacauuugcaaagcaauaaagaaaccaccuuugcaaucacuuuacuacaguuuugaaaaauguuagugaauagcucuccaaagaugcaaguaaauaauauuuuauuagauuucagccuaggagaaaggggaggaaaaccuucaacuagaauuacaugauuauugcuuugcuccucccucaacccagcaaacauuaaaauggaacauaaagcaagucuauaacaagauuuaugaggaaagguauuacacuuaggggcacauugugcagaaaagucauuaaaauuguuugggccuuaagaaggggaaaaaaaaaaccuuuugagaaaaaugagaaacucagauguaucaaaaugccuuccuuaugauuaccugaggcuuuagguuuuuaaaagccuuuguaccuaaagguucugauucauucucuauuguggcaacuuuuuccuaccagacaaaacugaaagauuuuguuucucuaggaaacauacuuaaagaaguauaguagaccuggcauuccuuuugcaugcucugguagaccccggcucuuguauaauaaaaacaauauaggcauguuauauuugccauauguuaguuaggggguuucagcaaacaaauaccuccuugugcacagaaguagaugaaagcaaagcuuacugaugucuacuaugccuuaacuuaccuucuuuguccuacauagucugccuagcagacuucuuucugguugguuguaugcauauuuggauaauggugauagcucagcauauucuuuaugcuuuguuccgcucugaggacagcuaguacacucgauucaguauuauaugcuuuccuauuuccuugccugaugcuucuguguuaugcuaaaucucaguuuauucugucaguaaaguugaggagagugagugaggagugcguuugcauguguguguuuucuuaucuguaaaguuuuaacuuuggcuuacuguuuaaccaggaaacucagcaggacaaaggagaucuaaauaaaacuauauuccuguugagaaucuccaagguuaugcaauacuauaaaauggugguuugaguagaaguucuguaguucauccuuaucagacuaaugguuuugggguuuuugaaaaggaauguuucaaggaggucuuugaaaaccauuuucuucaaauguucauugcaucugagaucccauuuuugucccuuuauuugcuccagaauaccgcccaacugccaacaaagaagggcuugugcucccaggaauuuucugcauuccucucuggaguaggcauuuuucucagcuacaaaggcccuuuggcgaauucccucuaaucauuggauuugcccugggcucugauaggugccauucauggacuuggucugcuguuugauggggcugaggcauuaaugggaucuuuucaugauaaacaaaacuggguaacauuaccagagggaucacaaagcugcuguuguagggggaguguggugcuuucucucucuuucucuuucucucucucugcuuuuuccuucuuccuccucuucucccuguucuuuuuaugaacgcacauuugugugcgugugcagcauggccauuucuagaagcagaucuucugaccuuugcugcuacucguaagucaauggccaauggcaaggccuuuguugaacauaagaugauucuauauacugaucugaucuacaguagcuucacagccugcggggaggucuguguuuucuuaauugauuaaacguuggaagaauacugcaugaagaaucugauuuugagaucuuucuuacaugcuggcauuuaauuacugaaaguaucugguaguugagaugaaugagucugggggaauaaauacuuaacacaagaauucaacuucauguggcugcuguggugguauaucccuggcuguguuaucaaugccagacugaaugggguaacucgucacuguuguuguauccuauuugcuucucaaaagaaugcaaaaaugguuaguugaaaccugauuccugcaauagugaagaagugaaauuagaauuauuuuaggugaugaacacuauuuuuuuaaaguuuuuauuuuuguggguauguaggugugcauauuugugguguaugugagagauuuugaugcgggcauacaaugcuuaauaaucacaucaggguaaaugagguauucaucaccucaagcauuuauccuuuguguugcaaacaauucaguuacacucuuaguuauuuuuuaauguacacuuaaauuauuauugaccauagucacccuguggcauaacacuguuuuuuugaugaaaagaaacugacaguacaaacuagagaacuugugaucauauuaacggcauuauuuuuaaguuucugagaaaauuaaggaaaaaguuucuuauuuuaaauggaaaucucugauguaauuuggaaauaaauaguacauuaggcauccugauagagguaauucuacuuacuugccaugcauuuucuuauguuccaucugaauacuggggcuuaggcaaaaggacaaaaaggaguggucagggagagcacagagugagcaagcaugcagagcagcgauuuaaaagucaaaaggaauguuagguuaagggaggaugggugaaaagcaaugcuuauuauuuguccuaaagcaagaagaaaggccgggcgugguggcucacgccuguaaucccagcacugugggaggccaaggcaggcagaucaccugaggucagguguuugagaccacccuggccaacgugguaaaacccugucucuacuaaaauuacaaaaauugacugggcaugguggcacgccccuguuguaaucccagcuacuugagaggcugaggcaggagaaaucacuugaacccgggauguggagguugcggugagcugagaucgcgccauugcacuccagccuggaugacaagagcaaaacuccaucucaaaaaaaaaaaaaaaaguuaaaugauucauccaucggaagggauagcacagugcccucguguuuccaccagccacugaugcuaauucuucauuuuaauuuugccuugacuuccuggcuaaguguauguauuuuaauaugaguuucagccuccaacuaaauaacaaacaggacaccaggcuucugucuagccaaggugucgugaugcuguuuaacagcccccaaaucccuaccucaauacauuuuaaaauauccaggugcuguaagucggaugggaaaaaguuugaggagagaaagucauuaccuucgguagagcagcacuuuauucauuuuuuuuuucagguuuugcuuuuugauuaaugcuuuuuguuaucaucuguucaguauaacauauuguaaaucauaaacucaggguucagaucuuucagagacuuuugcaacuugaaagguggagcuucccagccucaaggaaaucugcaguggcuaguguuucccacagggccccauuacccaguccuggaaaggugcuaacgaggcaucuuuuuuuuucccagugaagaaaacaucaugcauuuuaaaauaucgguguuaucugauauucacauguuucaaacauaugguuauaguacauauucaacagcccuuaagggcuuaaauauccuuuguauguacuauaauccuggugguagccacuauacaaugagcaccuacuauguccagcgcaugauucacauuauccuuaauccuccuagccucccugccaaaucauguuacgauuauucccauuuuaaagaugaggaggccgggcgcaguggcucacgccuuuaaucccagcacuuugggaggccgaggcaggcaggucacaaggucaggagaucgagaccauccuggauaacacagugaaacuccgucucuacuaaaaauacaaaaaauuagccgggcgugguggcgggcgccuguaaucccagcuacucgagaggcugaggcaggagaauggcaugaacccgggaggcugagcuugcaguaagcggagaucgugccacggcacuccagccugggcaacagagcgagacuccgucucaaaaaaaaaaaaaaaaaaaaaaaaaaaaagaugaggaaacuggggcuuagggagguucugguguuaaaagacaauggagucaauuuccaacgaugccuagcaaguggcacugacuguguucauccuauuuugccuucuggucaguuuauaacucgugcuuccgaacagaugaaaacuuaaaaguuuaguugaauauccaaauguuuccaaauauccuuauauuucauagcuuguaguuuaugacacauuugggagcaaguccuuuccaauguuuauuuauucucuauaguaccuacauuuaacuuuuuucucccauaaugacuuccgauccuacuucucccugauucaguauucacuccauuacuucacuggcucucuuccuuauuaucugucacaggacacacgcacuuuggaaaaaucugccuugugauaugauaauugcaggauguuuucugaauugcagaaggcuggaguagagggggaugaggguuugaaucaaguuuaucucuggaugagaggaauuuuggccugggaaaggaacuggaaacguucugaccagcuuuccgaaugcugguuaaggaaaagccuaacucacucuagacugugcucugcauucuagacauuuuaucauggucugcacccuucaggaucuuauauucugaggaagaaagugauuauuucccagguuguguuauuuuuaugaagauaauugaagcucuuuuaucucuggauaguuuucauuuuaauuuauagauaucccacugcaucuuaggaaagcugauauuuuuaguuccaaacuacuggaucacauuuuaccugcuggcacuuuugcuaccugaguaguuuccugacacuugggguuuuucuacuauucaaguuagacacuaaggcaacuaugcagggaauuuaagcaaauaauaaaaucaaaagaggagggaaaccuuucgucucaaucaucugaauauuuuguacuuuuaaaaucuuuacggauaggguaauauuuuaauacuuauaacgacuucauuauuuuagauuaucuuguauauguaauuuacauuacucuucuaacugcuguaagcaaauuaggucauguuuacucuguagucagugaaaacgauuuguucgaauugaggucuccuuggauuauuucagucauagcuacaucucuauuagagagaaaggccacuaauuaucagccucucugcauucucuaggagggccuuaaugcacucuaaauuuguacaugaagauuuuguuaagaaaauacuagaucuuacaugacuaaauggcacgcuacuauuccaaggagcuuguuuuuaguuuuacuucuccccuggacuccuuuucaggguguuuucaagcaagguagaaucuguuccuaggucacagcauagcugaaugccagagagcagaacuuaaccagaccuaaaucuugaaccugguucagguagaaaccagacaagugucauuaaguuuuccucuuaguagccacagcaagcucacagcagccucuagccaaggaccaaguauaucaaaggagacugaccagcacuguggacugcagugaaugcauagagcgggguauggagaccacagggacaauuuuauuuuuucuuguucucuaaaagaccacuaggaacaaaaugagcccaauuuuuguaguacaagcgcugguaauuacugaacacucacucaauucgguuaauaaagcuaaauauacccaaacaggccauuguuuugaagggagauuuuguggugugcuggaggcacguuggagccaacuguuacauuuuuagaaaguuugagagcugguuguuaaacauagcccuuacuaaaaauuaacauauauaaauguauaauuaaauaaauuauguuuaaaaacaggcaauguguaaagcucaucauuuccaaguuauucuucuggacuuuacuauuauuuaugcucuugauguuauuuauguuuguuguaucuauguggagaaauacuccacauauuaugugugguaugccaccucccauuucuuuccagcucuguguuuagugaugacacguuggcagcugaaauugaccaugguaggagcauuuacaccacagaaauuggcaaaugcuacaagcaggacuugacagguuguuuugauuauuaacuagacuuuaaaaaauuauugagaacauuuuaauaaugcagguuaaacaauaauuucggcagccuuuacauuauaaauagcauaaaacauuuaaggaaauauucuuuggauauucaaaaacuaucauccgguuuaacaaagaagucacucacauuauugaugaaugaguaaaccuuugacuucacuguuucacuuugguuuuacuuauugauauaaagaaaaauaucaaccaauguucauguugaaacugcacuuauuuguuaaugacaugagcuguuucuuugcugaaaugaauagucaccaagcguuuauuuguugucugauuuugugacacuguuguuggugauagaauuacaaaaacugauacugaauuuugcaagaaauagcaagugaaacaaauuacagguguauggaauuugaaaacagaguauuacauauuuuauuaucacuugucaauuauuuacuaaacauuccuuaaaucacuaauuuuauaauacacuuaugaauauguauauaugcacacauuguuuuuucucccagagauccugacguuaaacauuuacuagauaauggaagacaauggaugccuuaugacaugaaucuauaaaucccccacaauuuucuguugaguccuauuuuuagauccuuguuauucgaaggacacaagcagaacuuuucaaacaaaauaaaacacacacacacaaaccuaagaaacacgaucuccaccaacuuaauauucugaaguaugugaaaacgaaguguuuuaugugagaaccauaggaauguuuuucaaauauaauaaaaauggaugguguugauuaacuuacuuuguaaagacuuuccuuaguuuauucucugagaaacgacuauguagcaaacuuuguccugggcucugcaccaauauaaggaggacuugguuccuguuucccagguugagcuuaaauguuugcuguaauauggaucauccuacuuuuaagaguuuuuuuuuucuuuccaaauaaauagcuaaagagccauuuucaguuucuuaagagaacugacgugaauuugugaagaccguugaucaucuuaauuugucuuccauagauaguaauaaacaaacaauaucgaacaccuguuaugugcuacauucuauaccaggcacauuccucaaaacuaaucuuuugaaaaucucugugagcucaauuauaauaucuucauuuuacacaaaaaugagacauuauacugguaauaaaugaugaagaugagauuugaguucagguuuuucugacucaaaaauucucugucuuuucugaaaaaauguuuuaccccaagagcccuugaaaaagaaaacaaccaaaaauuauauuccuuuaaauuacuggacacacacugagccuggggaaaugcuuucaucaagugugagaauaaaacuaagugacagcuggauggccagauccauuuucugcaauagauagcagagucugagaaaacagcugcccagaaaugaggaaauggaacagacaguauguuuugguaucuuuuuacauucagaagaaaguagagaacuauauucugaugucauuagucaucucugauacaaccaaauuuuugaccugcugauacuacaggauuuaauugugaaacucacgguguggccuaagauaauuccaacuuccucacucuccucuugucccauacaaaauaucaauguacuaauuaguacuuaccaguacuaauucaaaauuuuauaucuaaauuuuguagagugagauaguuauauaaaccaaguaguaguauuagaaagaaaauaaagcaagcugaaguaggaucuaaaagaagaaagagaauacauuauucguauauauuggucuaaauguugcccuaguuuguuuguuuguuuguuuugguuuguuuguuuuuuuaaagaaacaagcaccaggauaugagaugucacugggaauaccauuucccuucagcugcuuuauauuucauugucucuugguuuagaauguguuuauauacacauaaauauauucuccaccaaauauacaauuuggaacuaauggcuuugcugauugaaaagacugaaacuugugucacuucacuaaagcauuuccuaaaaacaaaugccauaaaguuaaauguauauauggccaauguaugcuagaaaauaaagggacauguaggauuuuaaaucaauugauuuuucagccaucaguuugaguaacauaaauugcagacuauuaggaaacuuuggagaaaugcauaggcucacaguaaaaggaucugaguggggaaaaaauuaccuucuagggaaagccaaaaagacuguagucacaagagcagaaugaacauacugagacaucgccggggaggugggggcagagcaagggucucugguaaacaggagccacugugagaaggauccaagguaaaagguucgagaaaucacagugaguauuuuuuuuuagguuaaauguuagcaaaaugcuucugacaggcgugucaaacacuguauccguggaccuacagaggcuguuuguguuccaagaguagugcuucuucauucugaggaagaauagggauuugaucacagaauuucugaacucagaguuaugccacgucuuuuggcuuuuugauuggugagaaguaaggcuucugugaauaacuagcagauaacagauaacauccauuuuuguugcuggaaugaaauaagacccaacacuggcaaauuuacauucaugauaacggccuagagccacuugauuuccuaguggagauaaagagguaauguuuuauuugggggaagugggguuauauuugucaguauauaguaguaaauaacaaaaccaaacacaucgcguagcgauccaugagcaguaaugauaauaucuugaauuuguacaguaauuuguaaagcacuaguuaaucagagagaacuuuaaaucauuagcuucauuuuccagaggcccugggccagggacgucugacagaucuguucaacgucauagaauuaacucauggguugagaggcugggccuagaaucugggcauacugcuuccacccaguguguuccuuggcucguugagugaccaaagcaccgcagucacccagucuaccucuagauuauagacucaucaaacaauugaagcugcagagcaauucauuuuuaaaugacuucuaauaugaagcacuacacaauuaucaguaugcccuuaccacauagaacugggaccuaucuuguuuuuccacaguagaaagcauucagaaucaagacagugcaagccaccuucuccaguuccuuagcaauuguucuuuaacugauuuuuuugcugcaacuuuacaacuaaagaauuacuguuuuauaaaugaauaaaacaaggugcaagagaaugguucugauaugcacaacugguugauuugaugauucugaaugauguguuuauuaauugauucaaauaauuguuuuugacauuuugaggauuaaauuucuggcuaguuugaugauacuaauuacuuauuuuaaaacucuuaaacauccuacauauauauaacucuacagccaagucagcuuuugguuagguaaauuauagagugaaacuguauagagugaaaauuuuuuucacuuugggaggccgaggugggcagaucaccugaggucaggaguucaaaagcagccuggccaacauggugaaaccccaucucuacuaaaaauacaaaauuuagcugggcaugguggugggugccuguaaucccagcuacuugggaggcugaggcacgagaauugcuugaaccugagaggcagagguugcagugagucaagaucgcgccacugcacuccagccuggacaacagagcaagacuccaucucaaaaaaaaaaaaguuuauuuuaauugcagauaaauagaaagucauuuauaucagucuuugaaaugcauguccuaauuuuuauuucuuagagguguggcuuucugauuauuuugggaguagguuauaaugaauugacuuuaucacacacacacacacacacacacauaauagaaaauaaggauaaauacuaaaaugggcauuuuucuguauaauuaacaauauugauauagucaguuaaaccaaaugaaauugccguuuuuguagguaaaaaaauugaauauugucuauuucucaugcuuuauucugcuuaauuuuguuuacguguuuaucaagcuucuuguaugggauuccauuguauuuugaaaccaagcucucuuccagaagaaaaagaaaauggaaaaaaaaauuaccaauauucaaauauuuugauuguucauuauuacaguuuuauagguugaggaauagaaagaaaaagcagaagacaaauaaaauaccucauguccaaaccuguguguggacacuaacuccacagcacagacaugucaucacucaacuccacuucuucugagaauagcgacacagugugcaugacaaugccugcccuguauaugcacaguacucuuugcacgcuucuacuuacauaaggaauauuuuucuuuaaaaaauacuuuccuuaaaaacacauauauucuuaaacuaauacauucucuuuagaaauuuuagaugacucauaaaagcugaaggaauaaaauaaaauuguugaaucuuacuacucagaagaaaucagaguuaauauuuuaguguaaauuuuuuaucuaugaaguaaacaauuuuaaaagcuaaauauagagucucauuuagaaaauauguauuauaccuuguguaauuuuguauucuuuacacuucacaugauauuguuucccaagucauuaaauauucuucuaaguaaccagauuagaucagcaauaguucacuuaaaacagcgaacaagcugcauuaaaaaccagccagagccuuaccaaagagcugaugcuaugaauaccaaucauagcuuaguugcuguuccauauguuaauuuaauuugacagaguaagagucuuugaaguccuaauucucuuuugcauccaauaaaccaguuuuuauagugcgugaacuuuuagacaucagccugcagcuaaacucaugucgggaaguugccaugaggucacacauaacaauggcuuggaggggcgauccuuuggaagucuugugggagaggugaggggacugucaggggucacuuggggggucagugccuccgaugauagcaucuuaugggcauacagauuuguugccauuuuaugugagcucuugaagguugauuucuacagaaauggguccacaguagcccagcaacauucauuaauaaguguguagguacaucuuuguguuuauucaugggcucuguagcuuuagaaggaaaaagcuaagcacaagugucuugcuaguauguuguuucacuucccauacuucagcaagaaggugacucucuagucuucccuaucaucagcauuuagaauccggguggugaguuaguucaacucauagaauacucuuggggauauuuuuguuugaugcugauuagggcuggugguacccacuagaaggguagagggggaaagaaacagggcauuagagaagaagaucauaaagaaaaagguuaaaaauaacaaauuaugcuaaacauuaaguucuguagaguaaggauuuuaaguuuuuuuauuauucuuuguuuagauuguacguucuuugagggcagaaaccaugcuuauaagauauuacaagucuagaagcugauguuauugucuaauaguuauucuggagguucaacgucaaauauaguguccuaauugcuacaaacauuaaagaucaagacccuguggaaauggguuucuuuuccaauuacugaucaccuccagugugccaggaccugugcaaggcuagcauuugacuccaaagguguaugggcauucccuguaccugaaaacgagugggagccaagcaugugaacuguuaacuucaauuaaaagggguugcugggugcgguggcucacaccuguaaucccagcacuuugggaggccgaggcaggcggaucacgaggucaggaguucgagaccagccuggccaacauggugaaaacccaucucuacuaaaaacaaacaaacaaaaaauacaaaaaugagccagguguggugaugcaugccuguaaucccagcuacucaggaagcugaggcaggagaauagcuugaaccagggaggcagagguugcagcgaaccaagaucaugccacuacacuccagccuggacaacagagugagagauuccgucucaaaaaaaaaaaaaaaaaaaaggugggggguaaagugcucugauagucauaugcugagaguucugggccucucagcguuugugcaaaguuaggggaucacucaacaaucaauuaacuagcauaaaagagcaauucagagaggagucuaugccccucuuuggagggaccuaggaggccuauucuuuggggaguucuucaucaaugacagcgauuugagaauagggaaccgaaagauaggguggccacuuacaaggcacacaagccaacguuuagggaaauuggugauuaacaggaaauuauuggacaagugcuuaauuuuucaaguaaggauguuucuagguaacaauccuguuguggccgcaugguucugggaagugguagacaugggauuaagcagcugcacuggauaguaaugauguaauuggguuuccaacauaauuuccaguccuucuacugcuucugggugguuucaacgacugugugaccuaaguuucauuuuggcaguccauuucagcuguaccauugcuuuucaaccauuacaaagguagcuugacucucuuuuuacacuuaauuacucaaaucuuuguccuuuaaauaaaauugagauauccguagagucugccaauuaagcauuuagaggaaaccacacacucuuuguggagaaaagaaggccaaauuagacaaucaaguguaccaagaauuugccuaaauuugguauaauuuuguugaagauuaauuuauuuucauggugaguuaugguauugcaugaaaagcacacuuuacuuuacuuguaccugacugucaaacagccauuacaugcgaagggcagccuguauacaggcuggguuuccccuuccugcuugggaacagguacggggaacuguuggcaugaguuguucuccuuagcucggcauaucucacacacauauuguaguucuauucuccagucugucuguucuacucagugugauuucuuacucauacauuccaacaucucuagauuuuuccuaaucucuucaaagucucauucaguugucuuccagauauuucccuucacauccuuucuuuuuuuuccuuugccuuucucuuuguuauuacccuuucuacauuuucaaaaugaguuucauaugucuccaguuguugcugggaaguagaauuagaugguccucucuucguucauccacagccauuuuagugcacaguguuaaaauuauuuguuuaugcaucuauuucuuccuugaaggaacuuucauccuuaaugucuuccuuggcaucuaauggggacuuaauagaugccuauguuuuuaaccauuguaauuuuaguaagaacguuuauucugcuuuccugauagucaauucacaaacagacuuuugcaacccaacucccauauagacugaggaguuucugcaauguggucaacuacagcaaaaggcuuuuuuuguuacaaaacucuaaucuucaucuacuuuggcccgaccugaauuccacuauaauuaccuuuacaacauauauccuaccaucaucuuaaaaaggcuuacuucugaacacauccgcuggcagaagauuuguuuugcuuucuuuucuaggaaauuguagcuuagcaaacuaugagacugucugacuuuaauuuuucuuacuuucuaacuguugaucuaauuuuuuuaaaguaaauagauuaccuuuaauuugcuuauuaugcucaauaaucacacauuagcaauguaauaauuuuaauaacagaaaguacaucuaaaucucuacuguuuguauguaagucccauaccugggagccacaauacuuucaaaagugcacaucaaaguaauuguuuugucuggcgccagcacaaauuucugcugggaacugccccauuuaauauaaauuauauuaccuguggaauuuaaaaggauauaagguguagugugcccugcaggcaggaaauuuaaacuauggauugccuucuuuuuuuuuuaaucucugauuuauuccuguaauguggaauauuuagcaucccuaauuuccauuuaaucuuuuuacaggcauauuuugaauuuuucagucauagggaagacaaaguuagaaaugcuauuauucucucaggcuaacuugagaaugaaaaauaucuaaagcuaagggugaagugggaaagagaugucauuaucugaaggagucuauuuagaaaccaaccaaccaacaaagaaaaaaaagggaugaugaagaaaaacagggaacuuugaccuaauuuaaccaaaaaccaucaagccucaaaccugaugucuuugccucuuuuuugccuauauagaugugaauguaggaguagcacauccacgggcaugaauauggagauauaaccucaucucuguaaauccauugaacauaguuuuauacccugcuuagaggaccaagauguuacauuuuaagccuguaggaguaaacacaugcaaacccagcuguucagguggagaccucuggcuuccacauucacacccucggugaccuauuuggcucacguaguccucucuuaggagauggcugcaugcacaucgucuuggauguugaauguacagaauacuuucacuaggaccaguaaaaagggcaaauaaagcuaacagcacaaaagaggauauauugaaaagagguagagaggaaggaaggagagagagcauacacuagagaagaaaacuagaggagcuaaagaccaaagcaaugaagacgaggcuccuguccaccuccccucuuuguguuccaggugguucuuacacucauuuuuacucagccacagcugaaaacaugcuccuuucucugcccuuagucaggggaagaggccucugcucagucucuuaauucagucauugccuaaccauucucaugaaacagguccccaucaccaagagcagauaccuucuccaggucuuuuucuuuuuuguucaauaauccaaguauucucucaaagacuaauauugcagucaugaacaauagucacugcugaccgagguacugcauuaaaucuuuuauaucucacuuaaaaaucuuuacaccguacucacuccucacaccuaccacauagauucuguugucccaauguuauagauuauugaguaagauguucuguaucuuuagccaugaauaugaacgcauguaguugauaauucuacauaagauuuugcuguuuuuccuuugcuccugcaugcauuucucucuguucggugucuguggucccugaguuuucaugacaucuucugguaggaacuugggguacuagguccucagacacuuuuuacaguuuucuccuuuuuuucuuuuuaaaacaucuuauuaguucuuggaguacuguccaacugaaacugaaaugcacauauccauaguuuucuuuugguuucuuauauguguccuuuugacuuauaaaaaaaagggggcuaaauacccuuuguuccaagcguugacugaauucaaaggcgcaaauucaacucaaguuuuugaacuguauagaccaguuaguaguagcaauuaguagucacugaaugccagugguuaagagaggugguguuuagcuuccuuccaccccauucucuauucaccuuuauccuuucagcacuagagcccccacagauucugcagcaaugggcaagaucuuugagaggaacaauauuaagaaauaagccuucagauaugcagaggacauuuucuaagcuuaaaagcugauaucgaacaauagaacuauuuauuucaaaacgacacuccauguauccaacucaauugguauacuuugaugacuuacauuagcauuuaaaguacaagcaaauuuuagaagaugccucuagacucaaguguuggagguagggagcagcuggucuuuguuguuagaaaaacagauauucaaaguuugggauaacagaugaaccaucucuaccacuugacuuuaaaguuaguuuuuagauaagaagauagcuuaauaaugggcugguuguugagaggaucagccuucuaaaaaccuuaauaugcuuucagucuucccuggaaacaggugauaggguaauuagcauccacauccucuacucaacagagcagcuucucugcuggcacauugcuuggcaggacuccagggaaagcugugugaugacagcaagauuaagauccaggaagcaaagccgggucauaugcucuaaguuguccauuccuucuauucucuuagcauguucgauuccacaaacacggcuuauuccaaaagccaauccuccuaaugagcauucggucauuagaauuuucaucaauaccaaacggaauuacauuuggggccccuuuuggucuuucuugucauaccugagaugaugagauccuuuauucucuaagugccccuuaugcacacacagaaccagagcauccguguagaaauaagaacuuaccaugguaaaugaucaguauuguugaaucuccaagaugugggguucaccacauuuaacuguauguuuauuaacaauuccauucuaaaaauuauguuacaagcauggccaaacagaaaugaaacuaugauaguggcaucucuauacuaaaagucuacucucuauggaucuggccauaucuacacuuauagauaauacguuguauggaaguucuagugucagagcuucaggcuggugaucccugauuuagauacuguauuaacuauaucuuuccacuagucuuucuguuuauguucucuuuacaauccccaaacacccaauaguuugcaacccuuaccauacuucacagaaugauucuucagguaaaugauaaauauuaaauuuuuaaauuuaugcauauuauuuugguaagcuaaucaaauuuuuuauguuaaagugaacuugauauauuuuuauauucugucauuuauuucuccauuaagugcacagcuuuaaaaauuuucagugcugcaaaaauaggccaaaaagugugaccucaucuauuuuaaauuuaaauaaaugaaugaauaugcaaaugaaagaaagaauguccccugggagcacucuucauggugggccucagcaaaauaaagaacaaaagcuucuagaccuugcuuccugcuccugcucugucuagaacccuucugaaaaucauuuccuccaaucuguagagugucaggggagucuuagauacuuggguccuuugcauuguccuguucaugcugaauuaucaguuuuauuuagcaguuauaagugauucacauugaaguuaaaggaacaaccugaggagguauuguucacagacagccaacacucagaaugugauugaaagcauagguuuugauucuggaaagaauccuggauuuggaaucuauuccuggauuuaacgucaugccauagcuccaucagcuauuuacuggaugagucccucuuccucucuggcccacaguuuucacaagucuaaaauguggauucucauaggaugaucaugccaaauggggcauuuuaguuucuaaaaugagaacguuauucaucuauauaaauauaaaguuaaaauagaaacuguuuuaggguugacaaaaacucucaaagcaguccuuuagcacuucugugccccugcucugaggcaggaccacucuuaaauucuuccauucagauaaaaaaucucuauuguuugaaaacaccuucagaggagaugugguaggaauuugcuucacaagcacaguuacacuagacguuauuaaaacaaaaagguuuuaauuaauuacuuauaaucaugagucucuuguuuucuguguaguucuccacacaacaguucuucuguuccuccauuccuuccaccauuuugugcuauuuuuuccuucugccauuuuguaccauucugcggcaguuugccucuccuuccuuuucucuggucaacuccuucaguggucuuccccauuuuaaacaaacuucacuucuccgcuuuucuccggggucagucaucuugacuucugcacaggaagaagaucccccagucuuccucagccacugaguccaauaagugcaauccuucugguaaggaaacuugccuucuuguugcaguugaagcccauuuucuaaucuuauuucuucagagcccauuucaaaacagcugguuaccauccuuuagguuaguccuuccuagacaguacuucaaaaacauuauaucacuuuucagucauuuuuaucaagcaugaguuauagaacuuccuuuauccuuuucucauaagguguauuauucagccuuuuaauaagcagcaggguguaauugaaagaauauggacuguguaguuagaccuagguuugaaucugggccguguuacucacuagcuguuugaccccacucagagcucaugacuucucugaacguaaguucccucaucugucaggugggguucaugggaccugucucucaggguccccaucacagcugauguguguaguguuccugaugugucaccagugcucuaagaaguguugguuacccuugcucuucccuuucguuauacucuccucuacaucaguucacuauuuccuggcacuuauggagccuaggguugaacacaauguugagaauuugaaauaauugucuuuauucaucccccugcaacaugcuuuuuaaaaaauguuuuggagaggauguggagaaacaggaacacuuuuacacuguuggugggacuauaaacuaguucaaccauuguggaagucaguguggcgauuccucagggaucuagaacuagaaauaccauuugacccagccaucccauuacuggcuauauacccaaaugacuaugaaucaugcugcuauaaagacacaugcacacguauguuuauugcggcauuauucacaauagcaaagacuuggaaccaacccaaauguccaacaauguuagacuggauuaagaaaauguggcacauauacaccauggaauacuaugcagccauaaaaaaugaugaguucacguccuuuguagggacaaggaugaaauuggaaaucaucauucucaguaaacuaucgcaagaacaaaaaaccaaacaccgcauauucucacucauaggugggaauugaacaaugagaucacauggacacaggaaggggaauaucacacucuggggacuguugugggguggggggaggggggagggauagcauugggagagauaccuaaugcuagaugacgaguuagugggugcagcgcaccagcacggcacauguauacauauguaacuaaccugcacaaugugcacauguacccuaaaacuuaaaguauaauuaaaaaaaaauguuuugguuguuuguuguuguuauuguuguuguuuuugagacggagucuuguuuuuguugcucaggcuggagugcagugguacaaucucggcucauugcaaccuccaccucccagguucaagcaauucuccugccucaggcuccugaguaguugggauuacaggcacccaccaccacacccagcuaauuuuuguauuuuuaguagagacaggguuucaccauguuggccaggcuggucucgaacuccugaccucaggugagccacccaccuuggccucucaaagugcugggaauacaggcgugagccaucgugccuggucuaaaaaaugucuauuaguguuccaucacuagaucucuucugagguauucaugccauaugccccauccugaugucauauccacaggacaaucuacuaccaagaaccagcuccaagaagaaaacaucucugggaaacaguaccaaaaggagucacugaauugucauuggaggaguccaggauagcucuucauguuauuuucaccuugaggaauuguccauuacaucuaugagccuuauguguggcuuucuccgauauagaaaccuaucaggugucuuuuagaucauuucaaaacacuggcuuauucuuucuuauguuuccaacugaagucugcaucccaagauguaguuucacugcuaccccauauggcacccuuguacgaauuugaaaaaaguacucacucuaggcacaugcagagccaugccugcggggacagcuuagagaguagagggugggcugaacuccaguuacucucguacagggauccaccuuuuugcagaaaucacaguguggcuauggugugguuugauuucauaaaacagaugcuuaaaaaguauucacugucucugucucuucagugccauguaauaucacaugacuuuccuuucucauuccauugguauuuuccugugucuuuuauccucugugcaguuugucaguaacauuucauucccagcuucagaugggcugccaugacuucugccaguuccagcuauuucuuuggaugcaccuuugaauaccuaccuugacuuacauuuuuuuguuuuguggaguuacucuuuggguuuaaauuuuggacauuuggguauuaacccaaauagauuuugcuuaaaauguccacauucuauuaacagauucuuaguaauagcaaauuggcaaaaucaagauaguuaauucauauuaacguugcuucccccucuucucuaccacgccucuagagaugacuuaacugagcauccaaaugaccuaacccaggguacuggagggaaagggggaaugggugaccaucagucuuaaauaaucuacacacuaauaaccuuccuaggaggugagaguccagucguucuaagaggaguaccgugcugucauccuugccagaaaagaagauccuuuuauacuaggcccacaacuuugaacaagucccccacagaacaguaagggagugcaguggaccauuacauuuuccagggcucaaccaaauugguucuggugaucaaugaagcugcaagucugaggcagcugguuccauguucaguaacugauagguauucuuacauucaucucaaggagguagaagaauacuuuaauauaaaaaaguguguaaaaagggaugaagauuaagaaguggaaaacuugaagauaagccagaggcaaaauuuccugacagcaugauguacuggacugcagauaggucuuuugauggauaugcuugaaauuccauuguuacauuuaucuugucugcauuuuucugcauuuauuucuaaugugucugcuaggccaguaccucucugggaacauaauauaaaaacaacuauuaaguaaauagaaaagcuuaaacaauacgcauauaacuccagcuugaagcauuuuuuaaugcuuuauaaaucacuagaaaacacgugacaggaacuauuccugaucagucuuaggaugugcaggaugccccaagaagcuuuuccuguuuacuacuuuuuugaguguaugaauauauguuuuuugacuuugagauaguuaauauccagaagaguucuuuggcuauggaaauagccuugaaggcuugggucugggaaaauaauagagagaaagaguuacuagggcuuaguagaagaauugagggaaggaugcagggaaaagcggacaauaaauagaaagaggaagcuggugaagguagacuuuggcagcuggggcagcggcacuugggccgcuuaugugagguagcccgcagaggcaccuuuggguggagagagaauaaaaucugguuuugacacguuuguuuuagauggcaaugaaaugucuagccuauauauuuuguagacacugagaaauaagggacugaaaagaggaagaggugucagggcugaagauggaaaucuggggcucaucugaguauaggugguaauugaauccuuauggcugcacuaagggaauaaguagagaaggaaaagaugggcuaggagccccuggcugaaccccaggggcacuaagugguaaugcauggagggagggggagaaguuaaaagaaggaagaaaaagcagacagaaauaucugaggagucccagggccuaaggucccugccacugaggccgugagaauguugagaaggcagcacagaucccuggaacgggauugccgcuaagaaguuaaguaagaagccaugguguuugacagcuuccauaaaagcaaaugacaaaagcuaggacugcagagaggugaaaccagggccuaaucuggaucuggucuggauuguuuccuccaugcucucuagcacagagcuuuauaagacaguguugguuuaacgaaugagggagggaaugagggaaugacugaaucaagcaaguaagcagauauagaaacaugggcguuuucauaaagcagaguacucaacagugccugugagcaucacugacaggccaaacacauaaaacaggcagaagggagaaaaggaauugagaaaaagaaggacaaggaagagacagaagggggaaggaaagagcaguaagaacugaaaaaggcuggaguuuccuggagugugcaguuguggagcccuagaucuguggguuuggcccuuacuuugcucguaucucuaguuguuucuuugacauucaucuugugucugugaugaaacuuuaaguuucuuaguaaagacaagaacuacuauuguguaucucuuuaguaccuaauacaauucuacaagcauuuacuuuauucuugauaacagguggagagaaagaaagcagguuuucaguaauuuauaaaagugaagaauuaucuagaaauguagucagugaaaacauccaguuuugauaagucaaacuaaaacauccauucuucacucagaguaggcuuuuaaacuuggauuuucuaaguaauuuacucaaagcccucucucucaaagacccucuugugaaaugcccuugugaagugcuugugaaauggccuuuugaguuagcuccacaaaauguccuuccuaaucuuagcaaaaugaagaaaugggucaaaaugauuugaaauaugcuucucugucucuuccuucaccucuuuuugguuucauuuucguaagaguaccugucagcauuugcagaagaauuaaaggcagugucguucuggagggaaaucacauguuccuuuaauuuugugauggaaggacuuauaaagagaaguggagcuugguuagaaaggggagaugugcacauaggaaauguaagcagggcuggugagaaaacuuggugguggcguuuaauuaauuuugaaacugggaaauaguucuacaguuaaucuguaaguuuuuuuauguugaaugcuuggaaaauuucaacuuuuuuauuuucagacacuuuguaugcagugaugacauaaauaagaaaaauggccuugaaaacaucaaaaauguaauuuucaccuucuuaugcuuuaaaaacaccugaaugcacuuuucucaaacuuuuaagaaaagaaacaaaacucagauuuugguaaagaucaagaugaaugguguugacaaauuucaggaggcuggagagucugaaaauagucuuauggaugacaucuguauguaacuuuuuaaugcucuaccacagaugcucccauaagggcaacagagaaauagcuggaaaagguaacaauguuacuuauuuuauuaaauacguaagaauuguuugcauccauuuccuggcaguauuuccuauuuuuaggagugaggugaaugauguuguagagcuggagauaccagugggcugacuacaauuuucaaagcaccuugagauguaaaaaaauguuucuguaggagggaagggguacgguucugauaaaucucucagcaggaugaaaaagaaaagggaggucuagacagucuuguuucaucuaauagaauuuucccacagaagaugggcaaacaucagauaagaacauuuaucagaccucacacauuuuacagccauaucccuuugggaacauugcgcagcauagacuugcuaaguccugaaaauggaagacagaaagcacuauaaaaaauauggacuggcgcccugaaaaaccagucuuuauuacucacccuaacauauacauuuggcauuuugguguacuuguuaaaugauacauaaaaccguaucacuaaugaaaauacagcaguaguccaugagcucuuggcucaaaagaaagcaaaaguaaauuaagcaaaauaucuacuuuaaaaaaaaaaugguaguagucccauuggacccacuuuccuauucugcucuugccugauuuucauaacagugggugaaugcagagaugcuuuaguaguaagugcaggugaugccagggcagauuuuugccaaugaaauaagaauuuaagaaaaauguuaaauucauguaauguuauuucaaaggcuaauccaauaauucuuaaacauuuauguaaaucugccauuuucucacucuggaagacagauaaagagaaccacgugagaagauauagcauguucuauuacuugccauuaaauugauaagaauuacaaugucugugaauccaucaauaccacugaaggacaugcaguggaaucaaauagguggcagaauagcuauaugaaucacauaauauaacaaaucuuuucaccagaugguguucagauuugcuguuuauuuguggcuuauuuaauauuauccugcuuuuccucaauccacaaaggauucaaagcuucuuacaaagaacaccuugggccucaggcaaccaguuuuuaaugacgaaagauggacucugaaguccaugacauuuaguaauuugucacuuuucuugugcacaaaguugaauucuggcuccgggaagcugauguuugggagaaaaucauuuaguuguggaugaagugagccaauacauagcugguagucccaauaugacuuguuuguuuccuaauuugaguuuacauaguaacucuuuuaaagaaacaaaaccauuuuuuaguggugggggaguucuuugugaaaauagccgugaagugagagaugaguccgggguagaagcuggaaaaggaguuaacuugcagucugaggaugugcacaggaaacgcuugccucuagauaguaauacaguuucaggagagaucuccaaaccugagugaacuauuuccuggauucuuaaguuuagagacugugaaucugggggcuugccaaguccucaaaaacaucaagggccuacuaaaauauaauagaaaaucuagaauaaaaaaagagaaaaagacaaggaacauguagauuuguuuagaaugcguauuuuaggugcaauucuccuauuaccaacugauaugguuugccuguguccccacccaaaugucaacucgaauuguaucucccagaauucccauguguuaggggagggacucagcaggagguaacugaaucaugggggccagucuuucccaugcuauucucgugauagugaauaagucucacaagaucugauggguuuaucagggguuuccacuuuugcuucuuccucauuuucucuugccacugccauguaagaagugccguucgccucccgcuaugauucuggggccucccaagccauguggaacuguaaguccaauuaaaccucuuuuucuucccagucucagguaugucuuuaucagcagcgugaaaacagacuaacuaauacaguaaauugguaccaggagaguggggcauugcugaaaagcuaccugaaaauguggaagcgacuuuggaacugggcaacaagcagagauuggaacaguuugaagggcucacaagaagacaggaaaaugugggaauguuuggaacuuccuagagacuuguugaauagcuuugcccaaagugcugauagugauauggacaauaaaauccagguugagguguucucagauggagaugaggaccuuguugggaacuggcacaaaggugacuuuuguuauauuuuuagcaaagagacugguggcauuuugccacugcccuagagauuuguggaacuuugaacuugagagagaugauuuagaguaucuugcagaagaaauuucuaagcagcaaagcauucaagaggugacuuggguacuguuaaaggcauucaguuuuuguuuuuguuuuuguuuuuugagacggagucuugcucugucacccaggcuggagugcaguggcaggaucucggcucacugcaagcuccgccucccggguucacgccauucuccugccucagccugggacuacaggugcccgucaccaugccuggcuaauuuuuuuauuuuuaguagagacgggguuucaccauguuagccacgauggucucgaucuccugaccucaugacccgcccgccuuggccucccaaagugcugggauuacaggcgugagccacugcgcccggcaggcauuaaguuuuauaagggaagcagagcauaaaaguuuggaagauuugcagccugacuaugugauagaaaagaaaaaaaucucauuuucugaggagaaauucaagccagcugcagaaauuugcauaaguagcaaggagccuaauguuaauccccaagaccaugggggaaaugucuccagaccaugucagagaccuucacggcagccccucccaucacaggccuggagauccaggagaaaaagugguuuugugggccaggcccaggguccccaugcugugugcagccuacggacuuggugcccugugucccagcagcuccagcuguggcugcaaggaaccaacguacagcuugggcuguggcuuuggcgaguggaaaacccaagccuuggcagcuuccaagugguguugaaucugugggugcacggaagucaagaauugagguuugccaaccuccaccuagauuucagaagauguaugaaaacaccuggaugcccaggcagaaguuugcugcaggggaauggcucucgugaagaaccucugguagggccauggggaagggaaaugugggguuggagcccccacacagagucccaacugggacacugccuaguggagcugugagaagagggucaccaucccccaggccccagaaugguagaucuacugacagcuuucacuaugugucuggaaaagccacagacacucaacaccagcccaugaaagcagcugggagggaggcuguacccagcaaagccacaggggcggagcugccuaagaccguaggaaccaaccucuuacaucaguaugaccuggaugugagaccuggagucaaaggagaucgcuuuggagcuuuaaaaugugacugccccacaggauuucggacuuccaugggcccuguaaccccuuuauuuuggccaauuucucccauuuggaauggcuguauuuacccaauaccuguacccccauuguaucuaggaaguaacuagcuugcuuuuaauuuuacaggcucauacacagaagggacuugccuugucucagauuagacuuuggacugugaauuuuuggguuaaugcugaaaugagcuaagacuuugggggacuguugggaaggcaugauugguuuugaaauguguagauaugagauuuggaggggccaggggcaguaugauaugguuuggcuguguccccacccaaugucaacucaaauuguagcuccuagaauuuccauguguugugagaaggacccaggggagauaauugaaucaugggggccggucuuuccugugcuauucucaugauagugaauaagucuuaugagaucugauagguuuuucaggaguuuccgcuuuugccucuuccucauuuucucuugccaccaccauguaagaagugucuuucgccuaccaccaugauucugaggccuccccagccauguggaacuguaaguccaacuaaacauuuuucuucccagucuuggguaugucuuuaucagcagcaugaaaauggacuaauacaccaaccuugggaaacuucauugccugaccauuucccuaguuucuucaauuggaaacgaggggaagcugcucauccccaccaauuguugugccccaaagaagggcagcgugguccuccugcuaauuuaguugguaaacuugggcccaaucaaguaaaaaaaagaagaaaaaaaaaucccuauggcuauucuuaaagaagaccccucaagaaauaaaagaacaugguucuggguccuuucccacucccaaaggagagcagcuccauuuuuaugauuuauauaaaaugauguucugaagacuggggguuaggggagagaaugaggaaguggaauguuucuuugaugaaggaacacucaccacccacuaggggcuucccuguguuacauucagacuauugucaguuccugggcuuucagggacuaagcugguacaguagugagcuccccuugccagcuacagcacuggaccaguccaacaaaauauauuuugaggcugaagaucaaacaacuuagugaauaauggaagcuccuguaggcuccuguacccugugggaaccuagaagaguaugguaggacagcaacauaagagccauuuucuggcuucaaaugggagcucuagggcucugauuggagaugccagacuuuaucacccguaagaaagucauucucgccgggugcggcagcucaugccuguaaucccagcacuuugggaggcagaggcgaguggaucaccuggggucgggagcucgagaccagccugaccgacauggagaaaccccgucucuacuaaaaaauacaaaauuagcugggugugguggcacaugccuguaaucccagcuacucgggggcugagguaagagaaucgcuugcaccuggcggggcggagguugcagugagccaagagcacgccauugcacuccagccugggcaacaagagcaaaaccccaucucaaaaaaacaaaacaaaacaaaagaacaaacaaaaaaaccaggaaagucauucucugacccacccccagcccaccuugggaaggauacuauuuaauagugacuuaaauuccucuuaggguagggaagguccaucuugucuuggcuuauucagggcaguggaagcuuuacccacuuccuacucuucuucauguuauugaagcccaguuaaaaugaaccaacuuagaauauaaaauuauuuuaauauuucuucaucugacuucuaaucccauuguucuuuuugcuguaucugaagauagucccaacuucucaaauauguuauuaauuucugggcuguaaaaugaauauggaagagggacucaaauuuuguaaaugcugugggguuacaaaucaccaauuguccucugccucuguguugccucagccuaccgcaagaccucccuacacacacacacacacagacacacacaucccugaagucacucuaaauaucaguaauuaugaaguuggccaggcacaguggcucacgccuguaaucccagcacuuugggagacugaggcagguggauggcuugaggucaagagaucgagaccauccuggccaacauggugaaaacccaucucuacuaaaaacgcaaaaauuagcugggcguuguggggcgugccuguagucccaccuacucaggaggcugagacaggagaaucacuugaacccaggaggcaccgguugcagugagccgagauccugccacugcacuccagccuggcaguagagcaagacuccgucuccaaaaaaacaaaaaaaguaauugugaagucuuuggcaacuuccugaggccuuccaacucucucccagccuuucagaacaggucuuccuauuuucuuccaucccucuucugccguucugucauauuucuagaguggggcuggcaauaaaacuaucagagaagagagaaaccauauguucugagguaaaauuuaacagaauaaagaaauuuccagcccuugaaaaugcccagaagcuuccaagcagacccuccuuaaaaguuuccaucuacugucuuuuauuaaacccugguauuccucaaaugugaaauuccuuucugaauuguuaaaauauuuuuauaaauaaaaaaacucaauuaauuuugaguagcucaaaaguaucuuuucuacaauuucuaaaguaaagaugcuacauuuuagguuauaaguuuuugccaccaggugugacucuaacuauucuucauaucuuuuguucgcucaaacgugucccaaauuugaaaaaaauugacuuuuggacaauuucuaauaagcauuugggugguccugagcaggaggaacuucuaguuugugaaguagcuaaggaaaacaucuuaggcaauuuuuaguuccaagaacuuagccugaccaaguaaccugacuugcagcuuaggcguuuaauuaggagcaauuuggacaccagaguuccgauucugcucuuggugccaucuuuuucuuuggggaaguguucugcuuacagccuauauuuugugaacaucguuuccuguauaucuuugugucuaauacggcacuucaaacauaguaggcauuuggaaauugcucccugaacugaauuaaaugcaagguuaauucaugguuguacaugaucagaguuggaguaaaaaaugaaauaaaaugaaaagcacuaucaauuaaucagguuaagucaugucaagcgaucauuaaguuuucgaugaucuugcagaucuuugagagaaugcggaucucgggcauuuucaguugugugcacugacacgugaaugugugugugcccucacauaaguucuuacauagcagaaggaaggaaguugugaaaggggagaaaauagagcuauugacugcagagccauaaagcuguuuuuagaaugacugcuucuguuguauuggggaacgcuuccuuugagaggggguauauuaugcauccucuuuccauuaagucuauuuuuggaagaaauuacagaagauaauauauuaccagcucccagggaucucuuaucaacauagccucuguucucauaacacaccugcuuagagcaaaauaaauuauucuguccucaggaaugccaaccccagacaaucaaaaucuucacuaaaucccuguauuuauuagggaagcucggauuuuugaaaaguguuaacuccgccccuaaaagcaguaagcgagagauaacaacaguggagucuugugguugagcauucaaucagcuucaacaggggcaaagucuaggaauuguuuucaaaacaguguggggcuuccuacucagggggaggauuuaucugcauuuggcaauuacuccaguuaccuuggaacaagaaauuuacuucucaguaguuuugcaaauuaaguguuuaacuucgucucuauagaauuaaugccucggagguggggagagggaggcagaggagaggcuuucaaggccaguucacaaguuugacacuuaaagugauaguagcaaguuuuucucuaacugcaagagugugaaguucuguuuccaccuaauugcaguuugcauccugcaaguguauugauuuagacauuaaaacaacuuaaauguuuagcaguaaaaaguuguuuaaucauuaaaccacuaccauuuucuuucgcccuuuaaaccugcuuucaaucagcaaaugcugauuuggaugcugguuuacagucucauuaaccaugaagaucacaaaggaaagguuguggcagcagugggaagcucugaagcacccucauugucacaggaaacauucagugagacauucagcugucucacaacacacacagcucugagagagguuugggugacagaaaugcagccuccaguuccagaagcagcacgcuguucauuccaggaaaggaaaaaaaaagugcuuuucugcgugaccauguugaucacuguuaccaugcaguaaucaggggucuuuuugccacuuaaguguaaugggaggaggguauaucauuggagacuccuaggugaauggcguggauguuacucuuuugcaaagcaaggaggaguugcaguguuucauggccuucuuucaacacacgggaguuuuaucacucauuuuaaacgcacaacuuaacaccauuuucaaacugaguuccagcccuggauuguuuuuuuacaaaauggccccuuuccccucauagugggauggccaugggugcccauuaauugcuacacuuauaggaacugaauuuauucccuucaugguagaaaaaccaagccuauuuucugaaacuuaauccugugagcuaccauccacggccauaccaggcuccaggaagggaucacaacuuucugaagagaugaauugcugcuuuaacaaaggcuacgugugccuuuugauuccauauucugccuccacuagauguuugguuuugcugccaaauauaaaaaccacacuggaaaagacaguucuucacuuuuaaguggcugugugauagaaaauugguaauuaguucaguuuugaggaagacagggacaaacucuucuuuacguuuuauaaaaucacaaauuaucacagugaucuccauuugagauggagaaauggaaaccuagcaaguuccagagacuugcccaagaucuuguagcuaauuauuagaagcaggaaauggguuagaaaccagaacccugauuuacagcuaauuguauuuucggcuauccaaauaucuuuacuggauuaauacaaacuucucuuguccucagguaauacaaauaccuguccucauagaaaauaaaggcuuauuggucugucucuuucucucugucucucucucucuuuguaucuguguguguguguguguguguauauauauuuuuuauauauguauguauauauaaaauauguauguauauauguauguauauacauacauauuucugucacccaaaauauguaugugaguauauauauauauauauguauguauguauauauguguauauauuauauauuuuauaaagauauauauucaaucauacauugcuuaacaauagggguacauucugagaaaugcaucuuuaggcaauuucauuguuguguuagcaucaaagaguguauuuacacaaaccuagauaguacagccuacugcacaucuaggcuaaauggugcaucccauugcuccuaagcuacaaaccuguacagcauguuacuguacugaaacuguaggcaauuguaacacaauaguaaguauuuguguaucaaaacauaucuaaacauagaaaagguacaguaaaaauacagcauaaaagauuuuaaaaugguacaccuguauagggcacuuaccauggauggaaauugccagacuggaaguugugguugcucugggugagucagugagugaguggugagugaaugugacagccuagaacauuacuguacacuaugcagacuuuguaaacacaguacacuugggcuacacuaaauuuauaaaaaauauuuuucuuucuucaauaauaaauuaaccuuagcuuacuguaacuuuuuuacuuuauaaccuuuaaauuuuuuuaacuuuuuuacucuuuguaauaaaacuucacuuaaaacacaaacacauuauguagcuguacagaaauauuuuucuuuauaucuuuauaagcuuuucucuauuuugaaaauuuuaauuuuuuuuaauuuucaaacuuuuuggcuaacaacuaagacauagcacacacauuugccuaggcacacauaggguguggaugaucaaaaugucaguaggcaauaggaauuuuucaacuccauuauaaucuucugggaccaccaccauauaugcaguucauuguugagugaaacgucauuauguggugcauggcuguauuuauauccguauaaagauuacacauauauaaaggaugcaaagacaaagaguacauauauauuuauauauguaguguacuguauauaugcauguauguauguauguauguauguaucuuacuuugggauuuccuuuuuucuaaccuucuuaccauuuuaagaauuggucuaugcacagcaaacuuuuagaaucgcaauuaaaauauucagagaaguggccaaguuuuuguauagguguuuggauacugugcagacaaguucuacauuucucuguucucaaaacuccuuccuacauaaauacugaggacuguucucuggccaaaguuugucaaaccauuucucugaguaacaagacuuccucauguuuuccauacucuauaguucaguguugcagccuucccauacuugauuuuuaaagcggaguuuuguuuuguuuguucuuagugcauuaugacuauaaaauguaaaaaccuuuccucuuugaagauaaaaggaaguaauccuaauuuuaaacacuuacuuguuuuaaaaaauugaaaaaaaaguaucgacuugauaugucuaaagagaccuauguauauauguauuagauauuuauauacauacauauguauguauauauguaauauauaucauauauauauuuuagaaaucugcaaauuuaaaaagggaguguuuagauugcagaagaccuaucccuaaaccccgaaucccagaauucuuaagcuagaagggcacuugagaggugaucucaucuauaaagagauguauauuuaaggagcuaauuuacacagguagaugacaaaaccuuacaccaacucuucaagcacaggaagcaccuuacacgaaacacuuuggugaaugcucauuucuacucaauuuuaaacuaaauucaacugaaaauaccucauuuuaaagaggauauucaguugacucacuggggaaaaacaauuggauaaacugguuguuugcccuuaccgagauaaaaucacugauaaguugaaugcauuuuuguaaugugucaagacagauggcuuuaauagucacacauauuaaguaugggauauguggcgaggaauagagguuuuuauauacagaaguaagaacuguagaggggggaaaccaugaaagauagaaaaagaugagaagaaagaggacagagaugauacacucaagaaaagcugccuauuucagaguagaauauauuguaagccccaguauaguugaaugcuuacaagaggagaagcuuuuagcaacuccuuuguuucuuaauguauauauuauaucugaacagaaugcuucuuuccugugagcuagacaguaggaaguaaucuaucuucaaccuuguuugguguguaaauaaaacuuuagaaagggucuauugaacuuuggacaggcaagcuccaugagcucucccucacucuuugaggcagguuaaaggguacggccaugaccaccaccuuaauccuucagggacuauuuacaaaagauugaaaaaugugcccagggcccguaccugccccucuguggaacuagcccaacucaagugggcuggcaggcaagccuggcuuucauggggacagaagagagaguuugcggggagcuuggcauuuuucaacacaugcuuuuuggcuucuccuacugaauuuguaauuuccaugauauuuggugggaaaauggacaccggccucuuuugcuuuuugucugcugcuuugcagcuauugggauucugcgccuugggauaaugaagcaggcugucauuuccucccccuaaauaaugcauuacaaaguggaaaugcaaauuuccugugcaagcucuaaguagcaggugguauuuccuuaauauauuguuuuugaccuuuggggaaauugguauuacgagcugacuuuggaaaauuaaaauagcaucaagguccuacauuuuaaauaaaacaaucgauaucuuaauuuuuaaaaucagacuagauuacgauaccaggaaaagacauacauauuuugcuuuuauguguuaaaguuuuguaauucagggaggacaagaaaagggauauggugcagcugaacuuucuaauucacuaagacaggaaaaaaggaaggaaaaaauguauauuuuuaaguuucaauuuaaaccuuugcuguuaacuaaaugcuuugauaugaucagucauacaaagaguuaaauuaagcauggagcuguucagauggcaaaucugcguugagcugaagguaaaagacaucuguauuuuucauucauuugcucagcagcacuaaauuucaagcuuguuuuuuguucagcaucaaagaaaagguuguuuuaugguuauuggauuuuuuuuaacccacauauuucaugaaagggacucaagucacugggucuuuauauucuuuuaaguuauuuuucugcccacagccauucugcaagccaucuuguugaagagggaaaacauaauuucauucuuuuucucuuccuuugaagaaaaaaauuuaagagauuuaaauaccauucacauuuuggaacuuccuucuuuacccccucccgaaaccaucaucucacaacuauguaaagcaaucaaauguugaaagacuuaagagauuuucacacacauaaauauccuuuauauacuuauaacugcucuacuuaucaagggcaacaagaauggaacccaggagcuaaguuuauagauguuuguguguguguguguguguguguguguguguguguguguuugugugcguaucaauauauccagauguguccaaauguacacgguauuuuuagcauacaaauugcugauuaggcaucuaugucccuuucuccucuaaaaccucuaagugcauggaucuauuaguggaugggcgccagaacgacacagucaaugcaggacugaaauauuuaccaaacccaagaaaugaagguuuguuugaauaguuuaaacuugacaggaggcugagacaagaggaucacuuaagccuaggaguucgaggcuacaggcagcucuaugaucaugccccugcacuccagccugggcgauagagcaagacccugucucucaaaaaaauaaaauaaauuugaguaguguaagcuauguaaacuuggauaauccgguuaccuucauucuuuaauuuuuccauagcauauauuuggcuucaauguccagguuuucgagcacgagaaaucugcauuuucauucuaagaaguauaaaacaagauaguuauacuucauguaagguucacauuaauugucauugcaccucuucuucccagaaggaagagggaagugagagcuggagucaaaacuggguacuguaaaugcucaucuaaucuuggaaucucaggggauauuaauuuuccagauaguugaguuauugccuucaaauuuuaacuucaaauuuuguuaaugugguuguauaugcaaauucagccaaugugcaugauaugugugucucaaacuacauuuaugaauucacuguaauuuuauguuucucuugauaauguuugauuguuaacauaagcaucacuagacuugucaaguggcaaagaucauauucuuucauucuuucuuccuuucucauuucuugaaugcuggcuauaugccaggaacuauguacccacccuggugcuugguguauagaaggcacucaaugaauguauguugaauaaaugaaaaaaauaaaugaauaaacaaguucaauggauaguuaaaaggauaguuucaauucuauaaaccuuaauuuggguguaggaccagucacaguaccaugacagauagagcuauuuggugauaaauaguguggaauguauuuaccaccaggcaguaaugcccugucccuccuugaauaguacuacagauaugagagugcuuuuuuaaauuuuuaaucauuggccacuuucucuagaaauuggagggaaacugugcagcaacaggacucucugggcauugugacaggucuacugucuacaaaauuuguguucaaggcaaaaucuaaagcagccaucuuucaaaaggauguccucacuuuauaaaaaacaauuauugcaaugacuauagccaaugagguuguucuugccacugccauucaaaacaucagugauuuuggcaucuugggcacauaccacagacaccaacuuguuuuuucuuucccacaccucuguccuauauaugcuaaguuuauucuugggcugugacagaggagcauuccuuaucacuuugagaaguucagcuaggauauuuaggggaugaacugcauucuuacgaauucuuuaucaugauuacacuccuaucuaguauaauuugaagauaaaguagggccuuuggagguagacuagcauagguuugaaauguuuccuucauucauuaucagcugccaagaguaaccuggggacgauuccgugcuucguaaacauggucucuucauauacaugcugauauacaggaaagaccuuugcagaacuccaugaaaguuuguuuuuuauuauuguacuaaaaauuacauauaccugaccagacacaaaacuaagcuguaaguuuucuuuaaaccuccuuaauauuuuguccuuuaagcauaagcgauguugcaaagcaccccuuuaauuuauccuguguaaacaaucacuauagucugcaaaauagauugcauuucuuaugaaauccacuuuguaauaacauuuuguauacagaaugaugcauucagugaaugagguaauuaaugcuaaaggauaaaaagauuauuuaaaaaauuuaccaaacuauaccuugcuuccucaguagcuaugcauagguaagucuguuauucugaaauuaugguugacugaaagaauaaauauaaaagauagugggagguauccaucaaaaaugucuuuaucuuuuuaaacacugguaugcacucuauaaggaguaagcaacagugacaauuuuucccuaaucacuaaaugauuauuaaccauuuguaagaagaguuaaccuguccuuaauuuguuugaacccauagggccaugaacaaacaccauaauagagugaagaaagcaaugccaacguagaccaauuuuaucacuaauauagaacugcccugggacagaguaugcccagauaugaguucucagaaaaagccacagaacucuucuguaaacuccuauaucaacuauauccuaccuucucuucugccucagcuugcaguagcagaaaaaguuuacauguguuuguauauucacugaacaguagcccucaaagaauagggaauucucacaucuuuucaaaaagagccacuuaaagaaaauacauucuaagugcuuuaauucagauuuaaauggcuacauugcgagauauuauuccauauaauuggaguaauugugaauuuauacagauuuucaacaguggcacugugcaaccauugauaaaauacaggggcuggggggauaaaaccaguauugccuggauccagugacauuuucccaugcucacuuuuuccaguuguguagcaaugaccauauucucuaauaacaucagcauacuuuuaugcuuuggucuuuuuccuuuucauuaggagaauacuggaauucaugcuguagaaugguuccuuuuauaccccagcccacuuguucaacgacauuccugugauuuuacuaucuaauauguuguggcuauaaccagagaaugcaaaaucugucuuccugagagccuuggccucuauguuuucuaccaaaucauaccuccauuuucucuauaaaggcuguugguacacccacaaaugucaucuguuugugaugagcagaacugaggcacuuuuguucugaugcuuacauuuguucacaugaauagaaguuccucacuugaaagugauuugcacauagguugaggaacugugaaugaaaucacucaaccuagaggcuggcauucuucaugcugcuggcuguugauuucuucaucuucucccugaagacccugcaugaguggugaguauccauaaaggcaccaggagacccagacaccucuguggcagccaagcagguguuacccugcaggacuuaagagggaucuuaagagcaagagaaggaaggagugacuucucucaccaguggucagagcagaaggugcagagcagcaaguugcaggugcuggcagugauggcuucugaacugaagagcaaccaaacccucccauguaacccugucaccacagcucaaagggagguuuucuugccccccaguagaagggaacugacagcgccuguauggcuuugcauccugaagauacuguaguuguugcgucuguuggggaagcaucaagaaaauuagauuguuccaacauucaagcucuuccauauuagcuuuguguuccauuugaugucaaacaauagguugaaaaauuagcuuaauucuaagcuuauauguauauagggaauuuuaucaauuauuagcaccauuauaacuuguuaaacagugaacuuauaguugaaugugaucuauuagauggcugcuuaacauuugcucgagaauaaucuauuagucaucuaagcacaaagcagcuauuugaaaauuuguugaguaaaugacaucucuuugacagaaauaucugcauaauugcaguguguuauacaugcucguuauagccuaacuacacgucuguuugaauuuggguuuuucuuuuuuuuuuucugucugcauaacacacaugcagacaucauagugugaauacuuacuguuaugaucuuggagaaaaguguaucugucaacucuuuaacagccuaagcauacuaaagguaguuuguaagcaacacauaacuuugaacauggaaaaauuaaguuugcuuuuaaugaaauucuaauuuuguaacuugcugagaguuauuuuuagagagugguaacuguugaagaaaaagaagcuuuuuuuuucuuucaaauccugaaauguaauugguagucauuaauuaaauuuuauaaaauagauguuccuuucaaaagcaaucucaaacaauaguacauuuuaaagucuggaucucuuucccagcagcccaggguguuuugaagauaggagaacaagggaaguacuuuaagcuguaaagucuugcaggguagcaguuaagugcuuaaggcacugcauucuugaugcagcguccuguuacaguaauauuaugaaaaaaagcuacagggaauucucauacaugucuaauacauauagcuuuaauguucacauggcuggacccauucacaaauggaaucugugggucagauguaguuugcaagccacuauuauuaagcuguuuuccuuuuacuauuaaguaauguuguuccuuguuaauauuaugaaugcguguguucuuugcucucucuguaaaucuuuuguuccauucauuuuuuuuuuuuuuggccuuacaagaauguggggggaggauaucccuauccacaaaucaaguacuuuaaauagccaggcuagagcugaaugaaggaaaucagucuagauaacaucuuugugaaauguaugccuaugaacucugcgucacacaauacaaaggaaauugccauuguccugcacaaguuaggugaacaaagcacauaaaaaauccuguucugguugccauacauauuccugugcagcugaaacuagaauuccaaacgccacagaaacggccaggcuuaagugacuaacuugcaaaucagagagugcagguuuuacauugauaauacagagagaccuguaaucauucaucacagugguacuacauuuauugauacugagcacugcaaaucauaaacaauaaggauuacaugaccacugcugcuacggugacuacuacugccaucaccgccacccucccuagugcuauugaauaaugcuuauuaaguucuuucagccagcaacugugcuauguacuuuagugucauucaucauauuuaaucaccccagcaacccaaugaggaauccacuuuauagaauuaaggaaauugaaguuuaaauugcuaccaggucacacagcuuacgcauaccuggucucauacuugaucucagaggucuuucuggccccaaagcccuguucuucccccacuaucuugaacuuccuuucccuguaugugaagggaauggaacucaccagguaccaagaugucaccuccuaacccuuacaaagcccagugaguuauuuggaggagaauuuuucccaaggccaaaaagcugcccguguaauacuccaaaguaacuuccauauccuggaaagagcaacuacaaucaaagauagcaccuuacaaacauccuucuuuuauuuaaaaaaauuaauuuuuuuuuaaaagcuaccaccaccaacaguucuucccaagaucagagauaccugcacaucuggcaauaagcccagacauaccaaacuguguauuaucuagagccagggacuugaauaccacugcaucugcagagagacaagcaucucauuucaauagacaacuuguuccuagagugggauacuccccugcugaacugacagggagccggaagagcggcauugaacaaagagaauaguuaugacugggcagcagacggccccaagcacaaccccagguucugcucuucuucaacuuaaccaagcagaacugcaguugacucccauuaaaagucaguagacauuuagucggcuuccagaaugugggcagaagcucauguuaguuauuuacuacccaucucuggaauuccuuuuggacaugaccaaugaguuacagcuggucuuuaggcaguauggcacacucauuaacuagcugucaggaacagcuacacccuuugguccacaaaucuggauuugccagaggaaaauuccaaacagaccaggaaagcaaaaaccacugacaccaucuccauaauaacuguaaaacugaaacauacacguucuacaaagagggcuguucuucuaccuccucaggaacaauuugacaaaggcaaacacuuuaugcacuagcccuggacaaacaaugcaaagaaaaaucuugugcagcugauuucagggucaagagggcgcuucuuaccaacccucaaagacaaaccagcacagagaauaguaaaaugugcaaagccaaaccaguugcuacucucuauccauuccccaauuuccuuuguucacagaaagugacccucuccauggcccugggguaaaucugauuuguucaugguggugaugcuggucccauuccccuugcaaagcaggucuggccuguuaaaaagggccaugaaaucugcagggacugucggaagagacucuccugcuggaccuugacauuucuggaagugccacuaugaauggacacugcaaauggcuguacccauuuuuugacucugaaggaaauagacugagaauaaaugucaacuggaagagcagaaagaaagaaucugaagcuccgacauuucuugaccuacugaauuuaccaacuuuaaaugugcaucaucuccaggcuuuuuguuauguuaaguaaauaauauccuuauuauuaaaucaguuugaguugggguucacuguuauacccaaaagcauacaguaggaauuaucuuuggugggcuauuugagacucaucagaauucuuuaucuacagucuuacaaauugguuggauuuccauuaccuccuuacauacacugaucagcaggaaauacagggagaucaaauuauauuuaauaugucuuuuaaaauacacucauuuucuucuauccacuuuuggaacuccaaaaaaguaacucucucaugcuaacaacucccuuauuagagaaaagaauuguagguguguaagcauuguuuucccaugacaacguuuuuuuuuaauuauuuauuuauuuagagacagggucucacuuugucacccaggcuggagugcaguggcacgauuacagcucauggcagccucgaccuccccaggcucaggugauccuacuaccucagccuccugaguaguugagacuacuacuaucaaauggguagcauguaccaucacacccggcugauuuuuguacuuuuuuuuagagauagaguuugccauguugcccaugccggccucgaacuccuagguucaagccauccucucaccucauccucccaagcaagucacugggccccccaaaucuaagagucauguccaggaaucagcauuucuaacaagcacucuuuuaugagauauauggaagguaugacucagcgcuugaggaagaagagcuacaagaggaagaggacuucuuccaggcaaugagaggcuuagaaauuaguuggaaaccuuuuuugaauauuuacuucuuccagaagacuagaaacauaguagggacugagugagucagguagauggccaauuucccugcuuugggaagauucucccugaaauuuuccauugguguuaugcucugcucaauguuuguaaacacagcuucucugauacuggagcaugaagcagugugucgguagcuuugacuaguaaugugucuuaauguaaauauguauaaauauuauauguacacacacacaugcacacauacaagcuuuuuuuuuuucuuuuugagaccgagucucgcucugucacccaggcuagagcacaguggcgugaucucggcucacugcaaccuccacuucccagagucaagcuauucuuuugccucagccuccugagcagcugugaauacaggcacccaccaccacaccuggcuaauuuuuguacuuuuaguagagaugggguuucaccauguuggccaggcuggucuugaacuccugaccucaggugaucccccugccuuggccucccaaagugcugggauuauaggugugagacaccacgcccggccacauacaagcuuuaaaugaagucuuuuaaaugacuuccucuguauuuauguaucauaaguaaaaaauaaugucauggaugguaacauucuacagaaaugaacacaugcacgggagcaccagccagggaacacagagaccauacuggacaagggauuaaaggcaagagacguggagauuucuucaguagaaagccauguggaugggaaggggagagaugugauuauguagaugggccuacaucauuaugggaaagacucguauggcaucuguauggggaacaagcauuuuuauucuucuccauauuuuggucacagacaauaacacauaauacaugagauuguaaaguccagagguacaggaacugugccuguauauuuucuauaucauagauaccacagaauuuauagcuaacauuuguaacauaaucaaauauuauagcaggugauaaacaagagagaaaaaaaaacaaaaauaagucauuaacauuuaucacggauauuuuagccuucauagccuuaacugaauuucuuuucuauagaguuuucaagaggaauaauagaaauaaaagauuaaagaaaguauagauagauagauauagcuauaaauaagaauagcaggauaggauuucuacuuuuauagaaaucuagugagaaacaagaugcucuuuauauuucuaaaacaucuugaacuuuuugaugagaaaacuuuuuucagagcaaagcuguuacuauaaaaauaguauucuagugcugauuuguccuuuaaauauauuagaaacauucuuuugaacuaagaucuuuuaaauuguuauauuaaaaugcaguuuuucuccuuauuuggucauuuuucuucuuagugaaaucauaguccaaggaagcuagauuuuuauuauguuuuuaaaaacagaugcuauuuuuauagauaaaagaggaugguugccuauaacacugauuuucuucguaaaaaaaauaagaagcacagaauaugcugaauaauugcccaaaauacuuuucuggggcaguguagaauagugagaagggaaaaagauguggagcuauacaaccuggguggguguuauaguuucauuauaugcuggccuugcaauguuuugcaagucaauuacugucuuuuggauuuagcuucugcaugcaugaaucugaauggcuauacuucuguacaugguuguuguaaggguuaaaaucagucagugcacuuuuaaaucacguuacaaacuaugugucacuguuaugugacacauacaaauuaugcauuaucaucauaugaucgauaucaacaaaaugaaaacucgugucaucucaucuugaaaugaaagaauguuugauuccaugaaugugaucgugaagccgaguucagagagacauuucuggaauauucuauacaaugcuaaacaaagauaagcaguuuuuaaguuaacggaaugcugaacccagaaucauccauuuuagggaaguugagcugaguaagguaguucaagacaguugccugaagcuccacuuagguuugagauggaguagauucggaagacaagacgaaugaaguauuugauuuucuaaaaaagggaauggagacauuuuaauuuacagcuucugaggaaaggucaucaauccagagaagaccgugaaggaagguccaggaagaagguauccucuggaaaggccagggugucagggccacuguggaagugugggcauguagcagaaagaacucacuucacaacuguuuaaaaacguuaaggauauaagcuaauguucgggaauaguuaauguuucucggagugaauauuaagcuuccuccaagaaaaacaacucaacuccuaaagucagcccuaaacuagugccaagaaaauagugcuaaauuaggcuucuaggagagauaugacucaguuaaguaucauagagcacucaacccauaaacuauccauuuguaguccuugagaacauaagagauuacaaauaaauguacugacucuuuccuuaaggaaaagaaaugccuaaaaucaugauucagcuuuuuaaauucaguuuccauguguaacuguuauagcugcugggaaauacuugauagucaaaucauuuuguaaaaccauuuccaaauguuuagucuaagauugggcaaauguucuuggaaccaaauaaauuuucugaguauugauucuaaaucucuuuagucagaaugaaaguacuaagaacuguuuuaaaaaucauauuuuucuguaagcuuaugggcaagcauacaagaaaagauauacauguuacaugucaaauuguguguaucuaguucaaguccugauccgauuucauauaaucucuaucugaauaauuggccaaaugucaagaagaugcauaucuuaaagggacuuucaaguauauugccaacgugauuggaguauuaacaacaaauuuggauauuaauucuugguaaucuccaauagcaucuaauuucauuuccauuauuucauagaugccuccuuuucaucuaauauugagcauuaauuagucuuuauuuggcuggaguuaacauuagcuaaaguuugaacuuaggcuauagcaucugugcauacauguuugauuugugaaaacccagcagcauggcaguucaaauauuuauucauuuuccugugcuggcucuuaagcacaugugcauaugcaaagugaccuagcuuugugaauggucauacacagagaaaaagaaauacauauagaauaaauaauuugggccuuaaaaaauauguauauauguguguguguguauacauauauauguauagcguuccuuuuuugaaaacuuguagcauaaggaaauaggacugaaacauucauuauuuucuaugaaguaacauuaaucucacaauuuucacuccacuuuuugacuaaggguggauuuuuccccuaaaaucuuagagaaucauaaaaaaugagaugaaaagucaacuucugagacuguguauuccuuuaccccaccugugugcgacuguuuacuucagacugcuuuauguuccucagagcacaaccaucuccuguaaaacaaaaaugccuauuaaacugcuauaacucgggagcacaccggagcauccccuuaacacuaaccaugguuugacaacacuauccccaaaccacaucuuuugcuuucuaauuuguuaagcuuaacuguaaucuuuaacuuuccaaagugaaggcaaagaaauuuucuuaauguauuucuuugugauagggaaaaagugauacuuuucuucuacuucgucuucaaauuucuucuggaauuuuuuuucagugaccuuaucucuacuuuuucauuuucccuauuauaaagaaaauagucaucucuucuuucauacauuuaucuuuuccauauuugaugagcacgccuccccgcacuuaagaaaacauuguaggaaaaaaauauuaaucuaaaauuguacauuguacucuaauaucuguuuuucauuugucucccccauuagacucuaggcuucuugaaagauuucuucuuuguuuucuacacccaguuccugccugucauauaguucaaauaucaauuaguauucgaugagccaaugaaccacuucaucaggucagaauccagaaggauacauuuugaaacuaaucaugacacugugauuuuuaaagggcuucccauugaucuuuucacuccauuccaaaggugucugaaaggcaccagagggaaggcaaaaacuccaaaguaucagccccccagucuguucucaugagagcugcuauggcucauugccacacauacgcagucugauguuaaucaacacuaacuagagcagcuuguggcuauucucauccuugagcagaugaaacaaggccagcagcagugagggcacuuugcuauaauaauccaauaaauacuuuugaaaugaugcuuacuuuugucuuuugcauuaaagucuaagcgcaaagccaaguagaauagaaaauaaagaacacuuccccucuuccacaauaccaagcagaaauuccagagauuuugccaaaacucccccauagauuuaucgcuucuuaggagacuuuguacagagaacuacaaaaucuccuuugcaccauaagggccagauguuacuguugaauuguaaccacccauagcuacauguguacacacauuucacagucaucucuaaaugcacacaggaggcacaaugaauggaaguuaagaccuaaccuaggcuuuuucuagguucagagaaaacccugacuagcuacuccugguagaugguuucuccucuuuaccaaagccucccaucacuagggggcagguucauucccaacuuaggaagcacuaaaacagaaaagcuuucaaccccagaaaagugguaccuagaggugugauuuguauagcuagcuguagcugagucucauccucacaauguugcaucaacauuugaucugaaauaaauccuucaaacuucagauauaucauauuccuaucuaauuaucaaaauacauuccuuagguacauuaaaacuuuuugaucacuuacuauuguagaauaccucaaacugaacuccccuauaucugaucaauaccugaguugaccauuaauuuuaaauuuaauucaaagugacaguuuucauucuagaccuuccuuggauagccacagagauguguuauguacaaauuauuucagucauccaguuucaaugaagagguagaguucagguggauuuggaguggguaugagaaucuagccagauggccacaaagacaguccuggugcucuggaagaacaaccacagcauaagcaagaaacuggaacaccacaccugguauaggccaaucccucuuuucaccacaaucuggcagucuuugguaaaauaaguguaaggggaaggauccaggcuggagaggagugagcagaaaaauugaguacaggaucucagaagguacaaaaagcuacgcagaagguacaaaaaucuguugccuaauacagccuaaugacaagucacaaaaauuaccuuacugaauuagaaagaccuuaucuugauuguaugggauuaaaccauaugaaauugcugauaauugauugguucugaccuacaaaaaugccaguucagcuagcucaaccugauaguaugagucacacggggugaaugcuaugaagacgcucugccuccaccuauccuggugauacaggucugcaggaggguuugcaucuagaaaucagagauuuuuguuuuuuaagagucagagucuugcuauguugcccauauuggaaugcagugacuacucacaggugcgaucauagcacacugcagccucgaacuucuggacucgaguccucuugccucagucucccaaguagcugggacuaaaagcaugugccaacaugcuuagcccuaagauuuuuuuuuuuuuacuuaaccuccccuggagcuccaguuuuucguugaggggccucaggggcauccugggagggcagagauggauuggaguggaggccacgugaaugagucucagaaauaccauuuugucugcuuucuguuguaggguuccacauaagaucuaacauaaaaggugugggggagguucuuaugcuuuaaaaaaaaaaaaaaugauucaaagccuccaaagccugaaguucauuuuuugaaaagugacccaaacacaaaucuugacauucuggaauauugaaguuuuaaaacuaaauccggagggccaugaacaaguaugucgaucacauaauuucgugaaaggcaaauucuugauaauggucauccuccuucagccagguaaaugucaaauucaaagaaaauauauucaggacagcacugugaaauuucugaggauaagagcauauuucacagcacauaaaugaaaguggaucucggugaauguucuauacagagagaaagguuguguuuugaaccuuuaaauaacuuuggacaaagggugaagaaggauauuguucacaccacaagucaaaagccacucccaucaaugugcccaaccacacaagucgaggcugcugcuggccuugaugguucauggccauuuggaguguuugcagagagauuggaugauuacuugucuagaauuugagcugugucuacuuauucaauauuuuggaacauuuuuucuauaaauaaccggucaauuuugucuagaaaucagugaagugauuaaguaauaggucuauguauuuauugaaauguugucuauaugguagggauauauucaucugucaguucaggcagauaaaacuggcuacacuuguguggauacaaacaugaucauaaaccucacuaguucaaugagcuggcuuacaucuaaaggacucuuuuggaaguugaaaaacaaauaucuuuugcguaaacauuuuuaauaugacaccauauuuaacuuaaaauuuuaaauaacagaugauccugugagaugcuauuuugugaggugugaaaggcccccaaaauguaacucucauugaggaauuuuuauagaaauuaggguuuuuacauucuuuauuaguaaauagcuagaagaucugucuuauacuauauugcuaugagaauggaaaacaaucuacaugaaaaaagauuaugcuauggcacagaaguaccuauugguugaacaauggucauaugauuuuaaaacaaaaucauaugauuuuaaaacaaagugggcaaaaucaccuacuacugccuggcaagaagcaaaggaucuaauuauauuaaaauucugcugcuuacauuaaacccagagacucaucugcacagacagccaugugaagggcuucuuucuuucuaaggucaacuugagacccuuuacauaauaaucauguuugcuuuaccauacauugugccuaauuuuuuuuuaaaaauuaaguuuguaagcucaauucaagccucuuuuuauuuaauguuuagauuaguacuaaaaugaacuacuaaugucuggguccuuuguuagcaaggauuuucuuucaauaccuaccagaaggaguggcuuagcugucugaguaucagcuuuaaaauaccuagacuuccuggaaccauagauuguauucuuaggagggcugaggaacuucuuaauuauucugaaauagguggaauggcagaccauuuccuacacaagugucucucuacaaaaucuuaaaaauccaaauacucuguggauuuuaaaaauucaguaacuuuuuuucuuccauuuggagaaauguucauuugcuguaugaccucagaaauccaaaaauauguccuuuccuuuugcuuaucuucuacaguuucuuagcauguuguacccuaagcuauuuguauauacuuuaacaaugauauuuauuugcuuaagcauuauacuuucaauuguggcugagcuaguccauucuaagggcuagacugcagagaacuacucacugaaauccaugugguuagaaagagcccuuuuaagcuucacgugguauguucaacucauggggucuuugaauucucaccacuuuuuuuuuuuuuugaggcagagucuugcuccgucacccaggcgggagugcaauggugugaucauagcuuacugcagccauaaccuccuaggcucaagcaauccucccaccucagucucccgaguagcugggaguacaggcaugcgccacuauaccuggcuaauuauuuuuaauagagaugaagucuugcuagguugcccaagcuggucucgaacucgugagcucaaacaauccucucaaagugcugagauuaccggcaugagccaccacacccggccacaguuucguuuuaacaucuguuaauccaaaaaauuucuucaaaguccuuuggugauuuugucaaugcugcuauugauguuuuguucugggaggaagcucucuuucaccccauuguauuuuagaaguuucaaugcaaccauggaaugaggauuuucauuacaagcuuuuugaaaggugcaauagucucaacauaaugaacucaaaaucucagugcauugaaggguuugcaugccaaguugaccaagugccuaaacuguauaaacucccuaugugcacacuuagaauuggaucaucagauuugucuaaacaacuugaaaggcuuugcuaucuguucacugaacagucauuaugauguacacaccuuuaagagggacucagccccuccacaacugauaaugaaggaagaaucuccaagugaggugaggcagcuggacuuugcaggucugacucuuguccccugcgauucacuuuucaucagcaaccuggaggaaucagaacuaggcccugcugaacaaucuggagaugaaaaucaaagccgggaaguacagcuucuccuggauuggaucucgauuugacuuuuuucuuuuuucuuuuuuucaaggaacagacuggguuucuucagagcauuauaucagggauuaagagaaucaguagacucggguuguuuugguuuuagaaaaagaucucagacgauuauuuaaauucccuaugccuugguuucccugugagaaaaugaaaacaguaaggccuggacccucccaguaacaaaggggcagauguuaaaaauauaaaggauucuagcuuucauauaggaaaugcaugugcaaaauauuacucauuuauuaaggugcaugaaaauuuacuguuaacaacacagaagacuaauauguaucauugauguuauucaggucuuauaaaacucuaguggccagucguguuuuuaaugccaagaaccccgaggagcaacugguuucuaagaaucaacacuuaguucugagccgagagaugccccaaggaagauaagagacuuacaguuuguuuggcguccaaaaagcuuuccagacagcaguuuguuuccuuucccuuuuuaugaauggugguaguauuaugcuucagucugcguuuucuaccaaagccauucauaaaaauaaaaacaaaacaaaauaacaacaacaaaaacuuucucggcacagucuggagccauugggugccagaggcugggaaaacauccuggcagccauaaccccaaccaacauugaaaguauucaagggucuguuuguuugguggucugaaaaguaugaagugcugugucugaggguagcugguagaaguuccgugacacggacuaggccgggagccagggcuggcagagauucagacauugucuuuccccucauugaagugucaggaccuaauucauggaaaauugggugagcuggcagcucuuucagaggauuucauugagcugcagugugcaggagucacaugaaugcgggagccucugccaaaaaaggagggggauuucugagcaguaggaaccagucagccugcaagaauguauguggauuugaaacgguuugggaguaaacauguguacagguguaaucaacagggaaaaaugggaggaagaugagugcucucuucuuccaaaugacccuuuggaaaugaauccucuauuagcccacgcuuuuguguccuaagaggcaagaaguccucaucguucuugguucgauuuucccuggagaaaacaucaucucaaaacuugggcuuuugugaugacgucaucuuuacugugauuuaaagucaaauggaagaacgucuuuuccuuugagcaaaaguaccuugccauuuauuuuauuuuuauucuguccaucuaaaaaaaaaaagcucuaaugauuuuuauauggaauuuuuaauguaccagcaauaaaccacuguaccacugagaggaacucugagaggaaggggcucucagaaugaaugaacaggggcuagugaauagugaacguauccuaagugcuguuauuugggagaacuggugcaagaaagcaugucgcuauccacaucagaguaccucagguguacucacaaaucucagcgauguguagauagaauaauacaugccuauauucagacaugagagugaggacuggaagcaaauaauccaucgaaaagcucaggcuucaaauccaucuuuuauaaugccaaagaaauaagaaguauucucuaauacucgauuggaaaguuaggcaggcagaaaaacauucccucggauguuucacucaaaagaggagaguuuugcucuacacauacaauagauacagauauaacacaauauaacacaauauucuucccaugauaccacgaagaaacugaacaaacucacagaauuauuugcaaaucauaagggacuugaaugcaaaacauuaaaagaacucuuacaacuuuguuaugaagagauagcaaauuuuuuuuaaaugggcaaaggauuuaaauaaacauuucuucccaggagacauauaaauggccaauaagcacaugaaaagaugcucaacaucauuaguugugagagaaguucaaauugaaacagcaaugauguuuaacuucacauccacuuggaugucuacaagcaaaaagacaggcaauaacaagcauuggcauguauacggagcaauuggaacuccagauucauugcuggugggacggacugcaaaaugguacagcugcuuuagaaagcugucuggcagcuccucaaaaagugaaacaaagaauuacaauaugaaccagcgauuccacucccagguacauacccaagaaugaaaacauguucgcacgaaaacguguauauaaauguucauaguagcauuauucauaauagccaaaggguggaaacaccccagauguccaccaacuaaugaauggauagguaaaaugugguauacccauacaagggaaaauuauuuagcaugaaaaggaaugaacugcugaugcuaccacauggaugacccuagaaaacccuaggccagugaaagaagccacacacaaaagacucuacauauauaguaugauuccacuuacaugaaaugucaggauagguaaauucauagagacagaaaguagauucauggucacuuaggcaugggagguggcuagggacguggaggguaguggggaguaaccacuaauggguacaagauuucuuuuagaggagaugaaaguguucuaaauuagacuguggugaugguugcacaacccucugaauauacuaaaauauacuuuaaaugagugaauuaugugguauguaaauuaugucucagugaagguguuuuaaaaaaauaaaauauuaacaaauuagguaccuucacuccucaguuuugugauauauaggcuaaaaacaaagugaaucaaacaguuaaguuucuuucaagcuaguuggcuuguaugccagaauuuaauugggaauuggaauuguuuucacugagauaaccuauguuguauuuccuuaauauagagagaucaugaauagacauuuuuguuuuuuuugagauaggguguugcucugucacccaggcuggagugcaguggcaugaucacggcucacugcagccuugaccuuucuuggcccaggugauccuuccauuuaggccucugaguagcugggacuacaguugcaacgccaccacacccuguuaauuuuuguauguuuguagagagaggguuucaccauguugcccagccuggucuacaacuccugggcucaagccauccguccgccucugccucccaaagcgcugggauuauaagcgugagccaccaugccuggccaaguauaaacacuuuuaacauuggauauaccaguugaacuuuauacuuuccucuuuccuuugcagacaaguaucuguauuuaaaauauguacaccuaauuuuuucuauaauguauauuuucuuuuaaaauauaucuuuuucuuuuccuccuuagccacaacaaguuguucagaagaagccugcucagguaagacauagucauuaauuuuuuucucccaauuaauauaaaaagugaaauauguacugaaaaauguccccaaacuaaaccuuauuucgcauuuucuuacuuuugguuaucguccugcaguauuccugaaaauguguuguagccuucaaaguuaggaauauauagucugcaaucguaccaugaaaaccucccaaaauguaaggucuuaaguguacaaagcaaauauaaauucuuuuaaaaauaaaacuauuuuauuacauugccucauauguaaaacaaauauuuaaucuuauccuauauuuuaccaauucuuaaacaucaaauuuuguccuuccaacugacugucuauauucuguugacaccagacuuauauuuaaugauucaugacuggaaacauauuucuucauugaacaauuucauaauauuugaugaucccaaaacacuccaaagaaugcuagaauacuuggaaauuaaguuauacuaacgugcagacugaugcauucuuagaucuuauuuaaauaacugaaucacagucucugaaguuuuuggcaacaucaaauuggaaaauagcucuacgucucuugccccauauuccuggagcaccuuguccucacuauaaucuguacauagaaacauuaaaaaaacauauuuauugaggaagcauaucuugaagaaaacaaaacugaaguauaaauuaaccaggauugcuaauaaugugagccaguauuaaaguauaagaacguccugcuguucucuucccuucuguauguaaauagucauuggagauccaggugguaucaugcugaaccugcuaaaauaaguaguaagcagugucaugagcuaucaaauuaaguagaacucuuucauguaauuuuaaguauccaugaaauuuuuuucccuagaagucuuuacaaaucuaccuugcauccuguuuucuuaggucaauguugccuugccugggaaggaccacccgggcaaucuuauauaucuacuguucucuaaaaaugccacuuagaagagaauugaaacuuccaaacacaugaaaggauccaaggaaagugucuucaaacaauuacauaugagcuuuaaguggaauaaaaacagaguuaccaugaaaaaaaucauuuucauugcugcucccauaccuaaaagcuaagagugggagaggggugcuaaaaaaaacccaguguuugugcgucuuuaagcaauauuuaaaaauauauacauauaaacaaaaacuugacauuuucauuaggagaacccaaauauauuuagccucucauccuuuaacuguacaaaaaucaagagaaaguaaauugauaauucugugcauuugagucaaaggaugaggcagaguucacauuugcaucacaggcugugaacuauagauuaaucacuuuaugugguuuguuaauauugauucagcccuugugcuuagugucauagggaagaugagucaaacaaagaaaaacagucacugcaucugagaaauguauuuauauguauaugccuguguccuauccagugguaugcuggaaccagcccuugugagcaaauagugaacaucucuucugaauucuguguucagugaugucaaguagguagcuugaaauccacuauggugggaguauuuacaccauggaaagugacaaauacuacaaaucaggacuuuuuuuuuuccugaggagcaaguaguuaaacauuuaccuccccagcauggccccacccuucagcgauucuguuuauuuggucuggagauccaucauauuuuuuaugaacucccuaagugaguuuaauaugcaacuagagaugaagacacuccaugaaaacacaugagaagaugucugaacauuuguugagcaaaugaccacagaaugucaauguguaugggacacacgggggauacagaugaaugaguggaaugccucagguuaucaaggggaugauaagacuggaauuuucuuguuuuguuugauuuuguuguuguugaguugcagaagggaaaacugaaacauaaauuaagggaaagaaauuacagaugagaugaauggcauauagaaagguagagaggcaagaacaaauacaucauagguggagauuauuaauauggcuagaacugauugcaaguuggacauuaauacaucaagaaauaauauaagugaaaucacaguuguuuuucccaagagaauucagaaucucaaagaagccacaaguggauugaguugaucuucaaggaucaaucuggcuaucuuacagacccuguuccagauuugcccuuuauaggagaguucagacucagaauuauaaaaaagaacaugagcucauugggcuaccuaauuuauauuguguaaugacacagugaugaauuauauaaacaugaaaacuacgugaaaguucguggaggauaauguaaauuuuacacuacauucaaaagaaucucuuccuuuuccaucuguuucuuucaaaauacccucccagauggcuuucccaugaggcaaucuggauuaacucagccucauauccuuccuucaacagcacuuugagggguuacauucagaaucgcuuuugaggugguaaaaauuuuagcacaacuaaauauuuuacaucuaaagaaaagggcucagcaguguguaaacagaccuacguuuuucuuucuggccccaucacugggcuaauuaauuucucuuugcucuauuuauccaucuaggaaaugggauaauaauaaugccuuuucccuuacucccaagaacauuacaagagaugcauaauuauauaaauuccagguagcauuauuacauucugacuuauuuuugacuguuaaguuuuucauuuccagagauuuauagucucaaaaauucuagaauccugauuuauuccaaaguacuuccucuuugacgucaaguguuuucauugaauguuuuuuaaggcaggaauuuuuuagcuggaggaaauuuucuaguaauugcuccauccuacuguuagggcuaaagcauucagaaucaucuuccuagcauuuaugucacacguauacagaauuacaaaggcucuguggugaaguauccucauacugcccaaugcugaagucuccucagaacuucaagaauggcccuuguugaaccugggguacaaagcagcagaguuuauucugaggagacaaauucagaauuaugauaaaucucagcaccugcauacgcacuuguguuuguguauacaaguacaugcaucuagagagaaaugaaaagugaaggaccacccuguugcagggguuuguguuugcgaaauccaccaggugucaucagcugcaaacaucaagugugucccauaauccuaaugggagaguuaauagucucuuaaaaaucuaaaggggaaaaucuguaauauguacguuaacuuuuuucuaaaauuccaaaaccaaugaaaacagcuuacaaaauaacucuacuauauuuccacuucaagugauaaacaauaaauugaaaucagcuaauuacaaauaaauagaaaugaggcugggugcaguggcucacaccuguaaucccaacacuuugggaggucaggaguucgagaccagccuggccaacauggugaagccccaucucuacuaaauacacaaaaauuagccgggcguggcggcggccaucuauaaucccagcuacucgggaggcugaggcaggagaaucacuugaaccugguuggcgggggaggguugccgugagcagagauugugccacugcaccccagccugggugacagcgagacuccaucucaaaagaaagaaagaaagaaauagaaagcagcucguuuuuuagcaauuugagcaguugaauucucagucauaugaauuacauucuucaguaggaaauggugguagguuuuucuuuuucuuuuuuuaaaaaaagaaacaccauaaaaguaccagauuauuauuauuauuagagggugcuuuguuacucaaguuuuuacuuugauaaaaauaagugucucuccaacugagaugucuaaaaaaguuucgcuaguuuaucagguauuugaucguuuauugcuauuucccuuuuaaggcuuuaaucugagacuugaagggacucccuaaauguaauucagacauuuuucucucaccuuucuucuacccaaagggaaaacagguuuuuaaaauccuaacagcucuccacccuuucaauccacuuuccccauuguuguacagcccuggcaaacgaugccucuggcaauuaggacagguauaaaccugcuccuuuucaauuucccaaugagagaauugcaaaguuuucaguuucuaaaagacuggaaacaaagcuuucuguuucaaaaaaagaguuuuuacuugcaaguaacaucuucuguggguggugugcacccgggcaaagaaaucucaguaagccuugauuaucacgggauuucuucccccucaaaauaaaauguugaauguuuuuacagagacuucaagggcaguuuuaaggauguuuauauuucagacaaccuaaacauuguuuggagcaaaaugagagauuucauuuugggacaagcaaguugaugaauugcagucagcaucucguucucaaagaaggcauuuuuacugggggcuuuuagucuagacauacaaagagggaaggaggaaaggggaaagcauucucacucuaacacucgucuuuuacaugguaccuuggccagugcaguaaauaguucauaauaaaucagacuuacaaauacucacucgucuacucacucaaggagcauaaugauuuauacugccuaagucacaaagauuaccgauguauuuauuuucuugcuuaugcacuuucaagcuaguaaaacaucuugugggccaguaaauguuuaguaccaacuggcaaaacaugaagaaucauaucaaagguugcccuaaguugcacgguuuuguuguauaggaaauacuuuuugacuuaaccucugaccucugacaucaccaaggucaagggaaaaggagagagcaaaguagaaaccaagguuuaacccuuaauaaaguagcucaaggacauagaagcacagggaaauuggagggcagaggaagcguaucaaaaugauuauuaacuguaaacagaugaaguaauuagcuuagcuaacaguuguaauacaggaauauuggcaggaugaagucagcgguucuuggcaggaaauguuuuauagagaugacaacuucuaacagaagugaaagaacaucaaucaauuuagggcaacuuauaaaacuccaaaaagcaaaauuuaguguuucuggacuugacaaauuugcugugagaguuuuuuuuuuaaguaugacuguuucuguguggggaagucuguggauuaggcucaaaacaaaauggcaguggcugccugcauuuccucuucauauugcagaauuuuccucuacauuuugauguguacuggauaaaaaccaauuguuuacucaauauauaaucuuucuucuuacucuccaaacuugcugacccaaauuaauguggaacaaauagcaacuggcuuuaaaaccuggucuuucuaagaaaauccuuaaugguugcauagaaauauguugcauugccucagacacuuacauucaggaaauguuugcuggacacucagaugucuacagagaaauuguuaacuuacuguuauugauauuuuuauaaucuuacucaaaagucauaacucaggauaaugaaaaauguuuggugcaauaaugauuaaaauccacaaauauucuguucccuggccgcaaauacaacaccuaugcaaaauuuuacacaucuacaaaacaaagggaaaagguuuuuccuagucuaugccauuaauaagcacaucuggaauauaacccuuaagcagucuuuaaucauaauuuaaagcuacuuugcauaaaaauaagaacauuccacaacagcuguggaaacauugaaauaaauuuucuucuucugggccgggcacgguggcucaugccuguuaucccagcacuuugggaggcccaggcagaaguauuccuugagcccaggaguuugagaccagccugagcaacauagugagaccccaucucuauuuaaaaaaaaaaaaaauuaccuucuuuugaauacuuuguuuaugcaaaaauccuuuugcuuucuuuagcuauuuuuuuaaaugcaguguuccugcaguaagaauugaaccuggcauggaaaacugaucaaaccgguaguccucagaaaucaucacuccugaaacuugcaauuaguuuauaccuaaaaugauuucccuauuugaaaaaugugccuaccauuuccagauuuuaaaaaaauggcccuuuaucccagaaaggagaaauucauuguaucccagagaccagcauuacuucuguugcaguauuuucagugauggaacucuguugaggcuacagacaagaaaagcaggagagcauuuuaggaaucuaagauuuuuuauuuuacuuuccucuggggaccuucuuuaauaguuuuuuucuuucuuaagaaccuauccuugaaucauagguaaagaaauaaucacagaaugaguaacugacauuaauaaucacagcuucacacuauagucuuacuggauuuuuacguuuuucaggguuuccccaagugguggucacauuucuuacacaacucugcaguguagauagacauguauagucauuacugggcugacacggugggacugagaccugcuagugccgugguuggcaucuaugauuagugagguccaagaucaaccuucuuuacauuaaacaugcccuagcaagaccuucaacccaacuuuauuaagcugaugcuaacgcacacaaagaaguccuaacaauucuauguuuuuauauacauaaugcaaaaauaaagacaagaucagguacaauugcugucaauaucucaacuuauugucuccuuuugaaaaacauaauucccgccuagcauuuccaccagaaucccuugcucuugccagguuauauuguuuauauauguuccauuuaacauguuuuuuaaaaaucugcuguagaguuuuccuaguuggaggaaauaaucacuuuccauuaaguuaaacagucccgauaaauuuuaaaugaaaauaucugacagagaaauagaaaaacucagccuuguggucuugccggucacuuagcuacagauggaacuugaaaaacugguuccuggucauugcugcugaagagagcccuuuauuucuguugugacaggacugacucaagauacucaugaacguggaaaacuccuaaaugugucauucugaguuccugagaaguugaacauacacagaugacaaaaaagaaugccauuuagccauaacuacccuuucuagauuaccaaguauuuguagguuuauuggcaagauagcuuaaauuacguauguauuucuggccugcaacaucauguaauagaagaguugcagaauucuuugcaguuaagaaaaaaaaaaaaagauaaggacuuauuaaagcugacauggacugugauuuuugcacuccguaccacacacaaaggagggcaucguggugacaccaccccuguguuuguauuucuugguuccauuuagaauucacuggccucuucuacugcagaccugcuguuuagucugcaucuggaaauuaaacccagagcuucagcucuuagcauuaaauauugaacuuucuuccagcacacacccucauccaugccuguauaguaagucugauuaaacucaagacauuuuaaaauuccaucagccuuaggaguuaaguuuggauauugggcugucuuccuccuccuuuuuaaucuauuagaagaaguguacccaaagguauauauaccacaugcaucauguugaaccaaauuaaaagaacagugauaugugcaaacuauauuucuggguuuuaguggaguuuuuuuccaaacuuagcuaaaacaaugaguuacauuuaucaaauuccuuuuuucaugaacaaaagaaaaacuaaggcaaaguaagugcacuuuuccaguaguuauaauaaaaauauaguuuuccaacucugcccaccccuguuccccacucaucaguuuucugccaagaaaccucacauguuucggcccgguaccucacuugucuuuguaaaguagcugcaugauggcugggagcuuuucgguguuuagaggccuuaguggcuggugcucauaaaaaugucaccgugcacuugcacuuugaaaaguccuuucaucugaacauuccugaagccccauuccaacagguaagccuucuugaccaaagaguggcuguuuagccuucccacccugccacuagacccuaaugagaugugugcaacucuuggcuacaguuuucaucuccuuauuacuucaaggcuccucuugggagcuacacaagcucaaagguccuuugaccauuaggugacaaaugagaagcaauuuuuuaaaaacaugucaagguaaaagcuauugucuauaacacacggccaugucuuuuuuucuuuuuuuuucuuuuuauuugagacggagucuugcucugucgcccaggcuggagugcaguggcaccaucucggcucacugcaagcucugcuuccuggguucacagcauucuccugccgcagccucccaaguagcugggacuucaggugcccgccaccacgccuggcuaauuuuuuguauuuuuaguagagaugggguuucaccguguuagccaggauggucucgaucuccugaccucgugauccgccugccuaggccucccaaagugcugggauuacaggcguaagccaccauaccuggccccauccaugucuuuuaaguuauuaaagaugaucgaagcucaggggucccuaccaacuccucaguuacagaaacaggacucuuuggggaugucggagccagcugcuuauucuccaugucaccuguuucuguucccucuuugcaccacagaagcacccuguguuaagucuggccgaaccaugacacuuaggagagcugagaauggguuuuccaaccucauuccugacagggaggauuuuucuucucuucauugaaugcacacuugucguacagaauccgcacauguaaccaaagaccaagucacugggaaggugagagcugagguuugcagaggugggaaaagccaccugccccaccacaucaacccuuugggaaccauuccuuccuuugaaggguggccagccagggcuaugccaagaagagagagcucuccacuaacuagacauuugagaaaaccaucauucugagcaugugagagccacauugccuccaaaccuuuaaugaagugagacuuccacccucugacauccuagucauguucccaguacuaacugauaguuacuaguagaauucuaaggucagcagaaagauacauuaauaaaacaacuauccacauugucuuauccacauugucuuaaggacaguuaaggaaacaauaugaccuaccaccauuuucaucugaauugugucuaaaggguuggaauucaggaguuucagcagcucacaucaagcaaaguuucugggaauguuuugaaaagcugaucacauuccaucuaguacaaggucuuuguuaaguucauggccugaaaauucuguuuccuuccggauuugaaaguaccuugguuuccggauaguauagaaaaaucaaacaguuagaaauugaauaauuacagcacaauccaggagguuugccagcuugacugaguucuaucaauuuuuuaaccguaagaaggaauaaaauauacuugcuggcuuuuaugccguggucuguuucagaguagucaccuaaguccacaccucaugucagaaugagaagugaaucaucuggggacaaacgagguguguaucugccuaacagcuuagugacuuucuggaauuuaaauauuaagugaaaggacagggucacagggcagcugaucuuuggcucgucucucuuucgucugcccauggcuuugaucaugcuacauccuccuuuguggccagggcuccacagagaaucucagggucauggccuguugccuagucaagagguauaaaccugcugcuuaaauaugugaagcccacaguuuggggguugggaguuaaaggggagguagccucauacguuccacuuuucccacaaaacccaaagcagacuaaacaaaaccggugugaaaucucaugacuugaugcugccgugguuauauuuuucaagcuguaauccauucauuuguauguguguuuauucccaggauuuacagcucgcucagucuucggggggaaagagaauauuugaaaccuuuugcaaaggguuugaaguaugcaguggccugugauuaaagcccaggauagaguguguguguguguguguguaugugugugugugugcauucaugugaaugugugagugcccauucuugugggguuuuuuucucccauuugcugcuuuuacgcaaaagcaucacacaugguagcauuuaggagccccuucacagcugaaguguuucaaacacuaaugaauggaaguuuggucauauaaugcagacaagcuuuaaggcaugcuuuacugaaugguguacuguagugaccugggaaaggaagagagguauaaauugugucgguuagccacccagacaaaaugaagccauguggaaaaucaaaucuauuaaaguaugaagacuguuauaagcuguuuuaagcuggccauucuuaaaggggcucggucugcugcaggaguaaauguuuaccucuucccccagaucuuuuucacaugccgucuuaugagacaaugugcagcauuugauaaaaaucauccucucacuaacgacgcuuuuaucggaaauguuuauugucuccgcuuuaccacccauguccugaaagguacugcacauuuguuaaauaagcaaaaggaaagagaacuuugcggcucaagccggcucgcagaaaccccaacaaauuccagagccauaaggaaucagaaaaaggaaaagggaaggaggaguuagauuuauaugaagagggggccuugcaaaaacauauauauuagauuuucucugcuuggcuagcccaccaucaaauguuuggucgaugcggauuaguauugagauugagcaguuaacgccgaacuugggucacugucucaaaaugugcuuuaauaaauacaagggggaggaaauggauuugggaaggcucguugucagcucugccccugcucucacacugccucugcacagugguguaggggucacacacagguguuggcaccaguaccaacccgacccaaauccuggucccacacacccuguaauuuugggcacauuacuugucugugccuugguuuucucagauguaaaacaggaauauuaacagaaggugccuaagcaucugguaagcacucuaaaaauaccagcuauuauuaccaguaucuggaggguggguucauuuauaccuuaagaaaggaucccccuaacucuauuuuucuugugugccgguuuuuaaaacugaugaauggcaugcugucgggaaaaauuuauccauuccuacuuuuuuucuaauuggugaguaagcgugcauugcccugacauucucuggacagcaaacaauugaauuugcugaccagccgccaugaugucaagccuuaagucaacaguggcuaaugaccgcucugggaaaaaacaacaccuugauuccucaauuacgguuuaagaagcccugggaaugagggcucgccagucaucgucauccucuuuugaggcaagcauaaugugcuguggaaacagguuaccucugcacuguuggcaagagcagcccacacaguauaacgauugagcgucauggcugugcccuuuguguguuccaggaggaaacugaagagacauccucacaagagucugccgaagaggacuagggggcgccaacguucgauuucuaccucagcagcaguuggaucuuuugaagggagaagacacugcagugaccacuuauucuguauugccauggucuuuccacuuucaucugggguggggugggguggggugggggaggggggggugggguggggagaaaucacauaaccuuaaaaaggacuauauuaaucaccuucuuuguaaucccuucacagucccagguuuagugaaaaacugcuguaaacacaggggacacagcuuaacaaugcaacuuuuaauuacuguuuucuuuuuucuuaaccuacuaauaguuuguugaucugauaagcaagagugggcgggugagaaaaaccgaauuggguuuagucaaucacugcacugcaugcaaacaagaaacgugucacacuugugacgucgggcauucauauaggaagaacgcgguguguaacacuguguacaccucaaauaccaccccaacccacucccuguagugaauccucuguuuagaacaccaaagauaaggacuagauacuacuuucucuuuuucguauaaucuuguagacacuuacuugaugauuuuuaacuuuuuauuucuaaaugagacgaaaugcugauguauccuuucauucagcuaacaaacuagaaaagguuauguucauuuuucaaaaagggaaguaagcaaacaaauauugccaacucuucuauuuauggauaucacacauaucagcaggaguaauaaauuuacucacagcacuuguuuucaggacaacacuucauuuucaggaaaucuacuuccuacagagccaaaaugccauuuagcaauaaauaacacuugucagccucagagcauuuaaggaaacuagacaaguaaaauuauccucuuuguaauuuaaugaaaagguacaacagaauaaugcaugaugaacucaccuaauuaugaggugggaggagcgaaaucuaaauuucuuuugcuauaguuauacaucaauuuaaaaagcaaaaaaaaaaaaggggggggcaaucucucucugugucuuucucucucucucuuccucucccucucucuuuucauuguguaucaguuuccaugaaagaccugaauaccacuuaccucaaauuaagcauauguguuacuucaaguaauacguuuugacauaagaugguugaccaaggugcuuuucuucggcuugaguucaccaucucuucauucaaacugcacuuuuagccagagaugcaauauauccccacuacucaauacuaccucugaauguuacaacgaauuuacagucuaguacuuauuacaugcugcuauacacaagcaaugcaagaaaaaaacuuacuggguaggugauucuaaucaucugcaguucuuuuuguacacuuaauuacaguuaaagaagcaaucuccuuacuguguuucagcaugacuauguauuuuucuauguuuuuuuaauuaaaaauuuuuaaaauacuuguuucagcuucucugcuagauuucuacauuaacuugaaaauuuuuuaaccaagucgcuccuagguucuuaaggauaauuuuccucaaucacacuacacaucacacaagauuugacuguaauauuuaaauauuacccuccaagucuguaccucaaaugaauucuuuaaggagauggacuaauugacuugcaaagaccuaccuccagacuucaaaaggaaugaacuuguuacuugcagcauucauuuguuuuuucaauguuugaaauaguucaaacugcagcuaacccuagucaaaacuauuuuuguaaaagacauuugauagaaaggaacacguuuuuacauacuuuugcaaaauaaguaaauaauaaauaaaauaaaagccaaccuucaaagaaacuugaagcuuuguaggugagaugcaacaagcccugcuuuugcauaaugcaaucaaaaauauguguuuuuaagauuaguugaauauaagaaaaugcuugacaaauauuuucauguauuuuacacaaaugugauuuuuguaauaugucucaaccagauuuauuuuaaacgcuucuuauguagaguuuuuaugccuuucucuccuagugagugugcugacuuuuuaacaugguauuaucaacugggccaggagguaguuucucaugacggcuuuugucaguauggcuuuuaguacugaagccaaaugaaacucaaaaccaucucucuuccagcugcuucagggagguaguuucaaaggccacauaccucucugagacuggcagaucgcucacuguugugaaucaccaaaggagcuauggagagaauuaaaacucaacauuacuguuaacugugcguuaaauaagcaaauaaacaguggcucauaaaaauaaaagucgcauuccauaucuuuggaugggccuuuuagaaaccucauuggccagcucauaaaauggaagcaauugcucauguuggccaaacauggugcaccgagugauuuccaucucugguaaaguuacacuuuuauuuccuguauguuguacaaucaaaacacacuacuaccucuuaagucccaguauaccucauuuuucauacugaaaaaaaaagcuuguggccaauggaacaguaagaacaucauaaaauuuuuauauauauaguuuauuuuugugggagauaaauuuuauaggacuguucuuugcuguuguuggucgcagcuacauaagacuggacauuuaacuuuucuaccauuucugcaaguuagguauguuugcaggagaaaaguaucaagacguuuaacugcaguugacuuucucccuguuccuuugagugucuucuaacuuuauucuuuguucuuuauguagaauugcugucuaugauuguacuuugaaucgcuugcuuguugaaaauauuucucuaguguauuaucacugucuguucugcacaauaaacauaacagccucugugaucc

SEQ ID NO: 21268 - RNA, 21756 nt, Homo sapiens
augagggcgaacgacgcucugcaggugcugggcuugcuuuucagccuggcccggggcuccgaggugggcaacucucaggcagguaaguggcgcgagagcaccggcgggcucggcaccugggagccggaacccagugcgcgcagccucggaggguaugggcacggucucaggcggcgcgggguugugggugcugcccccgguuugccaggaccaccugggagaggggcggucaggcucggguuaucggcgugguccggccgagggcggcauuccgggacccucacgccacccuucuccagagcgucgccgacccucuaauuggucuccccagaagaggcugaggccgaaacaguaguucacacuucugaggggcccugcagggaggggagcagggaacuucauucuguaaacaggaggugcuuggaggugggggccuuggcgggaagggucucgguuugcucgccaacccccugccccccacccgcgccgauuucagcuaccccuaguuucguuguuuugccgacagggcggagcuacagaagguuggaggggguuguuguucucugguguuggaaaaacaggagcggcaccuccucuuccgugagugagccugcccuggggaggucugagauuaaccagagggccaaguucaggugacaucaggcaggaggcccaacagaggcuggcgcccccuuuccucaguauagcagagcuuaagcaacaucucuuugucaagacccaggucaacacaacucauauuuauugagcaucuacuauacacaaggcccugggccaggagcuguaagggcaaggauguccagccucuggucuuuucucuccccaaccugaggaucaagagggcaccucugcuacuuucuaagccuccugccuuggggaguccuuccugggcucagcuugugccucccgcccccauuuugcuuauugucugacacugucucuaggacccuagacagagccccggauugcucuucuccaguccucccccgacucccaugcuaucugagcccaccccuuuggggugucucugggaccguggacaccugaggacugaaguucuguggaucuccuccccuccccucagaucucagcuugggguuuggcacagccagggccccuuccccagugugggaguggaagaaaccaccugugcuucccucacaguugcugggccuaaauuuagauccugggauuuuuagaugugaacacucccagcugguggagggggguggucuggggacuggcgugggagggagcaguggagugacuguauaacugucccauccagacuccugcaaucuucacccagaaacccaggaguaccagagucuggccacccucccuggggaggcaggaggcaggcaugguugggucucuuuacccuuuaucuggguccugcagccucugggcauccggcccugucucaguccuucuauagccccuuuguccuggcugugaugggggugggggauguuggaggggaggccucugguugaggaggggcuggagauucuggcucuaucccaccccuagugcucucuaccaaaggagggccugugacacugccccucccuaugcucccgguuccuggguacagcagggauuuuuaugauucccuuccccugcccugcuccccaagcugccuagcuccuccccagagguguuguuugugcucccuuccugcccaggcccuuugcccccuguuuguguaauauggacuuuacccucaggguagcagggaacugggcuaccucuaacacuguagccuuccaagcacagacacaaagucugcacaaacacuuaugggcacgugggauagauggggccaccugaaauacuuccugcaaggaaacccaacuauagauuccugagccagcaggaccaauguguacguguucguguguacauuguguguguaugugugugcccacacuacuacuucccugugcagaaagcuuggcuccucccuuaucuggggagaaguguuggcacuauaacuugggaaaggggguauccugccaggaaggggauugggguggggcuguuccagaaaugacuaaccuuccuagucucuuucauuucaacccaaggacccuggaguucccagcuccucuggaacuagcucucuuugcugggacuagccaaccuucauggggagugauaaggagcccuccaaggucaagaagucagacuagggguguauguuauaggagggauuggggccucaccagucucccucccuccauucccacuguugccucccacugagcuaccaccgccucagggaaggguggcuggaacaggugguaucuacccccuacuccccaccccacacauggucuuucccugaaccagaggaaagagacugggguagggcuucagaguccaggacuucccauagcccguuguccaccacauuugcaaagaagagugaacucccaaggcugacaugccauguaccucuagucuaggcucuccccuagugugggugaggauugccauggugaaaggcuuuuucaugaaccucuucuaacaaugaaauuguguggaggcucaauauggggcaucugcuacuaucucucuccagguuccucuguauuugcugaaaaauacucuagggcuggaaagugaugcugagguugcuagaguguguugggaugggggagagagugagaaggaaacccugaguuuaggaaggcggggaggcaacuagcuccuuaucuuucagcuuuaaagacaaagcucccauugacccccccucaccccagcacugccagagcuccccccucuacugaggucacuugucugagcccaaggcuugaggguggaggggagugcugcugaggacggggugucuagggacaggguggggcagccccccuccuggauagaaucgccucauugugggcuggacuguggccccaggcacugcccccacccucugcccccaucccacccucaguagacacaauaggggcuguguacuagucccaaagagauauuuauuccaggaccuagagagaggcaggaugaggguagagaagugagugcccuaguuggagggggagaggaggguaaucaaaguugcggccuuuuccuaacuucucuuuucuagggagagaaacaaauucccugucuuccuucucaguuaaccccuuaguacccaaaagaagcacagaggggucccagguugaaaaaggaaaucuuuucaccuucccauucauggaaugguaaggggauucugagaagagagaaagcucucaggccacuacagcuucugccuaucgcuugugggaggguuggaggcaaaugccaucugauccugucuaauguaacuggaagagggcaaccaagggggugaucuuuggggauggcagaugggcugagaauuuguguccagcccucagccacucuucccucugcuuugaacaguguguccugggacucugaauggccugagugugaccggcgaugcugagaaccaauaccagacacuguacaagcucuacgagaggugugagguggugauggggaaccuugagauugugcucacgggacacaaugccgaccucuccuuccugcagguuagugagcccacccuccuuccucaaccugcuccucuuuauucuccccuagaacccuccuuccuucuucagggcuaccuucugcuggaguucacccuuccuaagacucaggaguuccuaagauucaaaaccguguauuuauggggacaguggcugucaucugggaccuauggucucacuguuguagccagggauauauagggggcagggucaggggcaggugguguucuguggauagugcaaggucagcagggacuagugcagagagaaaccugaggaccaagagguuaccuggggagaugaggaaggggcccuacugguaugaggcacuuugaggagaaagcugccugucuucacucccagaagugacacagcagugugacacagucuacucccuacucccaaauaggaauuagcaagaguuaaggccaggugcaguggcucaugccuguaaucccagcacuuugggaggccaaggaaggcagaucacuugaggucaggaguucaagaccagccugggcaauguggugaaacgcugucucuacaaaaauacaaaaauuagcuggguaugguggcaugcaccuguagucccagcuacuuggagggcugaggugggaggauugcuugagcccaggaguuugacgcugcagugagcgagauugugccacucguaacagagcgagacccugucucaccaaaaaaaaaaaaaaaggccaagcucggaucaccugaggucaggaguucgagaccagccugaccaacauggaaaaaccacaucucuacuaaaaauacaaaauuagccagguguaguggcacaugccuguaaucccagcuacuugggaggcugcggcaggagaauugcuugaacccgggagguggagguuguggugagccaagaucgcacuauuguacuccagccugggcaacaagagcguaacuccgucucaaauuuuaaaaaaaagaaaaaaagaaaggaaagaaagaaggaagaauuaaaacaguuaaagagucuuuaaugccugaaggaggagaggagauugagauuauuuugcccuguugucucucucauuuacauaaucugcucugucacaguggauucgagaagugacaggcuauguccucguggccaugaaugaauucucuacucuaccauugcccaaccuccgcguggugcgagggacccaggucuacgaugggaaguuugccaucuucgucauguugaacuauaacaccaacuccagccacgcucugcgccagcuccgcuugacucagcucaccggucaguucccgaugguuccuucuggccucaccccucagccagcccaagacugguaccuccuugaugaugacccaagacugcucacucuaagugccucuuccaaggugccugucaccuuggccgcugucuaaagguccauugcucccuaagcaauagagggcccccaguagggggagcuaggggcaucugcuccagggaaaggaacccuguguccuuguggggcuggagucagagcuggaucuguuaaccguuuuucuaauuucaaaguacaguguaccggaggccaggccugauggcuuacaccuguaaucccagcauuuugggaggccaaggagggcagaucacuugagaucaggaguuugagaccagccuggccaacauggcgaaacccugucucuacuaaaaauacaaaaaaauaaaauaaaauaaaaaauuagcuggcuauaguggugcgcaccuguaaucccagcuguucaugaggcugaggcaggagacucgcuugaaccugggagguggagguugcagugagcugagauugcaccacugcacucuagcguaagugacagugagacuccgucucaaaaaaaaaaaaaaaaaaaaaaaaaagccugggcgcgguggcucacgccuguaaucccagcacuuugggaggccaaggcagguggaucacaaggucaggagaucgagaccauccuggcuaacacggugaaaccccgucucuacuaaaaauacaaaaaauuagccaggugugguggcgggcgccuguaguccgagcuacucgggaggcugaggcaggagaauggcgugaacccgggaggcggagcuugcagugagccaagauugcaccacugcacuccagccugggcgacagagcgagacuccaaaaaaaaaaaaaaaaaaaaaaaccaaaguacaguauaccuggaugucccuccuucccuaggaauucuaccuuuacucuccuaaaccaaaccccuaugagcuggaggaauauagggguuaaaaaccaccuguccaucuucugcuucuccaugucccagucaguuggaaaacauaugggcagggcuugggggagggaauguugagucagaaaucucucccucucucccuuccccucccccacuagcuaaaccggaucuggacaggugacugaggaggcaggaguuucuuuuggccugacuccucaucuuauaaagggagucuucucugcagcuuagauuuaauuggaccuaucugucugccucauucucccacuccugagucucagguguccuuuuggauggguggagagguaaggaagaggcguuccgcugcggcccuuaacccugucacuucuuucccuaccucagagauucugucaggggguguuuauauugagaagaacgauaagcuuugucacauggacacaauugacuggagggacaucgugagggaccgagaugcugagauaguggugaaggacaauggcagaagcuguaaguggccgugaucaagauugcuccccagucccaccaaaccagagugacucccuucuuuccaucauccuuacauuccugaucugaacccgccuccccagugaacaaacaccucaggucccugacucagcagcccaccagggcagaccauuccagucuccuggaaucuaaaccacagaggagguguuucaagaaaaggagcaggccgagcaugguggcucaugccuauaauccuggcacuuugggaagccaaggugggaggaucgcuugagcccaggaguccaagaccagccugaguaacauagcaaaaaaucuacaaaaaauuaaaaaaaucagacaggcguaguggcucgcaccuguaaucccggcuacucaggaggcugaggcagaggauugcuugagcccaggaggcugcagcugcagugagcugugauugugccauuguacucuagccugggcaacagagugagacccugucucaaaaaaaaaaaaaaaaaaucccugaguacuaagcagggaagccagaucuuuagacuccacaucuguuacucguuccacuagaauauacucccauuuccuuggagcccaccuuccccugaccauucacaugcauauauuccugcauauauucaguuugcccaggaggaacuaaguuccuggguugggacuaggacuaagguuggcauuugccccagucccuccccuucagcugcccagugggugguguggaggcguggccgcgccccuuguugacagguccacuugagcccagcccugcucuccaagggcagggagggacacagcccuggcuuuuugcuucccgggauugaggugccuguguacugacaucauaccccguugauuaaaacaagccuuucuuagcccugauggccccuuguguugccuuccuucccaaccagguccccccugucaugagguuugcaaggggcgaugcugggguccuggaucagaagacugccagacauguggguuugaaauucccuccaaaaacuucacucauacgcuuucauaucccuuccuccccaagccugggucaacacugugggggaggcaugagcaguggccucagaauucaguccuaggagcccuaacagccaugcuuucucuccuuccauagugaccaagaccaucugugcuccucaguguaauggucacugcuuugggcccaaccccaaccagugcugccaugaugagugugccgggggcugcucaggcccucaggacacagacugcuuuguauguacccuuuccauugccuggguucugaaauugggauguggccuuugaggaggagguagggguacacacguaacauaaaucugaugagccuccuuuuuucccaggccugccggcacuucaaugacaguggagccuguguaccucgcuguccacagccucuugucuacaacaagcuaacuuuccagcuggaacccaauccccacaccaaguaucaguauggaggaguuuguguagccagcuguccccguaagugucugaggggaaggaacaaugaucaacaauaguagauccaagauuuuagacaaaauuguggaagggaaaaagaauccaguuggugauaaauagggagauuggugaaugguuaugaucaucuaaccacuccagugagugacccuuacguccaguccucccaugacuucagcuaucacccuuacuucugcuccuuguagcaacaaauagugaagagacuuuugaaucuauagggcagcacuuaagggaucuaggguggcagauggggacaaauccagugcagagcuggagggagccuaggcccagagcaaggguuccauugguagcuggugauguuccucccucaucucuaaugguguccuccuccucuucccuagauaacuuugugguggaucaaacauccugugucagggccuguccuccugacaagauggaaguagauaaaaaugggcucaagaugugugagccuugugggggacuaugucccaaagguggguaggagaugguaagaaguuguaaagagacagccuuuccucugagccugcgcagaccacccccacugaaccucucuuacauuugcagccugugagggaacaggcucugggagccgcuuccagacuguggacucgagcaacauugauggauuugugaacugcaccaagauccugggcaaccuggacuuucugaucaccggccucaauggguuagagauccugccuucccuccuuagaccccagcccacgcaccccucacaguucauuucauuggccaaaacuuuccuauguggagcugacuaggaaucaaagucauaaaauucuagccuguuacaaaggaccugaaagaaugcuuaacacauccuccauccaggccuucgguccccucaggaacaucuuugagcaauucaauaucgcccugccaaggaacaagggacaggaacaacauauccuccuucuuaaaguuuucuuuuuuauucuuuuuucuuuuuugagauagggucuugcucugucaccuaggcuggagugcaguggcgugaucucgacucacuguagccucgaccuccugggcucaagugaucccaaguagcugggacuauaggcacacaccaucauacuugacuaauuuuuuuguauuuuuuuguagagacagggucuugcuauguugcccaggcugaucucgaacuccugugcucaagcaauccucccaucuuggccucccaaagugcuagggaucacagcacccaaccuccuucuuaaaguuuuguaaaaguucuuccuuagauuuggauaaaaaucugucuccaggcugggcccgguggcucaugccuauaaucccagcacuuugggaggccgaggugggcggauuacgaggucagaucgagaccauccuggcuaacauggugaaaugccaucucuacuaaaaacacaaaaauuagcugggugugguggugcacaugccuguaaucccagcuacucaggaggcugaggcacgagaaucacuugaacccaggaggcggaaauugcagugaaccgagauuacaccaccgcacuccagccuggcgacagagcgagacucuuucucaaaaaaaaaaaagaaaagaaaagaaaauucugucuccccaugacuuuuagcuguuuucacucauucugcuccuuggagcaaaaagaacaaagggacuuucuagucuauaggacagcauuuaaaauguguguguguguguaaaaaaaacccacuaugaccaccuguuuuuuuuuuuccuuuaauuuuuuauuuugacauaauuuuagaucuacacuaaaguugcaagaaugguauaaaauuccccauauacuuuuuuuuuuuuuuuaagacaaagucucacucuguuccccaggcuagagugcaguggugcaaucuuggcucacugcaaccuccgccuccucugccucccggguucaagcaauucuccugccucagucuccugaguagcuggaauuauaggugugugccaucaugcccggcuaauuuuuguauuuuuaguagagacaggguuucaccauguaggccaggcuggucucgaacuccugaccucaagugauccacccgccccagcuucccaaaguguugggauuacaagugugagccaccgcgucuggccccccauacacucuuuuacccagauccuccaaauguuaacauaccacauauggccgggcacaguggcucaugccuauaaucccagcacuuugggaggcugaggcagguggaucacuagguguggaucacgaggucaagagauugagaccauccuggccaacauggugaaaccucaucucuacuaaaaauacaaaaauuagcugggcgugguggugugcgccuguagucccaguuacucaggaggcugaggcaggagaauagcuugaaccuggcaggcagagguugcagugagccgagaucgcggcacugcacuccagccuggugaaagagcgagacucugucccccgccaaaaaaaauaccacauacgcuuuaucacuucucucucucucugucucucucuacacacacacacacacacacaaaacacaugcuauuguuuuucuggaccacgugaggguaaauuuucacacaugguucuuucuuaccccuguuauauuucagcguauauuccuuaaaaauaauauuuucuuacauaaccacagcauaguuguuugaaucggaaaauuaacauuaacacaaaauauuaucuaagcuacagaccuuauucagauuucacuaauuguccuccuaagguuugggaucauacauuacauucaguuaucguggcacuucaaucuccuuuauaacagcuccucagguuuuguuuaucuuucaugauauucuugaugaguauagauuagguaaugggcagcauguucuucaguuuggauuaguuugauguguccucaugauuagauucaaguuuuuguaguuuuuuuuugagacaaggucuggcucuauugcccaggcuggaauacaguggcaugaucucagcucacugcaaccucugccucccgugcucaagcgagcaccucagcccccugaguagcugggauuacaggugcaugccaccaugcuuggcuaauuuuauauauauauauauauauauauauauauaaauaauauauauaaauauaaauauauauauauaaauaauauauauaaauauauauaaacauaaauauuauauacuauuuauauauuuauauauguguguguauauauauauauauuuuuuuuuuuuuuugagacggagucucgcucuuguugcccaggcuggagugcaguggcgugaucucagcucacgcaaccuccaccucucagguucaagccauucucuauagagacaggguugcaccauguuguccaggauggucucgaacucaugagcucaagugauccuccugucucagccucccaaagugcugggauuauaggcaugcgccgcugccaggcuggaguuugauaagaacaccacagaggcugugagcucagggcauccuauugaggauguacgugauguugauuugucccagcacucacaaugaugucucuggucacuuaguuaaggugauaucugucagguuuuucuacuguaaaguuacuauuuuuccauucacaauuaaugaaugucuugggauaauugccugaaucaauuauuguuaugauaguugccaaaugauaauuuucuaauuccauuauuccuucugcauuuguuuguuggcauucuacuguuaggaagagucuuuccagcugagcacaguggcuuaugccuguaaucucagcccuuugggagccagugggaaaauugcuugggcccaggaguucaagguuacagugagcuaugauggcacuacugcucuccagccagugcacucacucugcacaacagagugagacccugucucuuaaaaaaaaaaaaaaaaaaaggccaggugcaguggcucaugccuguaauuccagcacuuugggaggccgaggcgggcggaucacaaggucaggaguucaagaccagccuggccagcauggugaaacccugucucuacuaaaaauacaaaaaauuagccaggcaugguggugugcuccuguauucccagcuacuuaggaagcugaggcaggagaaucacuugaacccaggagguggagguugcagugagcugagauugcugccacuguacuccagccugggcgauagagcaagacucugucucaaaaaaaaaaaaaaaaaaaaaaaaaaaaaaaggucuuccuuuccuauuuacucuuauggauacuuauuuuauucuagucaaugguuauaauccuuuacaaucauuauuuauuuuagccagccccuccaaguuggcuccuguguucuuugggcuguacccuuaauucuuugagucuugucuuguuugcacaagaugcucugggcuuauauuauauuucccccaucccagccauuucuccaaggaauguuuccuuuuaguggagaaugauauuuagaaaccaaaugcugaggcugggugugcucauugccauugaguuauaccuuuaccuuauugacugguuucuacuguucuauucagagaccccuggcacaagaucccugcccuggacccagagaagcucaaugucuuccggacaguacgggagaucacaggugaguggcagagaguuugcccuuucuagaagaauaggugaaccacuggcauaaauugcgguauaacuacuugagaaaaucacgucccaaguuauaggggaggagccaggagaacccaagaaagaagaaggcucccugcccauaugccucucuccaaccccucagguuaccugaacauccaguccuggccgccccacaugcacaacuucaguguuuuuuccaauuugacaaccauuggaggcagaagccucuacaagugaguaaaggguauggaggaaauggcaucuucaggcaaugaagccugugucauaggcauucuuuaguaaaauacaaggcacugucucauacagcagugccucaaaaccaaaggguuucagaguuucacgaggaaaaggcaaaaggagggggauucccucucaguggaucugacuagcacugagcaaauuucuugacuaacaugaauccuuugaauaguuaauguucccuuaguagucucuccucucauccugucuccuuauucucagccggggcuucucauuguugaucaugaagaacuugaaugucacaucucugggcuuccgaucccugaaggaaauuagugcugggcguaucuauauaagugccaauaggcagcucugcuaccaccacucuuugaacuggaccaaggugcuucgggggccuacggaagagcgacuagacaucaagcauaaucggccgcgcagagacugcggugagggaaagggucugcuagguggugagaauagggagucagggaggagagggcugaaaggacuauucugcccuagacgugggaguaggguugagggauggaaccaaggagaagggggcuguuaggcuggaagcaguaacgaggaagaauaaugaagagagggcuugcugggaguccucagacuccucuccuaacccaccccuuccuuuccaguggcagagggcaaagugugugacccacugugcuccucugggggaugcuggggcccaggcccuggucagugcuuguccugucgaaauuauagccgaggaggugucugugugacccacugcaacuuucugaauggguacaguaaggggagccagucaaggauggguggggguggggcccugcaauggaacuguucagguggcauacaauaaaagucuuuagacagcuuucugcaugugccuuggugggauugagguaggagaccugugguugugagaucggagcaugaaggucaggacuuggaagugaccccccccucccuuuauuccccacuacagggagccucgagaauuugcccaugaggccgaaugcuucuccugccacccggaaugccaacccauggagggcacugccacaugcaauggcucgguauacuaguagcaccaggaucuccaagggagacagagaaggggcaauacuuggagcaucuggggaaugauauggcuaaggauagcacagagaggccagauaaugcuagggccugcagauagaagauccugaaugucuggguuggucuuugcugggagguauggaauugaccuugggaucugauucuuccugaccuucucucuuccacucagggcucugauacuugugcucaaugugcccauuuucgagaugggccccacugugugagcagcugcccccauggaguccuaggugccaagggcccaaucuacaaguacccagauguucagaaugaaugucggcccugccaugagaacugcacccaggggucagugaugggauaauaaggagagggggucagguggaaggguaggagcacagaacuagagugagggaagcagaaagaagagagaggcugugauucaagaaucacucccagcuggccgggcgcaguggcucacaccuguaaucccagcacugugggaggccgagguggguggaucaccugaggucgggaguucgagaccagccugaccaauauggagaaacccugucucuaccaaaaauuuaaaauuagcccggcgugguggcgcaugccuguaaucccagcuacgcgggaggcugaggcaggagaauuucuugaacccaggaggcagagguugcggugagcugagauugcaucauuguacuccagccugggcaacaagagugaaacucugucucaaaaaaaaaaaaagaaucacucccagcuguguagcgaaggauuggagaaagggaaaaucaguaacagcacaaaauuacaccacaguuuugggaaccuggaauaaccucaguucaagggaguuucacagaagaggggcuuggggagagcuagugagcuggagguggaggccaugucuugggaucagcucugggcuccaggaugggaugccacgguaaguucugaaacaagcuuuuauauguuaggcuguugaaauugagccucugcuguccaagcucucauuuaagguggugacuuucuucccuagguguaaaggaccagagcuucaagacuguuuaggacaaacacuggugcugaucggguaugaugggguuggagauucuggaaacuggggauauuugggaguugggagagaggugguuaccuggagagaagagggaggcugucuucauucuggccuuuuauguaugcaguccacuaucacuggacacuugggacucaagaaugcaggcuucuggacuucccuuccuaaaauuaacuuucaguagucuaagacugguccagauuuagguuggucccuucagugcuuaaggauauauaugugaauguuaauuucuugccccaggucagcaucauaccuucaacacaaguauaguugacauuuguaaggaagaugcaaacccaggauaauguuggguuucuauauaucccauagcaaaacccaucugacaauggcuuugacagugauagcaggauugguagugauuuucaugaugcugggcggcacuuuucucuacuggcgugggcgccggauucagaauaaaagggcuaugaggcgauacuuggaacggggugaggugaguacuuagcuuacuuuuguuuuuucuuuucuuuuuuugcauguccuggaagucucuuuauagcuuaauuuugagugguacccugugcacccaggggucagugaugggauaaaugucacuccccuccucuuuccccagagauuugaucccuuucuucaaggaaguagugugguccccuagaagaacacuggucagagaaaugggaggcaugcauucuaguccugauuuugccauuaauuugccacaugacuuugaagaaguuacuuaucuucucugugccucgguuuaugcaucuauacagaggaaauaacauuuguccuuccaggauggcuguaaggguaaagggggaugauguaugugaaagugcuuuggaaagcacagagcacuguauaaaagguacucaaggugguaauaguacuaccaacucucccuagcuguccccuuccccacuuugugcuccuccaucaaagggaaaacccaaccccuuugauuccugaucucaugagcacaaauaacuuccucaguucucagggucuguaccucaauaugccuauaauccauuccaggacuaacggugcuuccucuuccugcccuuucagcugugcugcuuuuggcauucaccuaugaggagcggguuggagugggacaugggaauggccuuuccugaguaacuccuucccauuugcuccucagagcauagagccucuggaccccagugagaaggcuaacaaagucuuggccagaaucuucaaagagacagagcuaaggaagcuuaaagugcuuggcucgggugucuuuggaacugugcacaaagugagugacccauaggaauucuggagagguggggaaggcaucuagggcaaaggggugaaagauuuuugcauaggauugaccuagggagaaugaccuuaugccaacuccugccccaaacuucccagggaguguggaucccugagggugaaucaaucaagauuccagucugcauuaaagucauugaggacaagaguggacggcagaguuuucaagcugugacagauguaagugaaggaaauucuguaugccgcuaggagagaggacaauauuagauacaaucauguagaagcaggguccugugcuucucagcagcuacuauguuagccagaauguugggggugggggggccugggcuggcugugcacaugcugaguguaugugaaccuguugguuuccuagauaauaccuuuugugucucuuagcauaugcuggccauuggcagccuggaccaugcccacauuguaaggcugcugggacuaugcccagggucaucucugcagcuugucacucaauauuugccucuggguucucugcuggaucaugugagacaacaccggggggcacuggggccacagcugcugcucaacuggggaguacaaauugccaaggugagagaagccuggaggaauucugugauaagaacugcuugucugggggccagccaggaaaaagugagaagguugaaguucugagaggugagguccccaacccccgggcugcagacugguaccaguccauggccuguuaggaaccaggccacagagcaugugagcggcaggcaagcgagugaagcuucaucuguauuuacagucaguccccaucacuugcauuaccgcccgaguuccgccuccugucagaucaggggcagcauuagauucucuuaggagcuugacuucuauugugaacugugcaugugaaggaucuagguugugcacuccuuaugagaaucuaacuaaugccugaugaucugagguggaaaaauuucaucccaaaaccaacccuccccuuccccuggaaaaacugucuuccacaaaaccagucccuggugccaaaaaagguuggggaccacugcugagagguaccuucaagauuugggggaauuccagaucucagugacugauucccccaaccuuaagaauacuuucuuccccuauaccuacagggaauguacuaccuugaggaacaugguauggugcauagaaaccuggcugcccgaaacgugcuacucaagucacccagucagguucagguggcagauuuugguguggcugaccugcugccuccugaugauaagcagcugcuauacagugaggccaaggugaggagacacaaaggguaaggaggcggggguggagugaagcauggggauagggagcagccaguggucucuuccagaggcaagcagaugcuucaugguaaguucaaggagagaaggcugcagaugccagauauuuuaguucagagggcaacaaauaaaauaaugaucaagaacuugggacuggccgggcgcgguggcucacgccuguaaucccaacacuucgggaggccaaggcggguggaucacaaggucaggagaucaagaccauccuggcuagcacggugaaaccccgucucuacuaaauauacaaaaaaaaaaaaaauuagccaggcguggcggcaugcaucuguacucccagcuacucgggaggcugaggcaggagaauggcgugaacccaggaggcggagcuugcagugggccgagaucgcaccacugcacuccagucugggcgacagagcgagacuccgucucaaaaaaaaaaaaaaaagaauuugggacuuggaaauccuaagaaaauuuguggaaauaaacuugugauaccucuaucuuuaauccgcagacuccaauuaaguggauggcccuugagaguauccacuuugggaaauacacacaccagagugaugucuggagcuauggucagugcaucuggaugcccucucuaccaucacuggccccaguuucaaauuuaccuuuugagacccccucuuagaaucucuaagcacuucagauuuuuguguuagaucagguucugccuucccuucacuucaugcccaugucuacuauuuugccagugacuaguccaugucuuccugcaacaggugugacaguuugggaguugaugaccuucggggcagagcccuaugcagggcuacgauuggcugaaguaccagaccugcuagagaagggggagcgguuggcacagccccagaucugcacaauugaugucuacauggugauggucaagugugaguuaccugcugagcccaaccauuuucucuuuuuuucuuuuuuuuucuuuuuuuuuuuuuuuugagacagagucucacaauugucacccaggcuggagugcaauggugcaaucaaucuuggcucacuacaaccuccgccucucggguucaagagauucuccugcuucagccuccggaguagcugggauuacaggcgcccgccacaccuggauaacuguuacacuuuuaguagagaugggguuucaccauguuggccaggcuggucucaaacuccugaccucaggugauccgccugccucagcuucccaaagugcugggauuacaggugugagccaucaugcucggccugacugcagccauuuucugacuucccucuguacuccucuuauggcucuauuccuuuuuuuuuuauggagucucgcucuguugcccauacuggagugcaguagcgugaccuuggcucaccgugaccuccacguuccagguuuaaguucuucugucucagccucccagauagcugggacuuuaggcgugcaccaccacgcccagcuaauuuuuuuuugucuuuuuaguagagaugggguuucacuauguuggccaggcuggucucaaagucccgaccucaggugauccacccgccuuggccucccaaagugcugggauuauaggugugagccaccgcgcccggccauggaauguauucucuuuuaugucucuaccuccuacaucuuaucuccagguuggaugauugaugagaacauucgcccaaccuuuaaagaacuagccaaugaguucaccaggauggcccgagacccaccacgguaucuggucauaaaggugaguagggaguaggaggugcuaaggaaauuuagaaaaaggaggaguuggcuggaaccaggauucccccuaacaaucaccuaucgauauagagagagagugggccuggaauagccccugggccagagccccauggucugacaaacaagaagcuagaggaaguagagcuggagccagaacuagaccuagaccuagacuuggaagcagaggaggacaaccuggcaaccaccacacugggcuccgcccucagccuaccaguuggaacacuuaaucggccacgugggguaagacaacuucuaauuacccaacacuuugcacccugagcccucacaaacccuacagauacccagauuaacuacucaaaggcccccauggugaauguagauuucucccuucaucuuaaccuuuuccuuauuuuuucauccuagagccagagccuuuuaaguccaucaucuggauacaugcccaugaaccaggguaaucuuggggagucuugccagguaaguucuguugcugagaggcuggguuuuaggaucagauugauacgaguaguauggaagacauuagaaaccucugagguuuaaucaguguccugcaaaaaagaaggcagugagggccgggcgaguuggcucacaccuguaaucccagcacuuugggaggccagagagaguggaucaccugagguuaggaguuugagaccagccuggccaacauggugaaaccccgucucuacccaaaauacaaaaauuagcugggugugguggugcacaccuguaaucacagcuacucaggaggcugagacaggagaaucgcuugaacccgggaggcagagguugcagugagcugagauuguaccacugcacuccagccugggugacagagcaagacccugucucuuaaaaaaaaaaaaaaaaggccaggugcgguggcucacgccuguaauccuagcacuuugggaggccgaggugggcggaucaugaggucaggaguucgagaccagccugaccaacauggcaaaacccugucuguacuaaaaauacaaaaacuagcugcacaugauggcaggugccuguaaucccagcuacucgggaggcugaggcaggagaaucacuugaacagggaagcagaggcugcagugagccaagauaaugccacugcacuccagccugggcgacaagaacaagacuccaccucaaaaaaaaaaaaaaaaaaaaaaaaaggcagugaacaacccaauauccuucuaaacaaaucucucuucuuuccucaucauguaaauuuccuugcauuauuuucuguuuauuuucuuccuuaggagucugcaguuucugggagcagugaacggugcccccguccagucucucuacacccaaugccacggggaugccuggcaucagagucaucagaggggcauguaacaggcucugaggcugagcuccaggagaaagugucaauguguaggagccggagcaggagccggagcccacggccacgcggagauagcgccuaccauucccagcgccacagucugcugacuccuguuaccccacucuccccacccggguuagaggaagaggaugucaacgguuaugucaugccagauacacaccucaaaggugccugacucuuccuagggcuuuccucaauuuuuccucgaauucuuuccccgggcuccucuuuuuucuucucugaucauaugccucucuguccuauuaauuuuuucaaacuuuccccuacccucaugaaguucuucacauaccuagccuuucuucucaacccccagguacucccuccucccgggaaggcacccuuucuucagugggucucaguucuguccuggguacugaagaagaagaugaagaugaggaguaugaauacaugaaccggaggagaaggcacaguccaccucaucccccuaggccaaguucccuugaggagcuggguuaugaguacauggauguggggucagaccucagugccucucugggcagcacacagaguugcccacuccacccuguacccaucaugcccacugcaggcacaacuccagaugaagacuaugaauauaugaaucggcaacgagauggaggugguccugggggugauuaugcagccaugggggccugcccagcaucugagcaaggguaugaagagaugagagcuuuucaggggccuggacaucaggccccccauguccauuaugcccgccuaaaaacucuacguagcuuagaggcuacagacucugccuuugauaacccugauuacuggcauagcaggcuuuuccccaaggcuaaugcccagagaacguaac

SEQ ID NO: 21269 - RNA, 19344 nt, Homo sapiens
gggcguguacacucggcgcaccugcgagacuacagagccucgggccggcacguguggggaguguggacacgucugcugcgccccgcuucucgcugcugaggggaagggagggggcgggcaggugcagcggccgggcuagugggagggggcggcggccauggagcgggugaacgacgcuucgugcggcccgucuggcugcuacacauaccaggugagcagacacagcacggagaugcugcacaaccugaaccagcagcgcaaaaacggcgggcgcuucugcgacgugcucuugcggguaggcgacgagagcuucccagcgcaccgcgccgugcuggccgccugcagcgaguacuuugagucgguguucagcgcccaguugggcgacggcggagcugcggacggggguccggcugauguagggggcgcgacggcagcaccaggcggcggggccgggggcagccgggagcuggagaugcacacuaucagcuccaagguauuuggggacauucuggacuucgccuacacuucccgcaucguggugcgcuuggagagcuuucccgaacucaugacggccgccaaguuccugcugaugaggucgguuaucgagaucugccaggaagucaucaaacaguccaacguacagauccugguacccccugcccgcgccgauauaaugcucuuucgccccccugggaccucggacuugggcuucccuuuggacaugaccaacggggcagccuuggcagccaacagcaauggcaucgccggcagcaugcagccagaggaggaggcagcucgggcggcuggugcagccauugcaggccaagccucuuugccuguguuaccugggguggaccgcuugcccaugguggcuggaccccuauccccccaacugcugacuuccccauuccccaguguggcauccagugccccuccccugacuggcaagcgaggccggggccgcccaaggaaggccaaccugcuggacucaauguuuggguccccagggggccugagggaggcaggcauccuuccaugcggucuaugugguaagguguucacugaugccaaccggcuccggcagcacgaggcccagcacggugucaccagccuccagcugggcuacaucgaccuuccuccuccgaggcugggugagaaugggcuacccaucucugaagaccccgacggcccccgaaagaggagccggaccaggaagcagguggcuugugagaucugcggcaagaucuuccgugauguguaucaucuuaaccggcacaagcugucccacucuggggagaagcccuacuccugcccuguguguggguugcgguucaagagaaaagaccgcauguccuaccaugugcggucccaugauggguccgugggcaagccuuacaucugccagagcugugggaaaggcuucuccaggugaggaaaggcccccucuuccuccccugccacacguuaucuuaguccugaaaaggcuccugccaagaucugggggugugggauuugugggggucauuugaccuuauagaaccaugccagguuuggguagaguguuuuuaagggcccuuauuuugagaugguaugccugagaccugcuuuccauucccucagggaaguuuuuuugacgcuaagugugcccuacugucucuccuccuggggccggauuccucaggccagagccaccggaccucaccauucuucccccagggcucccuuuguguuuccggcaccaggcguggggcccccucugggggcgggagacugggcuccuccagcgacuuccccgcuugaauggcugccgagggagguacuggaacaagugcaucugggacucccuacacucuugaggcaccagauuccccaacacagaacacuggccauccugaucaguagacuccagcugugccucucacaccacccugggaucaugggacacagagcuggucacccagagcugcugcuuaacaccaaaagcuuugaucugcucugaccugguagcucuagagccuaaugggacccacgagccccuuuauguuuucaggacagaaaggaauggggacaggaucucuauguagguucacuuucuaguuagccuguuggggaacugaggacuugucugggagcagagggugauuuuguuuuucuccuaaaaggccgguuuuaaccuggauuguaggaccuugugugugugaacacagggauggagaacucccucagagggccccgaccaggaaccagucuuaccggucaggcagccccugcccaccugcucaggcgggcaucuggcuuaccagcccagcuggggacuuaaggcuccacugcuggccucuggggacugaauuccauccggguggcauucauuggcugcccguggcgggagaggcugggggaggggauugcugaguuucuaaggggcuuuagucuggacaaugaaucacauauccccuccuggaaaggcugcagugaggcagcucuguuucauucuacugccaccgccucugguccuagaaaacacugaguuucugguggggagaauugagggaguggggaggcaaaaucagagacaaaugcccauuucucuuccccccuccagagaaaaccagggcagagaggccugggccuguggagccagaacuggguggugacuuugucuuugucaugcugggguuggggagagggaguccuuuccagcagugaguguguguguguguguacacacguaugcauaugugccugugugguggggucuggccaaguuucuaaagucccucuugguucucucuuuuccaggccugaucacuugaacggacauaucaagcaggugcacacuucugagcggccucacaagugucagguaggggcugggucagggcagagaugggcugaaggagaugaugcuguucucacggucgcagccuugagccagccgcugcgugugccgggggcccggcugaccgcccaccgcuuugcacaccuccccucuguuccuccacccucccucugcucuccuccuuuguucuucccccaggcccccuucccccacagcugacguuccuccuuccugguugcuugguccugguucccacccugucuuugccuucacucuguugcuuggcuuuccucuccugguguuugccggcuccuuggauggugggccguaucacacagauguuguguugggagacccggcacugcgcugggccugacuguugguuuccagcaguuuguagggacugcagguuuuuuuaaaagggcuccuggugguccagccaaccacucuuccccuuuucugaccucaguuagagcuccuccuggguccccucagcuuagggcacaaggcagugggggagguaggagguagggagugggugguccccucucccacacuggcaucuguuuaacccauccuaagccaggguuucuggaggacuggagagcaaagugggcucuucuucuuuuagcucuuugcaaaguagcagguaggaaacgcuggaccagauagauucucacccuugguuuaccugcuugaacaauaucugggggcccugcugguacccaaaagauugaguuuccucuccuggccacugagccuuccuguguggauagcgaacacaccucugucuucuccuugguuaucuccccucucccaugccaaguucccaucaagugagggcgagccaugauuguggggugugcacugcagucucugauaggauaaccugcuucuccuuauccuguugguggcaaggggagaggguucagggagaccagcagggagggaugaaugugccguaaguagggcagagccccugggggucaggcguggacgguguucacaggugcugggcuaggcagucucccuggaggaugacccagggugggccugcugggaucugucuuugccuugcugccuucucucucucugucucugauucucucaucacagagcacauucugacucagguagugugcugauuagcccgggcagaguaggaggagcccagagggcagugggggcaagcccgguggccuggggggguaaccugcacucucugcccuuuuuccagguguggguugggagcagcagcggccugccgccccuggaaccucuuccuagcgaccugccaucaugggacuuugcccagccugcuuuguggaggucgucccauucgguuccugacaccgccuuuucccuuucucuaaaaaaaucauucccagcccuugaaaaccugggcccagcacacuccagcaacacucucuucugcccagccccgccgggauaucugaggcagggcuggaccaccccagagggcagcagggccuuuacccaguggccuguuggcuagccugggccucccuggagaggguugacaguggaagggaacaggaggggcauuuggccugagaccccugcuuuugggagaggcuagcagggugguuccugcccagcaugcccagcuccucccugggugacucggagucuuucccaugucagagcccccaaauggggguagcaaggagcaccuuucuggaacccccuauagcauccaaguuucuuucugggcucucuugccuuuuccccccuuucacagauggcaccccugggcaucuguccuugccuaggugauuuuggagguuggugccuuccugggaacuagccaccagcuuaucugcuucccuuccccuggcaucacuucccauaggccugggguuucuagacuggggccuggccaccccuuuccccacuccacgagugagucggccuccagagaagacuggcacaauuccaacuagagucaacccaugcugcccucugcccuucccacucagaucuagauccugcuuucauuucuggcuagugaaguagacuuuuguguuuuugagguuuauuagcaggucugcucaggaaccaaacuaaugaguagcuuuauauugggccaccccaauauauggcuuugggggcugaaaaagcagauguagacccccucccucggauccuuauuggugugcccuuuagcacuccgcagacucugcggggugaacaggagugaugauaaaauuuuucauucuaacauuugaggcuuuguguguuuuguccuuggucugugucauaacacugacaucacugucccuugguguacaaaugcgcuccugcccugccccucccaacauacacucucacagaccugcuggccccuccuccagcccuacagccacaacuccccuaacggacccagcaggugaagacaugcuggcucucuugcucugggcuggccagccaggugugccuggacuugguuaaacagcaggggcaccuguuggcauaguguggggaugcugaaaacauaagaggugaagagacggcucucugggaguucauuccuugaguuccccacuggcuaggcacaguccguaucgcucauccccuccugaugccagagagaaugaaagaggccaguuacagagacuagugccauagcuuaaguagaaaggccaucugaauguaggggcaggaagccucaggcuugacaguggcaugucucuuugggacuuggccugaguguccuuaacuggcccagaugccccagguacugcuggauuuaugagcuuagugggcugggacauuucccccacauggaguucaaccugaagcugagaggcuggagcagcucagaccucccuagcuuccacgggcuccacuucuugggggcugguuagagaaggaaugcguugagaugggcauaugcucgagaagaagggggccaaagagcccagggagcugaaccuucaugcauugcccuuagaguuuuccagggcugugggagaaagcugcuugagacuaccccugaggcugccugaguucaagggcuacuaagggugggggugugcacuagugcccuugguaccacuugggccccauucccaagcugcucaauccuuaggaagaaaagcuuuaggaagucugggaagggagcaggacuggggcucaguguugaguggugaugaccugcacucagggugccugggccaggaccuggcaggcauggcccuuaauuacagcaggcugucuaacuaagcacagggcugugggccgggcagcucuuccgagugccacaggcagucaaagcauucugccucuggcucacucucuucccaucagcgucccucugucuucucccugucucuaggacaaagaaugcucuucuccugacaccccagcauggaaguucuggauguucccuuugagaucugucucccuccgccccuucucuccuggguugugugaccaggcucuuucauguucuguguugucugaacuucugcugugccuagacuuuggacuuucacaggcuccccagaaaaccuggggacugcagcagcagagggucaauccuggcacagagaagccaacaaucacuucagcuuggcuuugaacacagggaaagcguuugucauguuuguguuuuuucccccagcagcagauuuacauuccuaauucuguuugcucaggcgaaaguuagcuuucauuccuugagagauaaucaauggaggacagggugggggaagccagcccagucugggauuuuaauuuugcuuagcuaauccccaaauggauaagccacuuguggguaacugaaguuuggcuauccaucaucuuuagguagcaaagcaugacaggcaaagccuuuagaggacagaucccaaaagaagguuggcaagagaaacaaggcaucucuuuccuaucccucuuguggcucccucucccagagacuguggaagacaaaauccugaauaugcuuucagcccccgaguagcugggacuacaggcgcccaccaccaugcccagcuaauuuuuuuguauuuuuaguagagacgggguuucaccauauuggccaggcuggucucaaacuucugacauugugauccacccgccucggccucccaaaguguugggauuacaggugugagccacugcgccuggccucagcccuguuuucuuacaccugauccauguugguuccuuugaguucugaggcuuagaacacacccucucucaccauuggagggguggucuuugggucgcugccuggcaaagcuagcucuuguccccaaauaaaucaacagguguaccucucuuucccggggguguuuaugcagccccugcucugguuuagagacugcugggcuguguagagguuaggaguuuuuuucuccuacuguggccugucacugggucaugaggucccuggcugacguggggcccacauguggccaugagagcaagcauccauggugcuuucugacuuccuacaugcuggaauuuccuugcacaaaucuguucaccuuucccuuuugggaguccuggcugccaaguacuguacacuguguuauaaaguaugagcaccuuucacucagcagaagcucccucuccugaaucuggagaugguaagagcacaggcucugggacugguucuuaguccagcugucucauauccucucacggccuccacuggcccagcuguaaacugggagagaucagaaucccccaggguguccaggaggauugguaaaguacuggccuggguguggugggggugggugugcuagacuuucuuuaguagcugagucuuguguuuuaagcaaguucaccuucugaagguuuccucauuuaugauaugaauacacugaauauauaaaacagauaaaagcaguaugucauugcuacaaauucaguucaaauguauaauguuuacuuaaaaagacaaugacagaagagcuagguaggcugugcuaacguacacagauauuugggacugggguaguaaacaguggugucuucuaccuugacagcauugcaugcguuuguuucuugcuauggcuguacaguaaggagacaguuagaugucuguauguguugacaguguucagccacuuaccuugagcucucagguucucaggaugugcuucuguuaaagagagauggcagaggcaguuccguucuagcacaagguaaugggguggucuucaguggguuaccauuugaucugugacacaaaggugaauguugcuuucucuuacaguucuaaaacaguaaacacacacacacacaaaagaaaugagucaaaauugacuagaacccaugaaacaccucccuggaaccaaaauagcuugaaagccaacggauucagcucuucucagggcuuucccaauauucuaugacccccacagcuggaaugccuuuguaagcuccagcugaggaagggauguugugaggagacugaucacugguacuaagucaggugcucagguacaggaagugccugccaaccugaguccuccuuccagggugcugguucugaccuucagcuccugacucauccaaccccgggggccuggcugugaguuggugcucagcucacaccacagcuuuccaaagccacgcugucuuggagggugaucacacagcuugccucggagggcugcugucaggauggguugcaugagauaagugccucuaaaaggcugagcaccgugccugccuggcacacaaugaaugcuuaaucaauacaggguaguaucaucauccuugcugucaccagcacuuccccagcuuaacguuucacaaaugcuuuuuuuuuuugagacggagucuugcucuguugcccaggcuggagugcaguggugugaucucggcucacugcaagcucugccucccggguuuaugccauucucccgccucagccucccgaguagcugggacuacaggcaccugccaccaugccugguuaauuuuuuuguguuuuuaguagagaccgaguuucaccguguuagccaggauggucuugaucuccugacuucgugauccgcccgccucagccucccaaagugcugggauuacaggugugagccaccgcgcccggauuuuuuuuuuuuuuuuuuuuuuugagaggaagucuugacuuguugcccaggcuggagugcagugacacgaucuuggcucacugcaaccucuaccucccagguucaagugauucuccugccucagccucccaaguagcugggauuacgggagucugccaccacacccggcuaauuuuuuauauuuuuaauagagaugggguuucaccauguuggccaggcuggucuugaacuccugaccucaggugauccacccaucucggccucccaaagcgcugggauuacaagcaugagccaccgcacccggcccacagacacuuuugaagccucuggcccuugcugucugcuaauucucaugucgucagaauugccacuaucauuuaaugggcugcuuuuucaauucaaacucgugaaaauauuacgaauaauuaucucugcacuuuguccugccuuuccuuuccauuucccuggccaagacuaaugucacuuuugaauaaaaugaacaaauauaauucuuuguauaaaacuaggggaaacccagggauacagaacaggaaggcugguuuauaugccaauaacucaucuguaaauucauguaaauguaauucugugcauuauagcuaaugcaccuaaagucaauucuuaaugucuaaggaugagcaaauguguaacucuucauuguguagagggguauagagcuuagcuugccauguccuggguacauuuccaguagucauuuaguuaguaccagugauucccacucaagugucccguaaggagguaccaugggaaauaagagcagccucuuggcauucuggguagggagccugagccaaacucuaaagcugucuuuauaaagggaggucaugugauggccagaaauugccuuugcuucauggugcacuugguggggagucagguguggggugcuggguuucacaucaucccauuuucuuuucugccuucagaccugcaaugcuucuuuugccacccgagaccgucugcgcucccaccuggccugucaugaagacaaggugcccugccaggugugugggaaguacuugcgggcagcauacauggcagaccaccugaagaagcacagcgaggggcccagcaacuucugcaguaucuguaaccgagguaaucugcccacuguuuccucacuuccagaggaugggccugagcguguaugggaggccuaggggugucucaaucacccugccucagacuccacucuuugcacagccacccccuacuucccacugaaugauaaacaccuucaucacccaacuagcuauuugcuaccucuuccuucccaagaagcuuggggugcuuagaaugggaagucccaggagaccagcaggucaaaacagaaggagagagguucuucccaagcuugggcccauaacucucaccugcuacucagauggcaggauggaugcauuuugcagacaccacugaaccacugagguuggugggggaguuaguaggucccaaagugagagaaaaagagguugguccggcuugagagcuuuugcugguugauucacuggcauaugaaauucagcagccagggaaggagguugagucuggagauaaacaaggagcagacacuuuguagcacaaguagucagaagagagcccaaacucagguagauuguggccuugagagaggaaaguggaaggugcucugagcagggcagcaugcuugaggacaaggugggccuaaguagugucuaacucuguggcagugguguuguguugggugaagucaagccuguccccaagguucugccgggucuaguuggcuguuggaagugcuagauguuuguguuuugcaagcacagcaucaguggaggcuugcacugugucugugcuaaaggagguuggagcagcuaucugugaacgugaggaugcuucugcauggugugcuuugcuuuggccaguggggagcacugggauguccuuaucuccuggggcauucuugcuugucccaaugcuuccgaaagccugcuuagugggugcagcacugaaccaggagucaagagacccaggguuuagucccagccucucacuagguggccucgaguucucccauucccucucuaagcuugaguuucuucaucucucaaaugggguuaagaauagcccccuuucccaccucacagggcuguuaugaggaucccaggagacaagguaggugaaaggagccgcacacuugggagacucuauccuugcacuuuguaacaauguugggaaagacaugcuuguugacacucuggguuggaccaggcacaacacuccugcaggccuuggcggaaucguugggugccugugcuguguucaugugccgagguccacgguggaaggagauugcugaguagcuggguguucuugguguccuggaacugggucccuccuugcagcuucauaccugggguuuguaccaccaggacaccugcugugaaagcagggaaguaguagugaaggucucuuaagcugucuguucuguuuucugacaugucauuagagcccauugcugacaggagcuuccuccagguugcaagcggugggcuugcgcaugcagggagaguuaucaggcuguggcugacugucuugacuggggcuuccccagcccuagaaauaaugucguuucuugucuugcuucauccuaaccuggcuuccugacagcucccccggauaacucaaaaccugcuguaacaagcuguuagcaggcauuuugucaaguuuucaauauggaaguucccagucugagaacuggggucagagaccagagguugaaaacugcugaguggagaagggugcucaugauaaaacucagaaagcccagaccagaugguggaguagggcagaaacuggacaggagacccagggcuacagcccuugaagcccagcucaggaggagagaaaaacugagagcagcagggacagugggaaaguuggcccaguaaggaagcagcugauguggcaaagccaacaacuauuguacaucaggauuuauuuuccaagggcuaguaaagagaacuugggcaacagccauaagcuacaugaccggaauggagaauccagaagaguaaaccagagucuacuuuuucucagaaaagccaagacugggucuggaucacaggccaaacaucucuggguuccagagccagagcgggaagucccuuuccugcaagaagacuaaagaaggugcugguccaacccaugcuggguacucagaaagaagagaaaacaauugcaguuuuuaucagaagagaaggagcaggauucuacuccuggacucauuccuugggcagaaauaggaagagacaaaaaaaaaaaaaaaaaaaaaggaagaggauaaaguucuuucugagcaccaaaaacauugagacauuggaaucaaaaugcagagagcucuguguccuccuuugcccugcugccaccaagccuguaccuacaggagggguugcacgaauaaacgaauguucuuaucucugcauguguucaaacaaaggcugaaugucagaacaguuaagauugaaucaggugaacuuccaggugcccucagauccuucaaucccaacaauucuuaaauaguugacuuaaguaucuaccuauagaucugucuuuuucaauuuuugccacaaaaaugacuccuggcugugaagaauggcaaagaggaaaggcagccugacuccugcagccucacacgugagucagaugcaaguugaagagacagaugacucuggcuuugucauacagacauaucaggauguguaugauacuauuuguacaggaagaucauuugcaguggagggaguauuauggcuagaaaagcuuguucccacauuuuugaguugaggaaaucaguugaguugaacaguggaaaagggagaaggcccuggcugaucaccaugauuuucuuccuuuaaaguuucuguagcaggaucuuuguauauaugccuaugugcugguauggugaagaggaacagauuaucaggaauccgccuuugacagagacauuugaaugcaaacaucauugcuugaaagguagaggaagccuucuccccagucagagguaagcacacaaguggauggaugcagggaaccugcuguuccccuggacucacaucaagcuauguaggcccacuccaacacagugcaguugggaauggccccuucaggguuuggacaaggagaaagcaguccccaaccccugcauugauguggaaccugccaaaggaugauuugcuucuggagugccaagugcaggcacaccaggcaagaaaaugcaacugaggagcaguggccuuuugcuaauaagaccaucgucucuggagugaaagggccgguggcuuguugguuguaguggcagucauaugugugcucagcaucuccauugcguggauggcuggaucaagcugccucuuuggaucuugguuaaucaguggugaauggguggguaaguuuagaauuccggcuaaauaugucuggcuucaaagacguauucugcucagaagcucagcuucuguuucauccuaacacuuggcugcugaguugcucuguguuuaaauucuaggcuuuaaguggcagcuguggauccacuccuaccaccccgccaugugguuuugcuauagauaguacagucugcagcugggguaaagucaagaggacucagccacguguuucuaagacuguuuuucaggaaaacucagcaagacaguuucgcuguuguugcccagacuggagugcaauggcgcgaucucagcucaucacaaccuccaccuccuugguucaagcgauucuccuuccucagccucccuaguuagcugggauuacaggcaugcaccaccacgcccggcuaauuuuguauuuuuaguagagacaggguuucuccauguuggucaggcugguccggaacucccaaccucaggugaucugccugccucggccucccaaagugcaugagccacugcgcccagccaaacucagcaaguuuuuauugagcaucugcuguguucucuugguauagcucucccaguaaggaguaaacauaauaauuccuggugcucucccgcuccuuucuguccccuuuugauugcaguggaccugcucugguucaucacagggagagagcuucaugcuauuuuagagaccccacaagggauuaaaaaacuaaggaaaggccgggcacgguggcucacgccuguaaucccagcacuuugggaggccgaggcggguggaucgcgaagucaggagauccgagaccauccuggcuaacauggugaaaccccgucucuacuaaaaauacaaaaaaaauuagccagguaugguggcgggcgccuguagucccagcuaccagggaggcugaggcaggagaauggcaugaacccuggaggcggagcuugcagugagccgagauggugccacugcacuccagccugagcgagagugagacucugucucaaaaaaaaaaaaaaaggaaaaaauuaccuucuaaagugguaucaucauauuaucagaaaguucuaauaucuuguacugauuggugggagccaaugucuccugguucugcuuuguuuuaggggacucuacaguaccaccccaaggggcagggcuaacagccucuuucccauuagccuugucuccucacuccugacuacagccucccucuuagggaugucuacaugggacccucuuacaccaaucuauacccaugaucagccucaggcagaccacugcggucauagcacaggacaacuugcucuaccaggcagggcaggacaccagcaccuggucuagacagaucuuugaaguagcuguauugggaaaggaaggaaaauuggcccaaucccacauuucccuucagaaccacuaacugcugcugucagaggagaacuuguuaaauaaaguucccacaggccagcccuguuuuuccagcagcuuccauucuaacauaccauuauggucgaaaaauacaugaguguaaaugguaauaaugaaaccuauuguaaaaguccacuggauauuucuagggcucagggcuaagacacaggaaccaauuaacccauuuaugcuggagguuacaaacuuuuuugugaaaaaucagacuuuaaugaugaucuugagcaguaggauacaaauaauuccuaaaagguuagcgucccaauaauggaacaugaggcauaaguggguuaaagcaucugcccaguagcuaagggccaaguucugguggcacaugauccugggguuggaguccaggcucugccacucaguagcuguacgugugaccagguuacuuaaccucaccaagccucuuuuuuuuuugagacggagucucgcucuguugcccaggcuggagcgcaguggcaugaucucagcuuacaggugccugcuaccacgcccagcuaauuuuuuauauuuuuaguagagacgggguuucacuguguuagccaggauggucucgaucuccugaccucgugaucugcccaccucagccucccuaaccucacaaagccucuuauuucuuuaucuguaaaauggguauaauaguaaucuguagcacaaaggguguugggcaaauucuauagaauagugcaugcggugugcugggcccuggugugccaucagcacuuccuaaaggugaaccuuuauuacaguuccagcagcauucaaaauaccaugccaauucagacuuuuuuaaaacaaaucucaugcagacauuacacaguacucuucagccucugacccuuuacccuuuagcaguggaucucacuguuauccugugacuguguaauuuugaaagugaauggaaacaccugaugaugagucaaccagaucugaaguggauuaaagggacacugucagggugcuggcacccuaagugggccuuauacuaaaaagcuucaguuccugcuaaaagcaccuucugauccuugacuacagugggguuugauggcauaccuccuuccugugaaacccaagucaaaauccuuuuaucggccugccugauucuguauccuuggacgcauggcugcuguggaaguuggcccaagauguguucuucccagccugagauaucucguggaucagacugaccgaagcaucugggaggugggcuggaacagucccaagaaggccggauuguccucccccaaaauaaagacagagaucauccguguuucuucuccuguacgcgaaccugguggaugcuccaaaaucgaaccaaaacacuaccaugaauaagagaugacugcacuccucugacacaacuuccuauuuuugucuuuguucuucaaaaggucuaaacaguuacuaaauccuguuaugcugaagguggggaaguuagaaaaauagaacaucuccugacagguagaagacgggauccuuggaggcguuccuuugggauuucauuuuaccuccaucucguuuguuguccaguuuccuuuuacgaggauuaagcaggcauccugcuggcuagaauccuguggcuucccuggagccucaaauucuugucuaaccacauuucuagucaugguuccugcaggagacauccacucaaaccaccuguuacugaggcaccaagcaacccuagaggcaguuggccucuggcccuagcaggagcaggaucucaggccaucccaccaggcagccagccucagccccucaccgcagccuugcagagugggcucugcagagaagccgauuuguggacagugccacccuccauccugagucacauggcucaugugguugcagccauuuuugagccaggagggggccccuucuaggugcagcugaccugggaaugcuagccagagcggccagaggagaggaguugggggaaggagagagguaucucuugcuggccgcgggaucucaucuccuuuugucuuguuuagguuucuccucugccuccuacuuaaagguccauguuaaaacccaccacgguguuccccuuccccaggucuccaggcaccaggagcccauccugaaugggggagcagcguuccacugcgccaggaccuauggcaacaaaggcaagcgaccccuugcucugcacuuugcuucucugcgcagacuguguugugggggcgcugggcugggcguggggaggcgggaaggcugccggcuuucuggcugccuugaggagacucagagaucugaguggcaguggccuccaggacaaaagucacaguggguaucucacuccagggcagugagugaggcuuuagggcacugccgagauccagccuccgccuccucuuccccagcccuccuccuuuccuccuggccagcccccacugucuggagcccugcagggaugccccgggcccugggcagaagaagagcccugcaugaugagucacuaugggccugucacugccugcugcccuuuaggaugguguggagcugcggcugaaugcuuucuccucuuuugacccagugggccggugggagccaaugucuggcuucucucacaguaggagugguugguuacugugaguggcccuuucuggagagccucuggcuaugguugugagaugcauggcaauaaugagcuaucugacuccucugacuugggaguugguuugcagaaagcuccccaggcccaccuucacuuguugauucagguuguuuugugguaugucacguugucguugccuuggggaugaggccaggggcuuggcagaugguagaaacagcagagauggcaugcuccaugcucccaucacagaccucccuucccggcauggcucucuggacccaggcaggaagcugcugauugguggaggacuccagugugggccgggcaaggcagagcagccaggguugucucuuggcccagcuugucuggggccuaggguggggacacccagccgacugaguaguacagaguugcuuucaaucucugugcuugggcugcuuggcccugaaaagguuuuggcagaaggaaggcgguaaggacagggcuauguuugcagcauuaggaaaaggauuggcuucugucugagccauugauggggucuacccagguugaggaccuaauggcucugguucugccugucuugcuagggugcagcuagucuggugcaggaggcgaggcuacuauuacacuggcucggcaucaucagaauaccaauuuuacccucagaggcacccaaaagagcgccuaggaguugggggucuuugaguuguucugggcagcuguagcagaguugcccucucuguaucccuuccuugaagcaggcugagaugacggugagcaguacaugugcagcugcaugaagaguccacagcaagggaggcuggcagcccuagggcccugccguuucaccccuguaggcacuccaggcucccagacugaccagcugacccuccguggguucugccagggcaguggcuggccaauggcugcccuccacaggucugugagcuggccccucaugaccccuccaggagggggcaucuccagagccuggccucaucgcucuccuauauuuuguuuuuucguagaaggccagaaaugcucacaucaggauccgauugagagcucugacuccuauggugaccucucagaugccagcgaccugaagacgccagagaagcagagugccaauggcucuuucuccugcgacauggcaguccccaaaaacaaaauggagucugauggggagaagaaguacccaugcccugaaugugggagcuucuuccgcucuaaguccuacuugaacaaacacauccagaaggugcauguccgggcucucgggggcccccugggggaccugggcccugcccuuggcucaccuuucucuccucagcagaacaugucucuccucgaguccuuuggguuucagauuguucagucggcauuugcgucaucuuuaguagauccugagguugaccagcagcccauggggccugaagggaaaugaggcagcugcuguguccccacggaaacaaccaucuggggacugcugggaaaugcugugaaugcggagggaagugauguuuggguucuguagcugagagauuuuuauucauuuuuaacugccccccaaccccacuccaacuccuucuccaccacccauucucccaauggucuuuagaaauagauuuucaucugauauucugcagaaauaucaaugagacuugguaugggacaggggcagaaaacacuacauaggccuccaaggcaaaaccagucccaguuucuuuaaugggaagaagcuggaauuccuggugcucaauucuuagugaccccaauccuauacccaaaucuaugauauucugggaccucagugauuuugguccccucccacuucucuaguucgucauccucccuucccauauccuucaaaagaaccacacuagggucuccaccuacuuauacaaugcggaugcccaacu

SEQ ID NO: 21270 - RNA, 8918 nt, Homo sapiens
agaugcgagcacugcggcugggcgcugaggaucagccgcuuccugccuggauuccacagcuucgcgccguguacugucgccccaucccugcgcgcccagccugccaagcagcgugccccgguugcaggcgucaugcagcgggcgcgacccacgcucugggccgcugcgcugacucugcuggugcugcuccgcgggccgccgguggcgcgggcuggcgcgagcucggcgggcuugggucccguggugcgcugcgagccgugcgacgcgcgugcacuggcccagugcgcgccuccgcccgccgugugcgcggagcuggugcgcgagccgggcugcggcugcugccugacgugcgcacugagcgagggccagccgugcggcaucuacaccgagcgcuguggcuccggccuucgcugccagccgucgcccgacgaggcgcgaccgcugcaggcgcugcuggacggccgcgggcucugcgucaacgcuagugccgucagccgccugcgcgccuaccugcugccagcgccgccagcuccaggugagccgcccgcgccaggugcgcugcgugcagcacccggcgcacuggcgccgaagggccuggggguugcugggugccgcugcgggagacuccgcuuuucuucucacuggagauaauauguggggaaacugaaggcgcuccgggaaaggugaaggcggucgccggagggacccuccccagccggcccucuacuugcucgauucucuaagugcagaguacuuguaaauugcaaagcgcuuucagugaaaauggguuaaagguuuccggagcugaggggagcgguaccgauguuuagcuguuggaaagauccuggacacaggagauucuccucgccccgcacgggggugcacacggacugcaaucccagggaugcuuggggaugggggggauauaggcggauuuggaccaaggaaggugggcaggcacguuguaggaaauaguaccucucuuuuaaaauacugacuuugcacagccuuuugguuugcaaagcaaugucuagucccgguauguccaaaaacaaguaaaguggauucggguuuugauaucuucugcgguuggaaaaccugaagcugaaaaagaaguaacuucuuaagguuacccagcggccacaacagaguguagguuugaacuccgcgugccacuuucaguaccauaccauucuuacaacucgggccaccccugcaccugcgccgaccucaaacaaacuuccaggugcguggugggugcgggcaauguggacuaagucaauuucaaugacacggaagggaauuggaaucaguccuagggcugucucccuucuuaaucugaaaugggggggggaaugagauguuguuaaggggagccccagaagaggaaaaaugcaaacauuuggcagaguuacccucuuggcuuagccacuaucaguaucaggcagacagcgacucugguaagggcaucacauuguucccuuaaaaaaaggagcggggguuguuuaaauggauuuggcagcuguucuuucaagcauucuuagccagccucaccuaguuauaugagaaauaaaguuccugccuugcacagcugaaggcugggagaauucuccccauccuaauucccccaacuccccaacgaucacguuggacagaugucacugggcaggcccccaucuagggcuagcaggaugaacagucccuuuauaauuuauguagcuguagaguuccacgcccgggugaaguuauuuucuggcucggcaaggcuggcucuguucaccccugagaaaugcuggauucauggaaaggcaagaugccugaaacauacacuggcucuggucagcuguuaaagcugcuggaggcauuugucucucggggcaaaguuaugucauuugccaagugucguacauuauugugcauuuugggguauucaaaaagugaucuuagaaauacugauacacaucgucauucuugggcuuuagcaaucaucaugauuaccaccuuaguagcacuguaguauagguugaugugaguuauaagauuauaaaaagaucuaagugacuucuagaaucuauuugacaaaaaaagguaaauuuucgacagucaaaagucacaauuaucuguugcuuaaauagaacuguuuugucuucaugcccuagucugcagcccaggcauuaagaagaaaccaaggaaauuuaagaaauuacucaagguucuuagaaaagaaguauaaauacguuuauuuacauguucuuagaguauuuacauucuuaguaucucuuuuaucucaguauuuccuugaaaaagaaagcaagcuaagauuaaaagaaauugaaaccaaauccucgcagguagggaccuccucugugaggcucugugcuggacccugggaaugugugcuucccaagguaugaaaccccuuggggaacuuuacagcaggaccucagugagcuguuuggcaggugaggaaacuaagacccagagaggagagggacuuuccuaaggcccuggugagugaccugccaguagccacuuccaggggagagcagagcaucugcagccaaaucauugcagccccagguagcuuucuagaauagacuguggaccagaugggccaccugagcucccugcuaggguuacacauuauagcccuguuuguuguaguagagaaauuucaugacucucaauuguggacuuaagccgaugccuccagaccuuggcaugguccacaggcccugggagcaugggcucugaauguagccuuugauccccauagcggucuuacagccccuccaaguucauucugaagaaggaauggagugagaauccuggcugcagauccagucuugaauuuagucauauacuuaaaauuccaauucaacuguuaacauuccagcauccauuuuaagcaucagacuuucuucauuuagcacuuuuuauuauaaaagggagaucugcuggagggggauuucuccuaccccacccccacccagggaaggaaaagcucuuuggcacuuagaagucugagccgugagugggacuuuggcauugucugcauccaugugcugcuguguucacccggggugaaaaggacucacuuaggcaggcaccagcaagaugcacagggucuguguagaccuugaguuuuagagauguaacggggaccuagaaaacaagccaccaacaugcuugcaugauucugagccccugaggcaaaacgcuuugcagguaauaauucaguuuucccaucugagcuggacaccaagcucuuauaagcguguuuaccugguagcauugaggacgguacuggucaaccuuggaauucccauaagggcuuguuacaacucagacugcugccgccacuccagcguuuccggaguggagaaugugcauuucuuccaaguccccgggcugccgcugcucccgcgggugggaggaccacacuuggaguugacugcaaaauuucugagccggcgcugcagcagccucccguggcucaggucugcccccugccgguggaagaugaagcauacugccuucaccuacugaggggcacugaagcguuugucugccuucuuuaguugcagcuacuuaggaagagcaccugucagauugacuuucaaacagauaacuucuugagguagagcaaccaccauguagugaguaguaugauggaauaauacuucaucgagguauuuuaaaaaaaaaaacucacuuggauugccaacuaauauugucauuuacaugugaccugguugcaacguuaagauuuuuaaaagacugugauagauauugaugacucucauguguuugucucucuugggcguuuuaaggaaaugcuagugagucggaggaagaccgcagcgccggcaguguggagagcccguccgucuccagcacgcaccgggugucugaucccaaguuccacccccuccauucaaagauaaucaucaucaagaaagggcaugcuaaagacagccagcgcuacaaaguugacuacgagucucagagcacagauacccagaacuucuccuccgaguccaagcgggagacagaauaugugagagcuuuuccucuuguuaaaggaggagggcaagaccugccaagccuggguacucagagccucuugagggcaauucuuacucaacaaaccccagcgccuggcugaugggugggcaaccccuagccccucugugcccuaccucucuccucuccuuacauaaagaauauugacccuuuuggagaaucuuaugaggaucaagcugaaauaacacucuuaaaagcauaugggaugucauaaagaccucugcagauaaugaaaaauauucucauaaagauaguuuuauuuacuucauccucuaugcuuguugaccugcuauugguuccauaccagcuucugugccuuacucugggaagagcaaaaaggagacagggagugaugguuagcuuauucgggggacuuucgugcuacaucagacauaagguaucugaggagcaaauuacaggucccacuuuugguaguugugcagcaucguaagauuuuuaaagcacacauucuagaguaaaaacugugacucuguugcucugguccuuccugauccccagggucccugccguagagaaauggaagacacacugaaucaccugaaguuccucaaugugcugagucccagggguguacacauucccaacugugacaagaagggauuuuauaagaaaaagcaggugagugagguccucaguguguuuucuuccucuucuguugacacagaggagaaacccaucucaccagcccccaggcucuucuggccauagcucuaacucugagccugugcagcaccagugcccaggacuuggugccagucucaggaggucagaccaagggcugcuuugacuuguugcucugagugcugcuauauuggccauaauccucaacccuagugccuuuccaccacccgcuucccacuccuguccuuucaaugguucacccacagggcggacaagaugcugcccaguggcacccuuuauaaacugcaaguggacauguuaacacauuuguuaaugcugcgucagggagugacauuucaaacaacuauuauagucaguuuccaagaagugugacaugaggucauaccacaaaaagcuuacccugaaaucccacaaucguccccuuuccuacugaugccuucccgauagugagcagguugcaauauuaagauuuugaaaaggcuguugcuagauguuggugacucgugugucucugucucccuugggcuuuucaaggaaaugcuagugaguggggggaugacugcagcauggccagcuuggagagcccagccauccccagcacauaccaggugucugucuuggcguggaggggauggaacuugaaaucagacacucgguccaugcuggggauggccagucucuccaaacuggccauguggucuuccuccgacucacuggcauuucccuagaaaguccaagugagaagaaggcaugagagucaucaacaucaaacaacagucuuuucaaaaucuuuauauugcaacauagucccauuccuggaaaaggaauggagugagaauccuggcuacacaucagccccaaauguagucauaugccuaaaaucccaauuaaccugaaaaugaucaaacaaauuuaagauauaguaauauuaagcuguaauaaauaugcuucuauaggcuuuguguuaugugauggcacuauuucaauuggcuuucuaauuggacaauugauacuaugcuaucuacagaauuggccuuuggagaccuaagugagccacaguggccucagggugaccauauacuaggauucauaguaguggccacagucagaaagccuaagcuuuccuccauugccauugcucguuuauacccacguuuucugucaaagucauauucauucaacaaagucauacugagaaggugucaugugaggcuggaugugggcuccaaagucauagcugugacauucgcaggcagcggggauguucucagucccacauuuggcagagaagucagucaagagguucuacaagggcugguguccaccuuauacuccuagaaacacaaaacugcccccacccccgcuuucuuggagcaggaaguuacacccacacgcaugcacaggcgcacacucagcgggccuaggcacgcauggcucuuguguugccuuagcugaaauuucuguugugcuuucucagcauagcagagucacgcuggcaaaccaucaugcgcccuggccaccgaccugacaccagacccaggagcauucacuucucugucuucuguuucucucccacagugucgcccuuccaaaggcaggaagcggggcuucugcugguguguggauaaguaugggcagccucucccaggcuacaccaccaaggggaaggaggacgugcacugcuacagcaugcagagcaaguagacgccugccgcaagggugaguacucaggaggggcagccuggggcuccagggccucacuguccuuggaccagccucaggggcugggcguggccacuggcccuuccccaggcuuacagacccaggagcugcagcucagggccagaaagagcaaagcaaauaggacagagcccucagaagggugcagggagagggagaccccaucaacccaaccaaacaaguguggggaaggaggccggccagugcaccucagggacacucugcuuuaucucagauaccucacagcaccuaagcuaucauucauccacacacaaagugaagauuuucaaaguuaggcuuuacccgugaggucuggagguccauuuaucuucacagagaaaccguuuuaauccgcaagaaccugcuaaagauacauguuucuaaauuaaagaugugaaugugagacagcugaaauagcucaguugggagagcaucaguuugaagaugcagcuuuuuuuuucuguaaaauauauaaugaauauucuguuagucuguggcuaauauaauuuuaauaaaguuaauuuaaaucugauagaaaaaugaaauuuuaaacgauaauuuuagagaaugcuauuauauccagucuucuuuuuucuuuuaauaaaugagggaacuauugggggaaaggaauaaauacauuuucuuucauuuuauuaagacaaauuuaguaagcagaagaaauuugcauguuuaguuauaaggguuucuuuuuuccuuacaaguuggaaaaaauaauucuaauuuaaggguaacucuuugacaaugaacacugugagcagcaucugguacucguugcuuuguuugaaaacaugaguugagaccccagcccugcacuugcaggccuagugccauuagccugcaggcugugcuggauaucucagggcaagagucgagcccuuuugauuuuggggggauuauuucaauauauuucuuuuucuuuuuguuuuaguuaauguggagcucaaauaugccuuauuuugcacaaaagacugccaaggacaugaccagcagcuggcuacagccucgauuuauauuucuguuuguggugaacugauuuuuuuuaaaccaaaguuuagaaagagguuuuugaaaugccuaugguuucuuugaaugguaaacuugagcaucuuuucacuuuccaguagucagcaaagagcaguuugaauuuucuugucgcuuccuaucaaaauauucagagacucgagcacagcacccagacuucaugcgcccguggaaugcucaccacauguuggucgaagcggccgaccacugacuuugugacuuaggcggcuguguugccuauguagagaacacgcuucacccccacuccccguacagugcgcacaggcuuuaucgagaauaggaaaaccuuuaaaccccggucauccggacaucccaacgcaugcuccuggagcucacagccuucuguggugucauuucugaaacaagggcguggaucccucaaccaagaagaauguuuaugucuucaagugaccuguacugcuuggggacuauuggagaaaauaagguggaguccuacuuguuuaaaaaauauguaucuaagaauguucuagggcacucugggaaccuauaaaggcagguauuucgggcccuccucuucaggaaucuuccugaagacauggcccagucgaaggcccaggauggcuuuugcugcggccccgugggguaggagggacagagagacagggagagucagccuccacauucagaggcaucacaaguaauggcacaauucuucggaugacugcagaaaauaguguuuuguaguucaacaacucaagacgaagcuuauuucugaggauaagcucuuuaaaggcaaagcuuuauuuucaucucucaucuuuuguccuccuuagcacaauguaaaaaagaauaguaauaucagaacaggaaggaggaauggcuugcuggggagcccauccaggacacugggagcacauagagauucacccauguuuguugaacuuagagucauucucaugcuuuucuuuauaauucacacauauaugcagagaagauauguucuuguuaacauuguauacaacauagccccaaauauaguaagaucuauacuagauaauccuagaugaaauguuagagaugcuauaugauacaacuguggccaugacugaggaaaggagcucacgcccagagacugggcugcucucccggaggccaaacccaagaaggucuggcaaagucaggcucagggagacucugcccugcugcagaccucgguguggacacacgcugcauagagcucuccuugaaaacagaggggucucaagacauucugccuaccuauuagcuuuucuuuauuuuuuuaacuuuuuggggggaaaaguauuuuugagaaguuugucuugcaauguauuuauaaauaguaaauaaaguuuuuaccauuaaaa

SEQ ID NO: 21271 - RNA, 128911 nt, Homo sapiens
aguggggagggggcaagugucagucaggacgggaguccggcggguuacagcggaggccuagguggcagacagggggcccgggccgcugcguguuguccacccaagauggaguuccuccuggggaacccguucagcacaccaguggggcagugccucgguaaggccgcguguggggcaggaggcugggcaacggcggccgcugauccggcuggugaggaccgcgggccuccgccgggcgccggugccacuucacgagcgggcugggccuccgccagccgcgggugccacuccacgagcgggcugggcauccuggucgucgggccuuugccgggcgcuugugccaccucacgggcgggcugggcauccuggucgucuggccuucacugggcgucggugccaccucacgggcggguugggcauccuggucgucgggcguucgccgggcgccggugccaccucccgggggggcugggccuucgccgggugccggugcuaucccacgggcaggcagggcaucuguguccucgggccuccucccgggcacuggugccaccucacgggcgcgccagugccacucugccaggaggcaccccugaggcccaacuuggacucggagaugccccaggcuucccugcccaucaaggcucagcccuuccuuuugcugcuagagguggugccaacugcuggucugcuuccccaaugcgcuuugggagaugccacugcaugugucuuuauccagcccagcaggcucacugccacugccccaaggacccaguucucccaaacccuuugugggaugucaccuucuucuccaucuuugucccuccucuucgguaccagcaacccucagacugggcacccucccagaaaugcccccugcuccgggacuugcuaauuugagcugcaacucagcugugcuguaggagggacugggauaggaggaggggcucuuggagggugauuaucuuggcagggggauggcaugccugcagugccucccaggaaagaagggaggcuguguuauuuaaugauaagagcccuggacugggaaucauggaagccuggacucuagcagugguuuugucagugacuccauaugaccuugugcccuuucugguuugaaguuccccugucugucaaaguguuuggagaugagaugugauagaucccuuaaaguucucaaguuuugauauucuuuguaguacucugcacauugacuguugcuuccucccccaccucauauuaaguuuaccaaagcugaaaucuuuuguuggcaauguagagagaaugguacucagcauuaucuguuaauccuauaggggggauguggacaccuggggacaccagagauggccagaaucauggauaaggaaagcccaaaguguagguaaaggaauacugaaauggccaccauaugggacuuccuuacuaagaaagcaacuugccuuuuuacccaaggcaguggcuuaugccacuugaucagucaagaaugcugauuaguuuguuugaaaacuggauuccuccugguugguugaaggacugguaaaacgucuuuuaugagccaggaucuuugguguucuuaugggccugauuucagcaguagugauuuguuuauuuucugcuuugcuuaugaaauuuuagcuuacuuuccagccuuuaguggagccuauaaacuuauugaggucucuccuguuggcuaauuagcauuuaggagccuuucuuuacuuucuggcguaguaucuuuuauaaugcaugagggaccccaaaagaguguuuucccaccuuuuugacaucuugucucuugcugcccacuggagagucucuggauucucacuuccuuacuucuuccccauguccuuuuccacucucuucaggugcucuugcauggcagccacacuccaaaaacuaauuuccagccaguuaauggagggagccagaaaacuugcgagaauuguuuuccuuucuguccccuuuauaauaggaagcucuacaccuuuaaaaugacaagguaguaaaugagggguagaaguuaaaggggauuuaaaauacaaaugugguugggugcgguggcucacgccuguaaucucagcacuuugggagguugaggcgggcggaucacaaggucaggagaucgagaccaucuuggcuaacacggugaaaccccgucucuacuaaaaauccaaaaaaaaaaagaaaauuagccaggcgugguggcaugcgccuguagucccagcuacucgggaggcugaggcaggagaauugcuugaacccgggaggcggaguuugcagugagcugagauugugccacugcacuccagccugggcgacagagugagacucugucucaaaaaacaaacaaacaacaacaacaacaacaaaaaaccaaauauaagagauauagggauauauagcaaguggaaagagcuugauacuucugucagggagaccuaaguugaauuuugaccuggcccccauuucuuggcugugugaccccagaaaauuguguugcuuucugagguuuaguuugucagucuucugagagagagagagagagagagaaagauuccuauucacagaguaauguaguuuaaaugagauaauguaugaaaacacuuagcauaguaucuggaacauaguagaagcucaguaaauugaaacugccacuguuaauaacagaauauuuaaguuaggguuggauuuucuaucuggagaggauaugugaaacaacuggcccgucugugaccugugaaggaaaauacccuaccaggccccaggauucaccauugcucauaagaugcuugacuaaagaugaugauggcuccccacugccagguagccaauaggucauuucaguucaguucagguaaaugauuaauggacagaauuagguucuaauguauauuccguacuguugugacaaagugucaaagugacuuucuugauauuuaguguuguuaguauucuuuuaaaagaaugugcgggggugggggauuggugggagggagggggaauacagaaauaaaauaacaacuacaaagcuaaugauuaaaaacagcagcuguaggcugguugugguggcucaugccuguaaucccagcacuuugggaggccaaggugguggaucacuugaggucaggaguuggaggccagccugaccaauauggugaaacccugucucuacuaguaauacaaaaaugagccgggugugguggugggcgccuguaaucccagcuauucaggaggcugagacaggagaaucgcuugaaccugggaggcagagguugcagugagccaagauugugccaccgcgcuccagccugggcgacagagugagacucugucuccaaaaaaaaaaaaaaaaggagagcuggucccucucugaucccuguccucaauggauuuacgguuucaggagagaagacagagaugcaugaaacaaugagugguguagauuguaagugcugaaggagucagaaacaauucagaagaggcuggggugacagggacuggcuucuuugagucugagggcuguucauaaaggauggguaggaacucugcaugcagaaaacaauaucauugggccuagggacagcugaaugaggcagggaguggggcacaggcacaucugugaguaccagucugaauggagcagagguggcuguggggagugguggcaaguaggguuugggcacaggaggaagcccugcucuggauggguggcaucaaagacuacauucuuuuuuuuuuuuuuuuugagauggagucucacuucaucacccaggcuggagugcaguggcacgaucuaagcucacugcaaccuccgccccacaaguucaagcgauucuccugucucagccucccaaguagcugggauuacuggugccuggcaccgugccgggcuaauuuuuguauuuuuaguagagacaagguuucacuaccuuggccaggcuggucuugaacuccugaccucgugauccacccuccuuggccucccaaagugcuaggauuauaggagugagccauugcgcccggcccaaagacuacguucuuuaacugacuucaacuuuuagucucuuuggaccuaauuuucccugcuuauaaaauaauacuucucaacagcugcauggggcuuacaccuaaauaauuuugucuguucacuucaguaggcaguuaugagugccuguggggggccaggccugugccaggcucuggggauacaaauauuaacaagcugcucuuagggagccuucgguagagguaacaugcucacaaaagguguccugggucugucugagcgguugguggaguaauucuuacucugucuuaugcgugggccucaugugaacauucuaaccugguacgauuuaguagaacacuuagcguguucaucucaaguuagcggcuaagaccacagucugacauaguuaacugugcauuucuugcauccaucccgcccuuuauucuggagggcaguuccugaguagaaagcaugguuuagggagagaguaagcuggacaggugcgguggcucacaccuguaauccagcacuuugggaggccguggcggguggaucaccugagguuaggaguucaagaccagccugguuaauguggcaaaaccccaucucuacuaaaaauacaaaaauuagcugggcaugguggcacgcgcguauaaucccagcuacucgggaggcugaggcggaagaaucccuugaaccugggagguggagguugcagugagccgagaucgugccauuugcacuccagccugaaugacagagcgagacugcaucuccaaaaaagaaaaaaaagagagagaaagccuagccauggugugcgaggcuaagaagugugguggaagaaagaguacuuacuuguauuucuuaauuuucuguucugcaacaagcuucaaaauguuaacugucuuaaucucagccuuccacaacugcuuggaguuggaugacauacauggggaguuccccaagucagguccauugugucugcagcaguuugcaguuuuccuuguguuggcuagaaaaaguuuucagaaaauccuuuuccaagaguaaaguuuagauucaaagaucagugaguaguuaguuaauucugaccagaauauuggggguggugggcauguauucucuucauuguucugcuuuaauaaacaggcaagaagcagauauucuguugcagaguuuguuuguagacugacugguguuggacauaaacuacuucauaauauccugugaaugguagacguuuaaccuggcuauuuguaccaagaauaguuaguugucccucagauugcuauguguauuaggguucucuagagggacacaacuaauaggguagauguuuauauuaaggggaguuuauuaaggaguacugacucacacaaucacaagaugaggucccacaguaggccaucugcaagcugagaagcaaggaagccagucugagucccaaagcugaagaacuuggagucugauguucaagggcaggaauuugcaaagcccuuuugcuucagucauuuuauuuaguguucacaaccuugugagauauacaggaagauaacuggaaggaacuuauaauuauuaaguaccaacuauaugcaaacucuguacauagaaucucauuuaacccucacaacauuuaacuauuuggguguuaucaucccuguaucacauaaggaaaucgaggcucugagaaguuaagagacuugugcaaggucaauggcagagugaagccuagaaucuacuccugauccagugcucauucugugcugccauuuauguuacuuuuugcacucugagcucaugauucagccgcaagggaaucaccuggagggcuuguuaaaaguggauccuacccucagaguuucuguuucaguagguuuggggugggaaguagcauucuacauuucugucaaguucucuagugaugcugaugcuacugguucacuucgagaacuguaguucuugcuuugaaguucuguuucuuuaaucuuuucuuuaucuuucuucaaacauuaaauguagguuuucuuguggacaggcuaaaagagugauuauuuagaauuuguucauuuauuuauucaguggcccuguacuaucuguauauagcaagcugagaauuucccaguguguagguaucuaaauuagaucagauagaaaguaguugcaagauuggauagauaaaugcaguaaggaaauguaggaggggaggggugaccucaggugguaauaauaauagcuaaaggcuuuuggguuuuuuguuuguuuuuuuguuucuuuguuuuccagauggagucuugcucuguugcccaggguggagugcaguggcgcgaucucagcucacugcaaccuccaccuccuggguuuaagggauucuccugucucagccucccaaguagcugggauuacaggugcccaccaucaugcccggcuaauuuuuguauuguuaguagagacaggguuucaccauguugaccacguuggucucaaacuccugaccucagaugauccacccaccuuggccacccaaagugcugggauuacaggugugagccaccaugcccggccccguuuuugggguuuuaaaaaaaguuuaauguuguauuccuaugugccagagacugaagugggcacuuuauacaucuugcagucauucgauccucacaacaaugcugugaggaagguacugugauuaucuccauuuucagauggggacauuaagacaaugagaaaguauggaaccuaccuaaggucacacagcuagcagugagggagcuauagucugaaugcagcauucuggcuccagagcugguauccugucacgcugugcugcccucagcaagaguaaagugaggaggaacacuguaggagggaaggaagaacucaggaaaacucugaggagguggugucugcugagcagggcuuugaugaauggggaggauuugguuuguguagaaauggaaaaggauguuugguuucuuggcagagacaacuugagcaaaugcuggauguuaagagguaggcgggggugaugggauuuauucugugugccuagcaaaggggagugauagggggugagacugggaagggaggauaaggccugauuguguggagggcuugcuucauauguuggcuaaguaguuugaacuauauuuuagagguacuggggaggcaugaaagacuucuagggaggggaauagcauggaagcaugaauaucauuacagagguagggagauuucuccuuagcagucaccagaagaucauucucucuaccaugaaagcccgcuucugugcagaauuggggagggaaggugggggaaggaggggggaugucagcuguggucaaggguagggacacugucuaugaagcccccucagaaacagaaaggugccaaggcagguugauggagcauugagaagaagucuagucuagagcauuuguccuuaauugccuggacaggucuuaaaaccccugacauugaaagucacguggggcgucagccugcuccuccuccugcucuguuuaucauaugcaaugacagggcugaccuauucccagggcuuuucuagaggaaugccacugcuuaggagugggcuaucggaauaucuaaaauucucauauaauugugcuuuuuauuuauuuauuuuuuuugagacagggucuugcuuugucgcccaggcuggaaugcaguggcaggaucguaguuaaagccucaaccuacugggcucaagugauccucccgcuucagccucccaaagugcugggauuauagguuucagccacugugcccagccuuucauugugcuuuuuacaaaacgauguauaaccgauagaaaauaugaaagauauagaaaaaaugcaaaggagaaaaaaaucuccacaaugugcguccucacaaauuuguugagaugcuuauuucacauaauggaauacuuuuguauuucacucuucaucuucucaugccuugaagaggcgacauuguagaacaacuuuuagcauauuucuguauaaucuacauuuauuuauuuauuuacuugggauauuaggaaaggaaaacgguguaaauacauugcccagaggagcaucaguuagggguuguugcucuugaccuagcagauaaaucacccagaaauguugcgcuaaccuaguagucugagaagauauaaauaacauucaggcuuuuccugcugacccggcuuguugagguuaaaagaggcgacuuuuaaaaccagucucagacuugguuacauauguuauugcucccuccaaccuucuugauuuaggagauucucugcuuuucuccauucagucaucaagccugaugcccaucagcccucaccucuuccuacaggcagccuuccuagaccacccuguuuauggugaugaaucucuucucugagcucacagugcuugcuauccauaucauucauuuggcucuucucuuaucuauaaaacagaaaauauuacuuguccuccagguuuuugugacgauuaaaugagauaaugugcuuaaaaucccuagcacgguguccugcaaucaacuaauauagacuucuugauuccuucccuccacuguuacuguuguuauuuaucuuguguuauuuaucauguguuuauugccauaccuucugaauaaggcuggaggcuccucuacuuucuguuuccuugugaccuucacagcacaugguagaguauauucuucauaguuauucacucuuuuugucacugguauuuagcaucuuugaaagcuaacauuacuagccaucauuuccuggccccucaccaugugccaggcaccuugcugagugcugugcauacuuaucucauuuaaaaauuuuuuucucuggaagcacuguuaucuucaucuuacaggugaagaaauagagacuuaaagggguucagaaacuugcccaagguuuccuggcucaaguaggcggagcgguccucuccagccaggggcucuagcuccagcguuuuucuuuguucauguugccuuuuagacaucaagcauggucuguuuccauuuggacaagaaggagccuaaacugauuucaaauaggaauuccagaaagauagcauaguuccaccaauaggaauguggauucccauugcucucucuuuguucucuuccagcacuuagcacucuuuguucuagauuggagucagucccaucuuugcuucucgaugcgacugcuuuuguaugaguccaguaacugugcuaaaacucaguuucccaaucuguaaacugugguggugaagggaguacaagaacacuugcaccaucacaucuuacaggggucaagugaguauguaaaagcaaaauguguuguuauguuuuacaucauuuagacuaaauguuccaugagggcaccuguuucuauuuauucuuuaaaaaaaaaaccugauaaaauauauauaacaaaauuuacauuuuuuuuuuuuuugagacggagucucacucuguugcccaggcuggagugcaguggcacgaccucggcucauugcaaccucugccucccagguucaagcgauucuccugccucagccucccaaguagcugggacuacaggcacgcgccaccacgcccagcuaaauuuuuugcaauuuuaguagagauaggguuucaccauguuggccagguuggucucgaucucuugaccuugugauuccacccaccucagccucccaaagugcugagauuacaggcgugagccaccacaccaggcccaaaauuuacaauuuuaacugguuuuaagugugcaguucaauggcauuaaauauauucacauugggccagucgcgguggcucaugccuuuaauccuagcacuuugggaggccgaggcggguggauugccugagcucaggaguucgagaccagccugcgcaacacggugaaacccugucucuacuaaaauacaaaaaaauuagccgggcauggcagugugcgccuguagucccagguacucgggaggcugaagcaggagaauugcuagaggaggagguugcagugagcuaagaucgugucacugcacuccagccugggugacagagcgagacuccaucccuaaaaaaaaaaaaauaugcaacaaucaccacuggccaucucuacaacucuucuagucuugcaaaagugaaacaauaucucccuguucccuccuccccccagccccuggcaacuaccauuuuacuuugucacuaugaauuugacuacucuaggaaccucauauaaguggaaucauauauuuauuaugaaaccucauauaaauggaaucauauaguauuuauccuuucaugacugacuucacuugcauaaugucuucaaguuucaucucuauuggagcaugucaaaguuuccuuccuuguuaaggcuguauaauauuccauuguguguuuauaccacauuuuguuuauucauucuuccauugauggucaccugaguugcuuccacuuuuuggcuauuguaaauaaugcugcuaugaacaugaauguacaaauaucuauucaugucuguuuucauuuuuuuuuuuuuuuugagacggagucucgcucuguugcccaggcuggagugcaguggugcaaucucugcucacugcaagcuccaccucccggguucacgccauucuccugccucagccucccgaguagcugggacuacaggcgccugccaccacgcccggcuaauuuuuguauuuuuaguagagacaggguuucaucguguuagccaggauggucucgaucuccucaccucaugaugcgcccgccucggccucccaaagugcugggauuacagguguaagccaccgugcccggcccuucaauuuuuuuuuaagagacacguucuccuucugucacccaggcuagaguacaguggcaugaucauagcucccugcagccucgaacuucugaacucgagcaauccuccugccuuagucuccugaguagcuaggacuauaggcaugcaccaccauucccagccaauuaaaaaaaaaauuauuuuuuuguaguggcaaggccuccccauguaucccagacuagucuuaaacuccuggacuucucggacucaggugauccucccaucuuggccucccaaaguguugggauuauaggacgugaaccccugcacuugguucauuuuuuuuucuuuauaguagccauccuaauggguaugaauuggugucucauugugguuuugauuugcauuuucuucaugauuagugauauugagcaucuuuucaugugcuuguuggccauuuguaugucuucuuuggagaaaugucuguucaaguccugugccuaguuuuuaauuggguuuuguuguuguucgguuuuaggaguucucuauauauucugaauauuaaucucuuaucagacaugugauuuacaaauauuuucucccauucuguggguugccuuuuuauacucuguuuauaguguccuuuaaugcacaaaaguuuuaaguccaguuucucuacuuuuucuuuuguugcuuguaccuuccgugucaugcccuuaucuuucagucgaaucuaacacaaugccuuaaagauaaggauggugcuauuaguagcagucagaaugucucuccuuacuagguacuggguuauguaguuuacaugcauucuuuucuuuaauucccacaacaauucuguaaggcagguauuaucacucuauuuuguuuuuuuggagacagacucucacugugucacccaggccugucagucauauuuuaaaagacuaggaaacuaaggcuuagaagugaaauaaccagcugggcucacuggcucaugccuguaauacuaguauucugggcagccaagaugggaggaucacuugagcucaggaguucgagaccagucugggcaacauggcgaaauuccgucucuacaaaaaaauacaaaaauuagcugggcaugguagcaugcaccuguagucccagcuacuugggaggaggcugaggugggaagauggcaugagcccaggaggcagagguugcugugagcugagauugugccacuacacuccagucugguugacagagccagagacccugucucagaaaaaaaaaagucaaguaccuuccucaaggucuguggauuaucaguggcagagcagggauuugaacccaggucugugggcagcagagcuggugcucuuaaccacuaaaccagagagcuuaguauuguuugugggauugagugaaugaaugccugaaugaacuugguagcugaaaaaucuaguaauaguugucuuaaauccagaccuacacuaguauuguaaauuauguacucaguuucaguuuuccuccuguaacucaguguacaaguguccucuucauaccaguaaguuuucugagaauuuccucaaaggacgugcuuucuuauauccucgcugaggcacuucuuaguaauggaagaccuguguauuuuacuuucucuuuggauuugccuuagaacuacagugauggauggaggaaaagacggaauuuaaacacaugcuaaauugucuaacugaccaacuugcuuuuaagacaucaccagcugcucuuuuaaucauuaaugaagcauaagccuuguagucugggaggcaugucaaaaauucuguuucggguuuugguuuaaaauugaguguaauggagagagacugauucuuucaucucagagaauugggcugucuuugagagcuggggacaagaacuggguccuguaauaggacacuguggaguuuuuuuugcugcuccucaaaggagaaaucacacagauuucuggcacgucauuagucgaaauaggaaaugaggccugagaaaugauguugcuugggguuugaaagcugaauuugcuaguggcuuccagagagcgagagucuccuaugcuaacuguggaaauucuuaaaccagcaauucaaagaaucagaagacucuaguugaaagggucuuagugguauuugguccaacccucuaauuuuugcagguuguggaaacaaggccagagagggugucugugauguaugacauuucugacagcaaaugugcagggauuuuuuuguuguuuuugucuuuuuucugauaucaaauggauguccuacaauugaauucaguuuugacacuaacuaccuggagcuggugcggaccccagagguuaagggcucagucccacaagacugcccccacuucacaugccagucacaaguuccugguuaccaucuguacuucccaugaccggcuauaaauuggggauucccgugaugccuuccccauguuugaucauaugcuugaauggcucacaaaauucaggacaacacuuuacuuacauuuucgugacaaaggauauaacucagcaacagccaaauggaagagauucaucgggcaagguguggggaaggggcagagaacuucugugccagccucccagcaccuuuauguguucaacuuggaaguucuuugaaccccaucguuuagggguauuaauggagguuucauuaugugggcaugagugauuaaaucuggccauuggugaauaacucaaccucuagucccucuccccuuuccggagguaaggugggaugaggguacggcuaaaaguuccaacacugaaauguaccuuggucuuucuggcuagggagccccaaucucauuagcauacaaaagacacuuaucucucaggagauuccagggguuuugggugaggugugccaggaaccuggacaaagaccaaauauauauuucuuacuguaucacaguaggagacuugccaaggucccacagugacucaguuuuaugacucuuacaugucuuccuauuuagcucacagccucuugccagucauuuagauauuuguauaugggcagggaggguaagcaugggguaguaagucugucauuuuaauggaguggaaauuuucaacucagccucaugaagguaaauacauuuuauuguuugaaaguuagucuccuguuuuugacugggcuugguuggggguacuauuuagcucuagauuugaugguuuaaaugaaauuagcucauaaaaucaccaauggucuucuguuuuaucuacuuuuucuggcacugguccagaccagagaaaccaaucccaggcuaggacugggaaagucugggacuguucacugcucugcugcugauuugcugugagacuuuggguggggcacauccugucaguuacucauuugaagagcaugguuuguucguucguuuguuuugaagaacagagguugaacaagcuuuccaaguucauuucagaccuaaagcuuaaggcccaaaucaaaguggcuuuuaguuuuucuuuucuuuuuuuuuuuuuugagacagagucuugcucuguugcccaggcuggagugcaguggcacaaucucgacuuacugcaagcuccaccuccuggguucacaccauucuccugccucagccugcugaauagcuaggacuacaggcgcccaccaccacgcccggcuaauuuuuuguauuuuuaguagagacgggguuucaccguguuagccaggauggucuugaucuccggaccucaugauccgcccaccucggccugggauuacagucgugagccaccacgccuggccuaguuuuucuuaagacuuacagcuuuccauaagagacuguacauaccuaugaaucauauguguguguacguguguguguguauagccugugauauguaaguauauacacacauguaaauacaugcacacagguaaauauauacauauacauauuuuauauauauuuuauauaaauauguuauacuuuauauauauuuuguguaaauguauauauauuugccuucuaaugauuuucacugagguaguuuacuuguaguaaaaugcauacauuuuguuauaauuuugacacaugcuuacauguugucaccuuaccccaucaagauacgcacugucaaccucaccccagaaagcucccucaggucccuucccaguuaauccucuccuccaacacacugcagagggaaccacugaucuuuuaucucuucuagaaguucaugaguggagucauacaguauaugcucuuuuguguugaaucccagugauauuuugaagaagaaucauaugcauuguuuucucuaccugccauuuugaaaggcuguauaagggagugguggcucaugccuguaaucccagcacuuugggaggccaaggcaggaggauugcuugaggccaaaaauuugaggccagccugggcaacauagcaagacccuguuucuacaaaaaauuuaaaaauuagcugggugugguagugcuacucccuguaguccuagcuacuuuggaggcugaggcaggaggauugcuugagcccaggagguggagacugcagcgagcuaugauugugccacuguacucuugagaggugacagcgugcuggcagccguugcucgcucucaggcgccuccucagccccgaugccuucucuggcugugcuugaggagcccuucagcccgccgcugcacugugagaaccccucccugggcuggccgaggccggagccgccucccucagcuugcagggagauguggagggagaggcgcgggcgggaaccgggcugcgcguggcgcuugcgggccagcgcgaguucugggugggcgugagcucagcgggcccagcaccgcaggccccgggcagugaggggcuuagcauccaggccagcagcugcggagggugugccauucccccagcagugccggcccgccagugcugugcuggaauucucgccgggucucagcggucucccugcggggcaggacucuggaccugcagcucaccaugccugagccucccugccgugggcuccuaugcggcccgaaccuccccaaggagcgcaaaccccugcuccacugcgcccggucccaucgaccgcccaagggcugaggagugcaggcgcacugccagggacuggcaggcagcuccaccugugacccaggugugggauccacugggugaagccagcuggguuucugagucuagugaggacuuagagaaccuuuaugucuagcuaagggauuguaaauacaccaaucagcacucugugucuagcucaagguuuguaaaugcaccaaucagcacucuguaucuaguuaaucugguggggacuuggagaaucuuugugucuagcucagggauuguaaacgcaccaaucagcacccugucaaaauaggccaaucaggucucuguaaaacagaccaaucaguucucuguaaaauggaccaaucagcaggauguggguggggccagaggcaguagugguaacccacuuggguccuuuuucgugcgggggaggcuuuguucuuuugcucuuugaaacaaauguugcugcuuacuccaugaguccacugcuuuuaugagcuguaacacuggcugcaaaggucugcaguuuuucucuugaggcuggcgcagaccacgaacccauugggaggaaugaacaauuccaggcgguaggagcgaacaacuucagacacgcugccuuaagagcuguaacacucaccgcgaaggucugcagcuucacucuugaagccagcgagacuacgaacccaccaggaggaagaaacucagaacacagcugaacaucagaaggaacaaaccccagacacgccgccuuuaagaacuguaaaacuaacugcgagggucuauggcuucauucuugaagucagugagaccaagaacccaccaauucuggacacacucuagccuggguggcagagcaagacuccaucucuuaaaaaacaacaaagaagaggcugggcgcaguggcuuaugccuguaaucccagcacuuugggaguccgaggcaggaggaucacgaggucaggagaucaagacuguccuggccaauauggugaaacccugucucugcuaaaaauacaaaaaauuuaucugggcuugguggcgugugccuguaaucccagcuacgugggagauggaggcuggagaaucgcuugaacccgggaggcagagauugaggugagcagagaugucgucacuguacuccagccuggcgacagagcaagucucuugucucaaaaacaaaaaaaaaaaaaaaaaaaaaaaaaggaauuguguggucugggguccugccguucccacuagcugcugugguuugagaagugagggcccucugccggugaccaccauauugucugcugaguaugauagaagagguggagagaacagcuugauuuccagauucuagguugaguuuguuucuauaauuguuggugucacagucuucucacuugucagcugggcaaaucagauccaccagcagaugagagacuaacuaugacacccgaaaaugucacuugugauggcacauuucugacaaggugcccaugagaugcaaucauuucaauuccauaaaugcuuuuugaacauaaagacauugcucuagggugagcaacagcaaaagaaacggaggucaggaaggggcugagcaaauggauggaggagccacacugccauggagguucugggaccucucuuggccuuagagcguaguaucugugugagaguuuuuuguuuguuuucauaauguguuuagcauguguuugcucuuaguuuucuccuccucuaacuuaguccagcccuuggucaugccuggaccauugcuugaggcuguaaguuagaccaguucaauaccaccuagcuggucuccuccuucauauucucccucccuuucuacacucuggaaccuuccaaaacuuuggacaacucuaccagaaaauuucuggaacuccccaucuccuuuagaaugauuuauaaauagggccaggcgcgguggcucacacuuguaaucccagcacuuugggaggccaaggugggugggucaucugaggucaguaguucgagacuagccuggccaacauggcgaaaccccgucucuacuaaaaauacaaaaauuagcaggacauggugguggguuccuguaaucccagcuaccagagaggcugagacaggagaaucauuugaaucugggaggcugagguugcagugagccaagauugcaccauugcacucuagccugggugucaaaagcgaagcuccaucacaaaaaaaaaaaaaaaaagaaugauuuauaaauguagccugguguucaaggccuucacugacugggcuucuucccgucuuuucucuuaccaaggucucuacuuacuuugccguucccacucccuccuuuucugugcucagcauggccuuuggcccugcaaagcaucccuucucucuugcucaugguuuagaccaauauacccuuugaaaccuaaccuagaucuucccacugccacaaagcuggcccagaagccucugaacugcaguggcacuuauaacuuauauguauuuaauaauuaucugacuauuugaaugcacuauguugagccggugggauuuugaauucaaagaugaacaaugcuugcccuguccuaugccuguccugagaguggcuaacuguacaggguacaagggaaggcauccuugugugacuuggaagaagaggcaaggcaaugaacaugcauagagcaccugcuugugcaggggacugugcuguguucuuucaagauuuuaucucauuuaacccucuugacuuugugagauggcauuuuuaccuguguugugacuuucucagaaucacacaaccaacaggauugaaacccagugaggcccacuacacacccuaugugcuccccccacucaugugucuucauguguguugggcuggugggggcaggucagugaggucagcugugggcuguuucuacaccccauccaugugcaugcuguggggcacagguuuccuccuggguuaggggccaggugaugcuuaaggcucugcccccaugguggucccuauuugggaucugccucuuaaacaguuggugacgccuuuugcagggacagugguucucuguccuccugagguggggaaagugauccggggcacuccugcuugucucuagcaccuuacaggaauacugcagcaaccaaacugcugcuuccugauuaauucaugcucaaggaccagaaugacucucugcagucuuuuguuuuuauggugguaaaauacacauaacauaacauuuaccuuuauuuauuuauauuuuuuugagacagagucucgcucuguugcccaggcuggagugcagugacaagauuucggcucacugcaaccucugccuccccaguucaagcaguucuccugccucagccuccuaaguagcugggauuacaggugugaccaccacgccuggcuaauuuuuguauuuuuuuuguagagaugggguuucgccauguuggccaggcggucucaaacuccuggccucaagugaucugcccaccucagccucccaaaugaagggguggggaccagucuguugggcauggcgucccagaagccccauugcagcccuauuguggugggcaggcugcuuuugagaauguguauacaccuuuucaaccuuccuguucugucagggcagcggaggaggaagugugccucagguggcuaaggggccuuccugcagcaggaccagcauuccauguugcuucuuacuccaguguuccucuaccccagaggcugccuucucuuuggucuuuugugcauacugggcauccuaaagcuguuuguuugcccuucagugaaugggacugacacagagacccauuuuuguuuuuaaaaauuauaaaauauaggcugggugugguggcucacaccuguaaucccagcacuuugggaggcugaggcuggaggaucuccugagcccaggaguuugagaccagccuaggcaacacaguaagaccuuguugcuacaaagaauauuuaaaaacuuagccagggguggcagcacgcaccuguggucccagcuccucaggaggcugaggcaggaggauugcuugagccugggaaggucgaggcugcagugagguaagaucacaccacugcacuccagccugggaacagagugaaauccugucucaaaaaaaaaaaaaaaaaaaaaaaaaaaaaaaaagaaaauaaagaagcacuuacuguauaaagagugagcccuuaauuucucagcccaacuaggcuccccagagguaaucagcugcuuaguguguggcgcauguuccaugaaguuucuuuuguauaaaugggauccuacuguaggcuucauuuuacagcucgcuuuuguuuugccaugucauuguacauuuuggagaccuuuccauggcaacauaauuagaucuaucucauugugcaagcauuccacagaauggauguacaguuuauauagccauccuccuccuggugggcaguggcuuucuuguccuuauaaguaauacuggaacagcauaucuuugugcauuucuauauuuguguaguuuagauuccuagggacaaaaugcucaugucagacuauaagaguauuggaaauuuugauggagacugccaaauugcccucuaaaugagccccucaccaacagagcccgagugacuguuugccuugcacucucaucaguacugggcaucuuuuaauuucuacacaucugaggaggggaaaaggcauuugguuguugguccacauugucuaauggaaaaccaccucuaagauguguggaugaaaguugccuucggcuaacuuccuuccuaagcaccacguccccauggaaaugcagagguagagaaugccugcugguggagcugcccagacucguuccuccugcauccuuggccuccccuugcccuguaaaaaggcuaugcaagaccuuuacguuucuugaaagguuuuuugcuaaaaacccuuuggucaccauucuucaguuaauuuucauaugguuuuuauuuauuugccuuaccugucugcuacuccugaggaaaccaaauuuuucuguugccacuccagggcagcaacuuuuuaugcacaaacucaaauucccugcauuuuacuggugacacaugaggcuugagaaucuacagugucuacccaaguacuaaauguuccuccuuuucaucucuaacccaguaagacaaagugagaucaggcauuuuguauauucuuuaauucuagucagaacagagaaguaugauucuguuuccucuaaaucuuaugaacguucucagagacuggaucucagaucuggucccugccagaguuaggaaagggcugggugggcgagggaacugccgucuacugggugcuggucauuuuccuugcagccccgcaagggaguggguauuaucaucuaggauuuauggaugaggcugauugacaucccagaagccucucagggaguagguagcagaaccaaaacuugaacaggucugccccacacuaaagcccuuaccuggcuuguuagguuggcuccagguagaucccuggagacauccugccagggaucuucccccuaguggggaagaugaaacagcacccccuuccugguagguccucccugcccauaggccaccagaaagaagaaacugcagugucugaucuuucuuuucccucugcaccaaggcucuggccuagguuuucccagaucuugcaguuuccauucuccuggggacuaccuucaugguuuucccuuaucuaugagccaccuaugcugucacagauuuucuguguauugacuaacuuuuuuuacuugggcacauuuucuuuuaaaaggcuucuaucacucucaauugaaaaguaguuucacuuggcauuaaucuaaaguaacauaaaaauuaaaauaaauaaauacauugaaaucaaagcaagauucuucuagcaggauccuguugucugccuaaggcuccccgccaagacucacucucauuagaaugggagcauacaaaguauuggaacagcgaccaggugcagugccaugccacuuaagcccaggagcuugaggccggccuugguaagauagcaugacccugucucuaaaaaaaaaaaaaagagaggcuaggcauagugacucacgccuguaauaccagcauuuugggaggcuaaggcaggcagaucacuuuaggucaggaguucgagacaagcgcggccaacuugguaaaacccugucucuacuaaaaauucaaaaaaaggagccggguauaguggugcauuccaguaaucccagcuacucggaagacugaggcacaagaauuguuugagcccaggagguggagguugcagugagccaagagcgcaccacugcacuccagccugggcgacagagugauacgccaucucaaaaaauaaaaauaggccugguguggugacucacaccuguaaucccagcacuuugggaggccgaggcgggcagaucacgaggucaggagaucgagaaacauggugaaaccccaucucuacuaaaauacaaaaaaaaauuagccaggcaugguggugggcgccuguagucccagcuacucgggaggcugaggcgggagaauggugugaacccgggaggcggagcuugcagugaguugagauugugccacugcacucuagccugggugacagagcaagacucugucucaaaaaaauaaauaaauaaaauuuaaaaaauaaaaauaaaaaauagagagagagaacagauucaguguuauaacauugcccuggcccaccuaaacuugcccacuggugaucugcaggccacucucugaggagugcucuucugccuucuggccacuggacugugcaccuuuucgggacacaccaccagccuucuggccguugcuucuguccuuccuuccccaggauggcugucucaucugcuucucgcuuaugugggagauucugcuccugcaaggugaggcuuggaugccacacuuacugagauauguccucugaccagagagccacugucuucaccccaggugcccugaugacucccuguuaacuuuuuucauauacccacccuggcacaggucagauuguagcaucggaguggggugguauuuauccuguaagacucuagcugcuggaaggggcacuuuguaacauuuauucuccugacccaguugggccuccuugggggcugagacaggcucuugucagagaugaagccuugugauguggcauugucugcacugggcccuaugcucuaugcucugccgugcuagauguucaguaaugucguggauggugagcuggguuuuccuggcacgaguuccacacugcuguuccccauuggagaacaucaccuagcacugggaaaagaugaagguggagacccuuaauggcagguggcaagaauaaauauauuugggguaaaaggcuccugugugagaaacgcauggcaugaaacccacauggagggucccugagaacacucaauuaaggugucccugaccugcuuucaccucauggcuccagcuccccauucucuggucuaugggacagucacucuguauguggccccuucuggcauuuugaccccugcuuggcacucuuaacuuuuuggcuuugcccaauacuuacucugagcagcccuggcucuguacuccaacucuuuccccccaccccucacagggucagcacagaucaugggggucuuugauccaucaggcaauaggagggaggcuggguguggagagugugggguugauagggggaagcaagcccuuccuaggaccccugccuugcucugggcacuccgcugaucucacucuuagcaagagggggugugaacugaaggcagagccacagggcugcucagcaaggcugugcucuggggcugcuuucacucuaagaaagggccaccuuuuuuuuuugaggugaagucucacucugucacccaggcuggaguucaguggcauggucccagcucacugcaaccuccaccucccggguucaagucauucuccugccuuagccucccgaguagcugggauuacagacgugcaccaccauaccuggcugauuuuuguuuuguauuuuuaguagagacgggguuucaccauguuggccaagcuggucucaaaccugaccucaagugaucugccugccuuggccucccaaagugcugugauuacaggugugagccaccacaccuggccaagggggcacauuuuuugauugcacagaagcuccauaugggcuagcagcagcucuggggggcuauugcccuccccagcuguacuugacacucucuccaagguagggacuagggcguauuuaucuugguaucaagauuauccaguacagcaagucucagugaaagguugauaaacagaauuuaguacacuuggucuuucaaaaugaaacuauuugacuaaggaacuuaaugaaagacaaacauuguaucaugauacagucauuuaaugucucugagccuuaguuuccucaauuaugacuaauauauaucucuuagaauuguuuaauguucaaauuggauaaugcauguaaagcacuugacucauuaauuuucuuuuccuccaucaaaaguauuucugaaaugaguggauucugaauuuggacuguaaccagguauauucuggaaagaguauauauuuaaaaaaaaauagaacaaagauuuuucuuuauuuuaacagugugaccccucaugcuaccaaaagaaauuaaaaaugaauacaacuuguuguacuuucuggaaagaacaaaaucuucaaaaucagacuucacuuugagucccagcuccaguaaccucuuugagccugagcuuccucaucuguaaaaugaggauagaaguccuauuuuuaaaaguaugugucggggcauuaaaugagacguuugcuagggcuaccauaacaaaauaccacagacuggaaggcuuaaccgaacuuauuuucucauaguucuggaggcugaaaauccaagaucaagcugcagguuuggcuucuucagaagccucuuuccguggcuugccaacagcuacugucuugcuguguccucacauggucauuccucugugcaugcaugauuggauuagggccccauuuuaacuuaaucacuucuuuaaagacccugucuccaaauucaaucagucauauugugagguacuggugcuuagggcuucaacaugagaacuugaggauggcacaauuuagccuacaauauuugcaaaacagaaagcucacuggccugggcacgguggcucaugucuauaaucccagcacuuugggaggcugaggcagcaggaucacuugagcccaggaguucaagaccagcaugggcaauauagugagacccccccaccguauaaaacugaaaagcucacuggaugguaguagcucuuccuauuuaaaucccaguucuaguguucuuuccuguuccuugcugaagauuguauuuacugugugggauuguccugagggcugguauaacuaguuaguacuuuccuaacccugaggcacuucuguuaaaauuagaucaacacuuaggcuggcacgguggcguacgccuguaaucccagcacuuugggaggcugaggagggcugaucacuugaggucaggagcucgagaccagccuggccaacgugguaaaacuccauuucuacuaaaaauacaaaaauuagccaggcgugguggcacaucccuguagucccagcugcuugggaggcugaggcaggagaauggcuugaacccaggaggcagagguugcagugagccaagauugugccauugcgcuccagccugggcgauagagugagacucugucuuaaaaaaaaaaauuagaucaauacuuagaccaauauaaugagcugauguuuagagagcaaaacaggccuccugcagccucugcacccaugagccuagcuuagggucaguaacuugugguuuagcaaaaaacagacuuaacuuuauaauguuagcaaaggauuaaguuuuaaauauaucagaaucgagaugggaaagaaaccuaacaaagugcuaauaaaaaauagaauuggguaaaaauauuauguuucaugaaagaagccagacacaaacagcuauauauuguaugauugcauuuauaagaaauguucagaauagacacaucuauauagagaaaaggcagauuagugguuguaggaggcugggagagggggaaugggaagugacugcuaacagguacaggauuuauuuuuaggaugaugaauauauucuagaguuacauaguggugaugguugcacaacucugugaauauauguacuaaugccacugaauuguacacuucaagaggguagauuucaugguauguaaauuauaucucaauaaagcucuuauacaaaauugaauuacggcagggugcggugguuuauuccuauaaucccagcacuuucggaggcugaggcaggcagauugcuggagcccagggguuggagaccagccuggucuccaacaugaugaaaccccgucuuaccaaaaaauaugaaaaauuuagccaggcaggcgugauggugcaccccaguagucccagcuacucaugaggcugaggugggaggaucaccugagcccgggagguugagacugcagugagccaugauugugccacugcacuccagccugggugacacugagaccuugucucaaaaauagacaucuuuuuuaaaaaauaaaaaaagaaaaaagauugaauuagggugguggcagacuuaugugacuagcuuuucuucuuuuuucuuccaguuuucuauaauuacuuuuucucuuuuuuuaaauggaaagaguccuacauuucauuaagauacuuaagauccaguuuuauguggugcugaauuauagcuaugcagagaaagucuccgugaaauauuaaggucacuuuugcucacaaaauaucaaugauuaacuaagauguauaggcuguaaauagagagaagauggguauguaugugauaaggaaguuuaaugaaguuucauccuauguaaugugggucucccuaagagagggucuaucuuuucaucaauagcagaucuguggucuguauugucugaugaaguccaccugguauugcacauugaaauccauguuuguuuugauguauaaguguucucucagagaacagcuacuucccaguuugacacuguuuucaauccagugccaaugccaagagauuucugagccauauauauauuuuuaauguaaguuaaauaauucaucaaggaaugagagagagagagagagagaguguguguguguguguguguguguauguguguguguggugaaacauuuggcucuuuccaccuaauuuuuaaccuuguugguccuacuggcaaucuguuucuuagcuaaugacugcauaaaaucaucucugaaaagaaagcuaaagacuuuugcauuaccuuuugccaguuucugcuuuaaauccacccuuugguauuugcaaaggucagaugagcuauuuugguguccacggcccugauuaaugggaaauccuacauuuccauuggccccggaggaugaaggauuaguguggcggcggcagugcgggcagcaucugcugcaaugucaggaguacgguguugggaauugcaggagcauccggccuaugaaaaauggaggaggaggggagcuccacuaguacuagccccagaugaguuuuucuccauugccaucaggcagacaucucugggagcauuuguucuccucuguuaggccuugucgcuaagcauuuaauauggagagcacaagugcggaccuccuguuuccccgccggaaggcuuccauagcucccuguuagucggcauguuuguguucagcuuuucaccucuccuuguaggagacguugguuuuauacuauguuaaauaaaaaucauuguguuagcucauagauuuucacaagagaagcaggugccuggugcuuuggggagaauaacuccaaauaugggaaucucuuuccccacccaagagcagauggucugcguuaguuugucuugugaccuuucuuugcuucuaagacaccaaaucucugaucccacggaucauaaauauucuuuagguuugcagccauggaggugaagggagcgucaagcugucggugucauuuuccauuugucuggaaccuuucaaagaaacuguuacagcauuuuuaggcacugaauuagccuccugcagccgugagcuuacagacucaugaagggcaccgcagcaaggcugccucagccaaggucaggaaggagcccucugcucagcaucccuuugcucagcauccugccguccucaccuguccacucaccaggcagccucucacggcagccacuuugugccaggcaccaugauggcuugcacaaccccugccugccuauccgggggcugcauuauuuaugucgcuaguaguguuaauaagcaccuuguauugaucaccuugucugcugccucucccugcccuagagcccaccuucucauccagaggaagacccucaagugcagugugggggugcucugauaauguagcagcaugcacugagaggggcagaguaaggacugccuucacaaaggaggugacaucugagcugcucucugguaggaguuuaccuggagggggagggaugugcaaggaagagagaacauuggagaaaaggggccuguauguuuguggcagcuagaccuugggcucuggauguucacguggggcccuggcaagggguaggaaguggaagucagggcugguuagagauagucacccugaggaucagguugaggaguguagaccuuaucugaagugaaguggggagaucugggagguuuuuaauacuuagggggaagaugagaucagauuuucuguuuggugcagaccaccuggggcaguguggaguguagacuauggaaagagagaguggaggaagugauaacaaugaggaggcugcagcagcaauccccaagagagaucuggaggcagcucagccuucgggcuccccuuuccaugcauuugcacuggcugcuccuucucuccuuugccuucacauuccuacauucucuuuuggaucauccacauucucuccauacccaaguguuguuaccuugcugaggccuuuucugcacucuccaggcagcaggauucagcccucugucgcaccccagcagcaggcuggucugccacuaucugaccccuauagagacugcuuugccuuccuaacucccuagcucuaauuagcagcacuuuggacccauaucaagauggaaagaagaaaggguuuuuuaaagugacuguuacaguggauuggagaggacucagaauuuggggacagaacauaccccaguuugagaccugcuucugccuuaugcuuucuccaggagaugaaguauuuuuuuauuuuugcuuuuucuuaucauagaaaauuucaagcauagauaugaauugggagaacaguguaaugaaccucuguguacccaugacucagcuucuaagcaucuggccaauccaaucuuguuucaucuaaucauccuccccucccacucugcauuauuuugaagcagauuccaggcaucauauuacuuuauaauaauuacuuuauaaauacugaaauagauaaagggcucuaaaagauaaacagcuuuuuguuuacuucuaacagucuucaugucucugagccccaaguucucaucuguaaaauggaauggugauggcccaucccagggcugucgcgacuaaagcuggcaaaagccuuuccuggaauucugacugcuuccuuuucuauacuaacuaccgugcugaugugacugcuuauaguaccauuguaaugacaauaagaacagucuuuggagcagacaaacccaagucacauucucaucccaacacuguaucuuuuggggcaaauuacuuacucugagccuacuaaguagccucauuuuuuaaaaugggggacauaauaccucccucauaggguuguuuugagauuuaaaagggaagguguacauaucggcccauacauaucggcccauaauaagaucuuaauacuuaguaacuaguauuauaaauguccuuuaaauugauaugauuuucugguuaguauaguaauccugcgaaguauauaguuuuuaauccccauuuuacauaugauaugauugaggguuaaagccaggauuaaugaacuugccugagaucuuggggcuaauacauuacagagccaggaguuugagcccaggucugccugaccccaaggcccccauccuuauuacugcuauuuauuaauggaaccuugcaauguggccuugugaaaaagaacaugcugaucuugggucaggcagaucagggucgucugguccuuacuuuugucugcuguuuucagcuagugcugguuuuuuauaagcuggugaacuggauuacaaauuuuccuuagacuccuuuguccauaucuucugccuucuuucugccucucguuuuaggagcuguuaguucucauaagccccuguaauggagagaaguagagagaacagaacauucaaauaaaaaguucaugcacaucagcucuuuugugcuacguuuuugugggaaaguggcugagacuuuuguauuuuagagaugaggucuugcuguguuguccagguuggacuugaccuucuggccucaagggauccuuccaccuucccucccuaguagcagggacuauaggugcaugccacugcgccuggcuuagaggcugaaacucuuuaaggcaaaaugagguucauagguuaucuguggauuuuuguuuuucagucagccgaguuagugaggcauggacagggcuuauguauccauuuccacuguaaaauugcuaagaauggaucauuggaagauaauaaauguggcagagccagaaaucaaacccaggccugaccaacucacugccuggcugguuccauuguuccacucugccuuuagggacgggcaggugagggacccacagggaagacuuagacugcccguggauaucuccucguggcuuggaaucccuauucuaaaagaucugaucuaguucuggcuuaaugggagucagcguaaugaugauucucagcuuuuugucuagcuuuuucacauauguuuuguuuuccugcugccaugaaguuuaaacuuguuuaaaaccaagauuuuaaacaaggaagccaagcauauaagggagucguccauagucauccgagggcagagccaggacacaagugccauccuuggacugcgaccaguccucuuccugcacuucccucuggaaagcccacuuccugcaaagcccucuggaauugcucagcaguagugccccaaccaucauguaaggaaaagaauuucgaguuggaacaggaacuucagggggccaguagccccuccccaaaguucucagagaaggggcaguuagcaaacguagaagccuuucuuacugagaugacccuuccaccuguucacuggagaaauggucuccaguagcucuguucuggggugcuaucucuggacagccaucuucagaaguguaguuuccccuaagaaaacacuagaacagauuuuagcagaagauugagaaucccaaugguacaaaucuuacaaguaugauuugcaagcaucauagagaagccuccuuuuuggguaggaaugcaaaaccaaucaccucauugcucgaaugacagucuggcuuucuugggauccagccaagaaaacaauuuaugagacugacccacacacuuaacuagcuaaagcuuugggcuguaauccagaauccuuauuauggaaagcagaguuaaaacuguucccuuugaaacccuguggcuauuuauuugaauuagcgaggucaccccaaugacagcuguggagaccagccuuuaauuaggaaaagaauuugccuugaacuucaucggaauggcauugcugagggucuugagugcuuuucuuccuucauucuuucaggcuuaccuuauuccugcucuuuguucaggagucacagcucauuucuucccugaaagccugacuucuccaugcucugcacccacaggacucucuccuggcuauggcaugccagaguccaucccugagcugggugggggcagugcugacucugaaauucaaauucucccucauauuggcagcaugacuuuuuggacaaguuaucauacuuuucugagccucaucuuccucaucuguaaaaugauucuaauaguauuuauugcauaggguuguauaaagcuaccaauuauugauuacucuugcuauaugccagccacucuuaucagugcuugacccguauaagcucaucucaucugaguaacaacccuaugcagcagaacucuucuuccuuuuuuuuuuuuuuuuuuuuuuuuuugagauagagucuugcucugucgcccagccuggaaugcagaggcgugaucucagcucacugcgaccuccgccuccuggguucaagugauucucaugcuucagccucucaggcagcugggauuacaggcacccgccaccacaccuggcuaguuuuuguauuuuuaguagagaugagguuucaccauguuggccaggcuggucuugaacuccugaccucaagugauccucccgacuuggccucccagagugcuaggauuuacaggcaugagccaccacaccuggcccaaagcagaauucuuaacacuuccauuuuauagaugaggaaguagaggcuacuacagagccuccuacauaauggggacucaacaaauguguuuauugaguuugaaucuuucccuuacuuauacuuucauuacauuuauaaucucugcccuauguuuaacuuuucucuaagaauauugaaugugucaauuuuaucuucaaauuuacuuuuuaaacuuuguguuauagaaaauuuuaaacaugcaaaaguagaauaguauaaugaacuucuacaaacccuuuauagaacuucaacaauuaucaacucaugaccuauuagauuuugucaauaugcauacccugcccauauuauuuugaaguaagucccccaaaucauauuauuucagcauauauuucaauauguaucucuaaaagaaaaugacucauuuuagaaacaaucacaauacugugauuguacuuuuaaaauguaauuuccuaucauguauccaacuaguguucaaaauuuuuaguugucucauaaugucauauauuuuuuaagacugaauagaaucugcuaaggucuaucacaaguacagugaggugacugugggcaguggcugggcacagcccaucugggaggccucccaucagaugaaaguuaagguucuuuucaacucuaaaagccagcugccaacuuuuugccugguauucgucucaacaccaaaaguuaggcacuguuagggagagaaagucacacuagagagggcuggccucucuuugcaaagguuuaauucagauggaagauacuucaguaauggguagaaacaaauuacuuagaggcugucuguauaucaagguucuucauuuuauccuuuucaucccauuacugaguagcugcauuauaacuuauuggugaaacacuuggguucagaggucagacagaauggaauucuaguccaggugccacugcuugcugugugugugucugggcaagucauuuagcuucucugggcggccccaccccaguguauagaaagugagaauuauaaguuucgaccuagaccgggugugguggcuaaugcuuauaaucccaguacuuuaggaggccaagguggggcggucacuuuagcaagaccucuuuacaaaauauuaaaaaaaaaaaaaaacccuuucaaccuuugccucauggugaggauuaaauaaaguaaugaguuaaggcauguaggauauuauaagucaguaaagguuagguaguauugguuugugacuaucugccugcuggguugcgucccugugcauuuaugaguauguggguagaaguggaaucuggagagauuuguaaccucaugccuaucuugagucucauuggcuuuuuccagagcacgucgucacuccauucucuaguggaggauugaguggcuccuguauuccuccccagugccucuccugguagucauuuauuauauagaacauccuagucagagcgggacuguugucagccuuauguuaccagugaagaaggcagcuucaggccacugcagugaaaucaaaggcaccaagggucuaagagguagaaggagcucucuggguugcugagggcaaggucuuaggcacagcaggcaccccuucuagaacguccugccagguggcuacccgcccagacuuguauaccuccaguaauggaaaacucauuaucucauaggcagcacaucccacguuggucucuucuccaguuaaaugaaaaugacuugcuuaauuggaucuaacugccucccucucauuucuaccuguaguccuggguccucuccucuucccauugcaccacgcugggugagagggaguaacacagagggaggucucugcucuugguggcauuguguucuggagagagcccuccaaagcagagccaccguauggcaaaaucccagucaagccuuuguguggacaucaguggagaccuuucugugaguggcaggaauggagugugguucucuauuaggcagugucagaugcagguggacuggugagacaugaaggagaccaaugcgggagcugucuuuaagcuuaagagcuaugauuuggagcccaguguggagugcuaaccuuuccacaugccccccuccacugugcagcucucucaaauguacuuuguuaugcucuugcaugagugguguucaccucugcauuauuuagugucauuuauccuugcacuuucucauuccuacagccugcaggaaaagagacuguagcaugugggcugugugucauugcugagcaguuugucagccuuagaaagcugcucaugagcugagagcacaugauaccagcaggugacgcaaagccugcaugacuugggguccucaaucacugggaaaggcccucccccacuggugacacaaaaaggcaggaaagaaccuuuguuucaucugguucauaugugacagccuucauuugcuacagaucuuuggcccucaccauucuuaccugugaaaguccccuaauccgagccugaugggacccaggugugaggcauugaucauggcugguuauucaucagggguggauauuggcacacaggcuaccauuuccuuauugguugacucugaucaaagauaaaaauaaaaaugucgguguuccuugaauaggauuacaguagaaugcuuguuacaaaaccggaggagggaauucauuaggcuuuuaugaucaucacuucugugggaggaaggguucauguugaauagccugccagauaacucuggaauauguaccacuggaguagggacaauuugccaggcauugcucuccuuuauccuuuggggcugcagggacagauggccuccagccuucuuucugcuccccuggcauuugucacaacaugcuaugggucaggagacccuaagcagaaagaucgugggaggucagcacggcaggguacaagaggccaguucaacucugagcccucaugguaugaggcagcuuuagaacaauguggaagaaucaaagagguugaacuuagacuguuaaaaagccuuuuuccccugaaaauuugaaagcagaaagaaauguagagaaguagagaaaaauuuucauuaucccacuacacaaagguuacuacuauaaacauuuugguguauuuucuuccuguauuauuaaaacauuuuucuuuacagagauaaugcuguaaguacaauuuugugcccuguuuuucccacuuaauauagaauaaucauuuuuaauuaaaaaacagcuuauaaauaucauuauuaaaugacuacauaauauucccuuauguggaugaauacauugcauuucauguuaccauuccucuaauguuggacauuuagauuauuucuuuucuuuuuuuccuugcuauuauaauuaaugcagugauaaacaucuuagggcuuauaucuuugcauuucagauuauuuacauauaauaaauuccuuuaaauagaauuaccaugucaaaggguaugcuuguuuuuaaguuucuuauucuccaaaaaauuuauauugcuuuacauaugcuuaguuuuuauggagaccccaccuaaccuggcccagguuggggcaggggcacuagugugaggaacaggguuggggaaaacuuccuggaagaaggguuuuaggccacauccugaagguguuaaauguuaacaagaguagaagcagauaggaugguggggagagacuguccuagauauccaggcagagagaacagaaugugugaaaacccagagcugcugaagggcacacgccugggggagcuaaggccagaggccgaagggaggguggagagagaugggcugcagaggaagacagggcaggagcaagcgaggccaagugacagaauguagacuuuguccuaacagcagugggaaaccguaaaggagcuauaaaugcaggccagugacaugaugagauuugcauuccagaaaagccacuagcugcuggguggaggauggacuggguaggauaggaggggaagaccucccuucugggagaccaguucagacuguugcacaaggcaggcaccaccagugugagucauuccucagaauuugcuaaauugauagguggaagugcauuucacuuaaauuuucauuucuguaauuccugcugagguugaauauuuuuagguugauuugccaacuguauuucaucacuugugaccucguuccuuauguccuaauggcucuuggagcaugauggcaucauugguggacuuuagagaugguauaauaagguguauaauucagcuuugcauuggaucccauagagacccagggaggaggugacuugcccugggucccugggaccaggauuggggcuuccaggugcaccauccucugcuuucuccaguccucuaagcuaccuccuagagcaggcacaguuaccaggaccuuggaaagcacagcucggcaagcucaaggucuacugacaagaaagagcaguaagaggauguggagaaggucacuuuucugccauucagauuuggaggaagagguucagaaugcagcaagcccaauuuaaaucaaggaguucuuaacaacugggggcaucuuuguuucagaagaagcucagcuaaggcuguuauuugccaacagauuauaagcauuugcuagaguagaaagauguauagagaauagagccuucaguaugaaguuaccucccuagaccugacucacaguucagcugccuccccaaaguuaacagcauccaacuuguagaucuugccuauuaauguauuuauuaguuugcuuguuugauagccacagaggcuuccugaggaaauugugggcaaggguuugccgagaauguaccaauuggaaaaacuuuucuuaauagcuggcugcuuucuaugcuguggggucuugugcauuuugguuccucucagaggguggcuggcuuuguaugcagugcacauggugcccugaguuccacucuaauugcuaugugcaggauagcugagugcagcacgguggcugaguaaugaacccgcauuucucuuugcagcuucucuauuaggaaaucucaggaaccuggagccuguguuucauucugaagguuuuccccuguuaaaucugaaugauuucagauuguuaaaacacuaccauuguaggcaguggccuugucaccgugcccugcauacacagucaugcccuugcuuuggaugccguucuuauuugccuuuuaauuuuacccaaagaccagauaagaugaaauaucgcauauuguuauuucugauggcuguauaggucgacacauuuuuaaaaaucauaaaucuuguuacaaaauaaauauguauuuuuaggagaaaaauuuuagaaauuaucccccuaaacaaaacaaaacaaaacaaaacacaguaagacauaauuacucucacuacuaagauguuugccauuguuaccguaucaggggcuagccuuucaggcuuuguuccuuugccuagguauauacuguuuuuuugugugguuuuuauuuuugagacaggguuucacucugucucccuggcuggauuuaaugacaucauagcucacugcagccuugauccccgggcucaagugauaccccucccucagccucccaaguagcugagacuacaggagcacaccaacauaucuggcuaauuucaacacuguuuuuguagagacaaagucucacuauguugcccaggcuggucuugaacuccugggcuuaagcaguccucccaccuuggccuccuaaagugcugggauuggagcacuuugaaaauggcuaccaugcccagccagguauacacuuuuaauauaaaacuguacauacuuuuaauauaaaauauaaaaaauauacuaguuugugucuugauuuccccccacuuaaugugugaugcacacuugccuacucagauuuuuuuuuccuaaccuaguaucuaaaugugucuguggauuaggggcaagccuuuccaggcagugagucaccuugugggauaauacugucaucucaggcagggucucaugcuucagccauguuuugggcccaagucacauucuuuaaauauugucuaggguggcagaucaucaucuuuugaaggauggauuugauuaaaaaaauaagccaauacuuuuucacaccccaguguuggaugcugagcaaggccauuuaggcaaacuugaguugugguuguaacaaacgaguggguuuucugggugacuuguaggggaaggaaagaggaugagaguaaauauccaucagacaacuauuauggcuccaccaggcuaaacauuuuaaagccagaucuagaccucugcauaaguacuguaaguguggugguggcccucaaaaugaugcuuagggggcaucagaaccuccuggggagcuuggugaaaagcccaugaggccaggauugaugggggucaagggaaagaggccccaagggaauaugaaccucaucuguaauugcaguagacacuguuccacaggcucccaauaccuguuccucauuucuucuuuucugacggagucugauuuuguuuggauugccuaugugcccagcuauauucucuuacuuaguuucccuugcagcuaggggugacuguaugacacagcucuggccuaugaacaagaggcaggagcuccugaggagagcaccucuucauaaauaagauggcaaaguccuuuggcccuuucguguucuuccugccugcuuuauagacugccagguagagcaguggugccuugcagcuggaaggauggaaaggagggaagccucaggccaaggauggcagaggaagaagacaaaaaguuccuggguccuuuauggaauccuugaguggauuccauaaauccacuccagcucuauacugccugcuucuagauuucuucuuguucccugagaaaaauaacccccaucuguuuaaacgacuguuaguuuuuuaauugcuugcagcugaaugcaaucauaacugauaagguaauguuuuaauauuuuacaagggggaaauguauuuacauauugugcaauuaaaaaugaaaaauaauuuaaauccccacagauuucugggccccacaucagaugcacugaaacagaaucuuugaaucuuuggggaugggacucauguagcuauauuuuuaacaaacucuacagaugauucgggugcacaauaaaaugggagaaccauuuccauauuuauuaauaguauuaacuccauuuuauagauaagaacauugaggcccaaggaguugaaacaccuuaccccaauauuuuaaaguaagauuugcauguaguucugucugguuccaaaguacauuccccaccacaucccaugccugcuccagagaggccuggcuuucccccaacaauacagccaugcuacuucugaggggaacuucuaaaauagaagauucaacuguuuguaaaacaguuuuacacugcugcccagggacaacauuaccauaauucaucuauccccaggaaacaaagggacguauguuuucuggcauguuuguuaaaaaagagggcugggcacgguaacucauaccuguaaucccagcacuuuggaaggcuaaggcaggaggauugcuugaggccaggaguuugagaccaaccugggcaaaguaccaagacucugucucuacaaaaaauaaaaauaaaauaauaagaauaaugaaauaaaaagcauguucauaaguucuuggucuugucuucuacuuucaaaacaaaaauucuuugaaauuagcuuuuuccauagauuuucuaggguuaagucacuuaagaauuacuagaacaucucacccaugaaagguaauuaugguuguuuuaugaguguggaagacauauagcugguaaguacuagaauagucuccugugaguuauuagaacucacaauauucauguuguaccaaauuagccaucaagaacugauagauuuuaucuguaguuuaucaaggcauuggucagugauauacauucauaacaauuaaacacacaccagcuccccuugaugagaucuuuggguaagguggccaccucggguuauauuaaugugauuugcauggguauuuggagaccuguaugauaagaauuauuuucugacaaggaagaggaucuuuauugugugaaauaggaagucaguguguugagacccucaaggggcuaacagugucacguguguaaaguuuggcccaggaguuauaggagcuuugcguucugaaccuggaucuggcaugaagcuacugcaugucagacucucugaucuaauuccaaacagucaggcuuuuagauaacucugcaacuccauuuuugagguccccucauguguaaggucuucugggagaugcuucauuguauugccuuucaaggagcucauuuuguacgggggagggggagagaagacagauacccaagucucuauugugccagcuauugcucccccaguucuccugaggacuccugugugccaggcccuguuucuguucuauagauguggaaacugaggcucagagacauuuaguuauuugguuaggaucacacagcauauaagcagcugaaucagauuugagcucaauuggucugacuccaaagaucuugcugccacuucugcaugacuuugccuuguuggugcucugccuugcuuggcagugcagaggcaugggcugcgugguagaaugagaccucuuuugauuggagaauuggggaaaucuguagaagaggaaggauuuaaagaggauaggauggguaaaaauagguaguaacgaaaagguggggauguguucuuggaaagaggagucugguuugguugaauguguaguucuuuguggggaugggauggggcaaaauaggaaaagagaggcugcaaaaguaacugggacaaaugguaaagggcaguuaauaccaggcuaaguuacaggaagaacauuuuauauuuuauaugaaacuguuguugaagacauuccauauuaugcuauucauuauuccuuaauaugagugacugcaauaaaucucaaaacuuacuguuagggaaaaaaaauccccauccuagaggaaugccuuuuauucugccuuuaaucagcaaggaaggacuguggaaacucauugucuuucccuucuugcccaggccaccaggaagcaugggccuaauuagugucuaguugcaauaacugucuuaucucucugguucuugguaaaacauuucuucuuuuauuccauuugguuuucagccuucuuguuuuauuugucuuggguauaaauuauuacuaaaauuacccuaaauuccuuuuggaaguaaauggaacauacccuucuuguaccaucacaaggaaaguuaauaaagggcuggaacagggcagugaugugaccaaagcuuguuucaaaacauuuucauggcauauugaugagcugauugcaagaggcugcuggggaaggguauuuuaucucuuggacaagauguggaauaagucagacuuaggagccccaagugucaggaggggccugccaggugucugucuaccgugagggucucugcaguccuccuugugccuaccaaguucaaaguuagguccuacacauucccagaccccccuuuuuuuuaaccacuuucacaagagucucugauuuggucauuuccuaagaccaucuggaccaauuuuuugguuuuuguuaggagaaugggcuaaaguuuguauguugguaauucucuauaccccacuuucuggagcacuuaaggcaacacucgguaaaaugacugcauaaugaguagugucagcauuccaguccaacaaaaagaggcugucucauggucugauaaccuuaaggacuucaggcuuggcagucucauuucugaagaacuagaauggagugucuuuuuuguuuuguuuuuggaauggagugucuuaaccauggugcucuugccuuccugugugugcccaggcaugggcucuguaucucugcuaguggucuucauaaagacacagagacagcccucccaacagagcugucacucacucucuguaguaccucacucaucgcagcugccuugcuguuguggaaauucauguuguguuuaacuugucuaaguguucauaccaacagucacagcuaaagcucuagggcagaagugguaucugacugaggccagggauuggugaauaaccuguugaaagugugugcagaauuguguguguaauucucuggaaaggucuuaucagauuuucaaagggaauguauucuuccuuuaacaucuuauccaaaaaguuaacuacugcucugaaaaaugacagucuauggauuucuuccugacauucuuuuuuuuguuuuugagauggaguuuuugcuguuguugcccaggcuggaguacaauggugcgaucucggcucaccacaaccuccgcuucccggguucaagcgauucuccugccucggccuccugaguagcugggauuacaggcacauuccaccacgccuggcuaauuuuguauuuuuaguagagaugggguuucuccacguuggucaggcuggucuggaacucccgaucucaggugauccaccugccucccaaagugcugggauuacaggcgugagccaccacgcccaggcucugacauucuugaauaucccuaucaaccccucucacccacccaaagccugcugcucaaagcagcucuaagcagaagagauggagaaacauucagacuggguggagcauggcccaggcuguguugcugcccacuucugucuagaugggcaguucuugacuuccccgccugacgcugcugagcagccacagucccgacugcauucuggcuuguacccuuuacuauagugccagccacagagagcagccaugcagcauuuuuaaguagccaaggaaaggcccguucucacagcagugcuuggggaaucuucagacuugguauuaggaaccauagcaaugagacuuguuacaagcuugcaaaacaaaaugggauuuuucugugugguccagcaaggaucuagacagaaagucugcuugauuuuguuuugccuugcuggcuucauaaacccacguagcagaagcacuuugugaaucagaaauggaagcauuguucucugauacugaggaaugccuuuccugaauggcuacugugggugggaauagcucuaaagaaaaaaaaaauccugagacacagacagcagcuauuuauguucuauucuguuugacacacauuauugaauaccuacugugugcugguaaaauucauggugcaucagggaaggcagguccaugaggaaccauuagacaagcaauaggggcuggaugagccucagcaagugaggacugugagaucccagaagagugcaauuaauucaucucgugugugcaugcucacgcgggggccgucuggggcccucacugagaggaggcaacgagcugaguguuaaagggagggugucgccuucuguguucucuuuugacccuuuccauuaugugagcaugcauuuuuaccuuguggugauuaguaugcacauaauauuuuauccugccuguuuuccucuuagcauuccuaugccgauuuccacuuagcgacuaggcugaaguauuuaucauuuuaaaaagccacguagcguuuuugccuuauugauguacccucguugcuuagccaucuucucguuuguugggagcagcaguguuuuucucaauuaugcaucuuugcagaaucagcucuccccuucccccuuauuuauuuccuuagggggcuauugccgggucaaaguuaugaaugguuuuaugcugucuccuacugauuuuuuuuguuguuacagaaaauuucagacauauacaaaaggaaaaagaugacuauaaugaacccccacauacucaucauugagcuucuacaauuaucaauucauggcaguuuugguucauccauagccccacacacuuuuauccuggauuauuuuucaguaaaucccagacaucauauaauuucaucuaugaauaccuaaguaugcauuucuaaaagauaaggaaucuuuuuaaaaguauagcugacuggguguggugguucaugccuguaaucccaacacuuugggaggccuggguaacauagugaaacccuggcuguaccacgaauacaaaaauuagccaggugugguggcacaugccuguagucccagcuacucaggaggcugagggugggaggcucacuugagccuggaagguugaggcugcagugagccaagauugugccgcugcauucccagccugagugacugagugagauccugucucaaaaaaaaaaaaaaaaaguauagccaacagcuuauuaucauaucuaaaauaaauuaaucauaauccuuaauaucauaaaauaucuagucauccaacugacaguuuaagauucccuaguguuuucuguggccauucucacgaggccaaauguuuauuugcuccaccauguucuucagggaauguuucccuugauguaucacauugagguugaguucuuuaucaagaaaggucugcaugcagguccuggccucagaaagagauggagggaaagaagaagggauaaagagaggccucucuccacagccucugcagcuggccucaugugguuugcgccacauagggugguagguucucucugcccguuacucacaugguaaacccagcugugcugcuuuauccacauaccagcuugacuugguacagugugcugaaaauaaugucgggccugucccuuuggacuccacccccauugaagaaugcaguuucaugcuguugguuuuuuuagugcuaaagaaacuagauagauacuguguuuauuuuucuacaguaaaaauccgaaaagcuaggaaaaugccuauucccuguuggauuuugaucuuauuugcauguuucccuuggcaagcuuuguuucguauuauucaaggugacccacuuagaacuacuguuuaaagucacauugucauuaauaaguuacacaaccugugugugauaagucuguuagcccugaauauuguauaaacaggaauacaugcuuguguuggggcucuucuucauauuuaaauaugguuacauuucuuuuucuuuuucuuucuuccuuuuuuuugagacagagucccucucugucgcccagacaggagugcaguggugugauccuugcucacugcaaccucugccucccagguucaagcgauucuugugccucaaccucucaaguagcugggauuacaggcgugugcuaccaggcccagcuaauuuuuguauauuuuguaaagauggaguuucaccauguuggcuggucuugaacuccugagcucaagcaauccgcccgccucggccuccaaaacugcugggauuacagguguaauccaucacaccaggcccaaauaugguuacauuuaaauguaaucuucccuguuuguucucacuguugauauucgugaccuuucuauguugaugaauaggaguaauuucccagaugaucuagaacccuauuguauuuggcuuuggaaugugaaacacguguacauuuauguccgcaucuccccuugugccaguccagacuggcucucaguuugguccuccuuaacuagcuggguacccugggugaccuccuuugggacaagggagaguuagcagggaggccuggucagaauaaaaugccuuuugagagauauugggguuaccaggcuuuuauccuuaagucuguauguucagacuaaguaaugaagcuuacuuauguuuaggccagcuugaaagcuuguaccuagcuuuuuuuuuuuuuuuucuccaagagacagaguuuuacucugucccccaggcuagaauacagugguaugaucacaacucacugcggccucgacauccugugcucaagugauccucucaccucagccuguggaguagcugggacuacaggugcgugccacugagcccugcuaauuuuuaaauuuuugguagagacaaggucuugcuguguuacccaggcugguuuugaauuccugggcucaaguggacuuccugccuuggccuuccaaagugcugggauuaugggcaugaggcaccacgacuaaccuauagccuauaccuagcuuuuuuuuuuuuuuuuugagacagggucucacugugucacccaggcuagaguacaguggcaccaucauagcuuacugcagccuccaucuccugggcucaagcgaucuuccuaccucagccucccaaguagcugggacuauaggcaugcguuaccacaucuggcuaauuuuuuuuuuuuuuuuuuuuuuugguagacacgaggugaggucgcuauguuggccaggcuggucuugaacuccugagcucaagagauccucccaccucagcguggcaaagugcugggauuagaggcaugagccacugcgccugggcuauaccuggcuauuuuugauggaagaauuaaauaacuggcuuuuaguuuuggucauuaguuugccacuuucuuucuuagucuuuugcuguauaauauccucuuuccuucuuuuuguaacaguaauaacauaaaaaauuuuuaaaguuugccuuuaagccaaauacuucaacacacugauuauuuucacuuuuucccauuuaucuuccaggcauuauccauaugcauguuuuuuuaaaaaucaauuuugugucuuuuuuuucuuacaucauuacaaaauguuucuauaugguuuuaagaauuauuacuuauaauggcuguauuagguuguucuugcauugccauaaagaaauaccugagacuagguaauuuauaaaagagguuuauuuggcucaugguuuugcaggcuguauaggaagcauaguacuggcagcugcuucugaggaggcuucaggaagcuuuuacucauggcagaaggggaagggagagcaggcaccucacauggugaaaacaggaacaaaaaacagagagagagaguggaggagggagugccacacacuuuuaacugaccagauauugcaagaauuaucacaaagacaucaucaaggcaugaaggaucugcccaccaggcccuaccuccagcauugggaacuacaauucaacauaagauuuggguggggacaaauauccaaacuauaucaauagcuauauaauauucaguggaaucaauauacuauauuuaaucaucacuuuuuuauuuuauauuugagaaguuuuaagaauuuuauuuuauuuuugaggcagggucucacucugucccucaggcuggagugcagugaugugaucacgguucgcugcagccucagucuuccgugcugaagcaauacuccuaucucagccucuugaguagcuggggacuacaggcauguaccaccaugccuggcuaauuuuguauuuuuuguagaggcaagguuuauguugcucaggcuggucucaaacuccugggcuuaagugauccuccugcuugagccacugcacccagcuaaggauuuuaaauaauacuacauugaacacauuccuaguagcuuuucucccauuuuucaacagcuuuauugagauauaauucauaugccauacaauucacccauuuacaauguacaagucagugguuuuuaguauagucacagaguuuuuuuuaaaaaacauuguauucacagcguuguucagccauuaccacaaucaguuuuagaacauuuucaucauuccguacccauuagcaaucacuccccauuucccccagcccuuccaaccccaggcaaucacuaaucuauuuucugucucuauagauuugccuauucuggacauuuuauauaaauggaaucauacaauauguagucauuuuuaccuuuguuuuuguuuuuguuugagacagagucuugcucuguugcccauucuggagugcaguggcgcgaucucggcucacugcaaccucugcuccuggguucaaguaauucuccugccucagccucccgaguagcugggauuacaggugcauaccaccaugccuggcuaauuuuuguauuuuuuuaguggagacgggguuucaccauguuggccaggcuggucucaaacuccugaccuuaugaucugcccaccucgaccucccaaagugcugagauuacaggcgacagccaccgcgcccggccuuuuuuuuucuuuuuuagacacaaguucuugcucugucucucagacuggagugucucccagccuccaguuccugggcuuaagugauccucuugccucccaaguaucuuuuuuaccauuuuaaagauguguauaacauaaaaucuacaauuuuaacuuuuuucuuuugagauggggucucacccucuugcccaggcuggagugcaguggugcgaucacgacucacuguagccuugaccuccuagccucaagugauccuccugccucaggcucuggaguaggugaaacuacagaugcucaccacugcgcccagcuaauuaaaaaaaaauuuuuuuuuguagagacagggucucccuauguugcccaggcuuaaaaauacauguuaauacaaguguugaaguuuuaccauggguguuuguuguuguuguuguuguuguuguuuuguuguuguuguuugagauggaguuucacucuugucgcccagacuggaaugcaguggcgcgaucucggcucacugcaaccuccaccucccggguucaagugauucuccugccucagccucccaaauagcugggauuacaggcacccaccaccacgccuggcuaauuuuuuuguauguuuaguagagaccaggauuucaucaaguuggccaggcuggucuugaacucuugaucucaggcgauccgccugccuuggccuuccaaagugcugggauuacaggcgugagccacugcgcccagccaacacuguggcuuuaaugagcacagcagguaugagcccugggaaacuucugggagucuuucuccugguguggaauuuuguaaucacucuuugaggccuuuuuauagccuuguuccuggugaugccugcggucccugguuggccucacaggcuaguuggugccuggccaacagauugcagccuuguccugguccucucugcucacacuccaggaggcaguuaagguggccacuucacuauuccaccuggaggcugcaauaaaagcauuggagacagucacccuccccuucugcuuccccgcuggaauuccgucuuuccugagaugcaguccacagaauacacaaguuaagaauugugguucauauuuauugcgcccucacuauguuccagguucccuguuucgugucuuauaucacuaacuuauuugaucuuaaccacacccugugaggagguacaauuguuuugcccguuuuauggaugaaauucagagagcgugagaaauguguccuaggucagagagagccaagacugacccccaguccccagauucaaagccaugaccuugaccaacaugcuguccugucuccuuuucucacugagcaguugugauaaccugcccccugcuuccugccugcagucucuccacuccacuacagcccccaugcuguuaccagagcgaucugucucagacauaaauauucuugucacuccuguugaaaagccccauguugccuccuguggaaagcccagacuccuuagagaaaaugaaaggacacuccagagcuggccuccucucaccgcuccccuucaccgaggcccuggcccugggaggcuguuugcauagccuaugauguuccucucucuucaaauuccugcucuuuccuuguaccaggcccauuucuuagcuuucacaguccccucugcuccccuguucagccucaggucugugcccuguguccuggauggcuggcugcaggucuuuccuggggagugcuuucaguguaggggcuccaucuuacuucuuuccaucccagucuggcagggagaggccucacaguugaaguuuuuaaauugagcugggaagucuuuggauaauccuucccaaggaguggcauucacaucucugggaugugucucugucaucgggagaagcucaaaaaaaaggcuggugacaguguggcacacugugaaauucucaggcacaccuccucucuucucugagagugcugguggugaauggugggcacgagggcgaggggaacagccccugggaggcgcucuggggaagaagaaauuggcagcaaagcagacugcacgaagaggccgagaggaagacaggacaggugaaucccacccccccaccccgcccccacuuucccuuaucugcucugcuuuaagcagaaacuguaaccugaucaccaggucacagagaaacuuugauccucccagccacccccaccugucugacauuagagcacagccugcuaggcugggacaagcuggccacagcccccucuuccccaaagccuggcaccaucuuggggccuggcuggcuccugcagaggccuuuccucccccauggccaauuuccauccuggcccuaaauuggccucuucccccagcuacucucacacacugacucacacguaaguuauuccauuaaguacaaagaacggcauacaucaaauaccaguggcucugcuucuagagagcacaccccaaaugcauuuuaaaucuguggauccuccucaagggaauuccaguuaaaaaagaacuugggucagcagccucgggccuguguggcuaacaagcuucuguuuucucuguuguuuggcuggccugaaggguuccuuuguuuggggagugggaggaugugguguccuaaugaggccaggguguggaauuggggcucacacagagcuguccuuuagaacugagcucuccagacaggagaauaaguuggggaguuugagaguuuauuggucuuuaaagaaaacagaagguuucaaagagaggaaaacaaaaugcagugugguauucuggaucggaucaugagcagaaaaagggcauuauuggaaaaacuggagaaauccaaauaacaucuggaguucaguuaauaguacuauaccaauguuaacuuuuuaguuuuggccugugugcagugguuauguaagaugugaacugccugcaacgguggcucacaccuguaaucccagcacuuugaaggcugaggcggguggaucaccugaggucaggaguuugagaccagccuggccaacauggugaaacccccgucucuacuaaaaauacaaaaauuagcugggcaugguggcgggcgccuguaaucccagcuacucaggagacugaggcaggagaauugcuugaacucaggaggcagagguuucagugagccgagaucgcaccacugcacuccagccugggcaacagggugauacuccgucucaagaaaaagaaaaaaagccgggcgcaguggcucacuccuguaaucccagaacuuugggaggccaaggcggguggaucacgaggucaggaguucgagaccagccuggccaacauugugaaaccccgucucuacuaaaaauacacaaauuagcugguguggugacagacacauguagucccagcugcuugggagacugaggcuggagaauugcuugaacccgggagccggcgguuguggugagcugagauuguaccacugcacuccagccugggcaacagagcgagacuccaucucaaaaaaaaaaaaaaaaaaaaaaauauugaacauuagcggaaacggugagaagagcaaaugagaacucuguucuaucuuugcaacuuuucaguaaauauaaaauuauuccaaaauaaaagauguauuaauuaaaaaaaaaaagaacgagagaauaaagugacccagcaucuaauuuaacuugacacuuucaccagcacucucuuuuacacuuaagacuucaccuaaaaaucaggagggucuuuagacuucaccuaaaaaucaggagggugggcugcauccaauacucuggaccgucuauuguggaggccagggucuucuuugccucugugacccucuaccugaggauggaucaggguccaaggccaggcuuaccaggaagaccugggucaugugguuggcaguauugcuaccuccucucugcacacuguggggcuagucaccccaccaggcuucauuuucuuccuauuagagagagagaaccuuccuggcggcuggggcgugggaugguaggguuaaaugagguaaugucugucaagaaccuggcucaaaccaaauaaacagguuuucauucucucuucuguuucuccauuuuuuuggugaaaagaaugagagccauuuccuugaagacuugagaccagugguucaaugguagcuuuaagggcaagaaacugcccauagggaacuugcaacaacaccguggccccuccucccccaugccccacuuccugggguccaggaaauguggacuuauggggaaucuuuuuacuagauggucucuaagaccucuuggaguuuuaaugcuuggauucuuaaggaaauuguggugugccugcuccuuuacccuacagguggggcaagccaaguuugggggcuuccuucuggaagcauggaggucuuccuggcucaguaacccagaaauccagaaagcuagagcucccaggguuuugaaucugauggguguagcuuguggauggcuguuuaccuguagguggcaguggugacacgggaaugggagaggaggggggugcaaggggagggcacuggcagagcuccuuucagaagagcuguaauaaaguuagaaguaacagcaaggaaagguccucuguauuagaggcucugucagguguuuucuguauuauuuagucuccucuaacagccacugugugagagagugcuguuauugcagcauuuugcagcaguccaaaaggcuuggagaggucaaguuauugccuguagucacacaguaauuggcagaacuagaacucaccaaaaucugaguucacacucccuguucuagacuccauuauaaugcacauuucuccugcuucuaagucugaagggagaaccggggacagcugggaaccgagcucucaucucaccagacugcccagugccugucaccugggggccucagaaggguuuauaaucaucauuuuacuuauaaagggcccucaucagcauaaagccaggccuucuugacaugaagauguccugccuccaagcagcuuccaguuuagguugggguugggggccaagaagauacuuaacggcucauuaagccgguaagauuugaaaaaguucucagaacauuagaauggucuugaaggcucaguccuugugugaacuguacuaucaggugcuggagcccaucagagggccucucuugugggcggcagcaaagaagguucuggagaggacguuggaugggagcuagauaugggcagauaggcuggagagaaggcuuuccagacagaagucugaggugacuuucucagggcuugcaaagaccugcagauccuguuaugguuccuguuuucacccucuugcaauuuuuuauggaauaaggacucaaaugggucuucucuucagcuuuguuugcucucaugguguaugacuguguuuuguaaaaauauauauaggcgcaacgaugcugccuuucaccacuucuauucaacaugguauuggaaauuguagccagagcaguuagggaagaaaaagaaauaaaaggcaucucaaugggaaaggaaggaguaaaauuaucucuguucccugaugacaugacuuuacauguagaaaaccuugaagauaccacaaaacaaaaaaaaaaagaaaaacugcuagagcgaauaacauaaauuuaccaaagcugcaggauacaaaaucaacauucaaaaaucaguuguguuucuguuaauauacauuaacaaugaacaaucugaaaagaaaagaaaacaauuccauuuacacuagccucuaaaaaaauaaaauaccuaggaauuaaccaaggcagcaaaaaauugugcaccgaaaacuauaaaacguugcugaaagaaauuaaagaagaaagaagacauaaauauauggaaaaacauccuguguucauagaugggaagacaguuuuuuuuuaaggcagccucauuguguugcccagguuggagugcaguggcucaauuacggcucagugcagccuugaccucccgggcucaagucauccucccaccuuagccuccugaguagaugaaaugacagguguaagccaccacuccuggcuaauuuuuaaauuuuuuguagggauggggucuccuuauguugcccaggcuguucuuaaacuccugagcucaagcagucuucccaccuuggccucccaaagugaugggauuuacaggcaugagcuggccugggaagcuaauauuuuuaagaugacaacacuacccaaagugaucuacagauguaaugaaaucccaguuaaaauugcaaugaagccaggcaugguggcaugcacauguauucccagcuacuuggaaggcuaagaugggaggauugcuugagcccaggaguuugaguccagacugggcaacauagcaagacccugucucugaaaaaaaaaaaaaaaaaaaaaaaaaaaaaagaccaaugguauuuuuuucagaaauagaaaaauccauccuaaaauucacaugaaaucucaagggaccccaaauagccaaacaaccuuuaauuuuuauuuauuuuuauuuauuuuuuugagauggggucuugcucugucgcccaggcuggagugcagugaugugauuuuggcucauuuugcaaccucugccucccagguucgagugauucuccuggcucagccucccaagcaccugggacaacaggugugcgccaccacgcccagcuaauuuuuuaaauuuuuuaauuuuuuuagauggaguuucacucugucucccaggcuggagugcaguggcgugaucucggcucauugcaaccucugccugcugaguucaagugacucuccugccucagccuccggaguagcugggacuauaggugugugccccugcgcccagcuaauuuauguauuuuuaguagagaugggguuucaccauguugguuggccaggauggucucaaucucuugaccucgugauccaccugccucggccucccaaaaugcugggauuacaggugugagccacugugccuggcuaauuuuuguauuuuuaguagagacaggguuucacuguguugaccagacuggugucaaacuccuaaccucaugagauccacucaccucggccucccaaaguaucgggauuacaggcgugagccacugcgccuggcccuaaacaaccuuuaaaaagaacaaaguuggaggacucacacuuccugauuucaaaacuuacuucaaaacuauaauaaucacaacaucaugguauuggaauaaggaaagacacauggaccaauggaauaaaguagagaacucagaaauaaacucucccguauauggucaauugauuuucagcaagggugccaaaaguauuuagaggggaaaggacagucuuuucaacaaauggugcugggaaaacugaauauccacaugcaaaagagugaagucggaccauuaucuuauaccauaugcaaaaaugaaccccaaacagaccaaagaccuaaacauaagagcgaagggaaaacuauaaaaaucuuaaaauaggccgggcgcggugauucaugccuguaaucccagcacuuugggaggccaaggcaggcagaucacgaggucaggagaucgagaccauccuggcuaacacagugaaaccccgucucuacuaaaaauacaaaaaauuagccuggcauaguggugggcgccuguagucucagcuacucaggaggcugaggcaggagaagggcgugaacccaggagguagagcuugcagugagcugagaucgcgccacugcacuccagccugggugacagcgcaagacuccaucucaaaaaaaaaaaaaaaaaucuuaaaaaggggaaaucaugacauuggauuuagcaaagauuucugagauaugguaccaaaaccacaggcaacaaaagaaaaaauagauaaaugggacaaucaaaauuuaaaacuuuugugcauuaaaagauacaaucaagagagugaaaagacaaccauaaaauaggcgggauuaauauucagaauauauaaagaacucuuacagcuuaacaaccaaaaaaaaaaaaaaaaaccuacucaguuuaaaaauggagccaagcauuguggcucaugccugugauccuaguacuuuggggggccaaggcaagaggaucacuugaggccaggcguucaagaucagccuggguaacauagcaagaccccaucucuacauaaauuuuuuuaaagaaaauuaucuaguugugguggugcaucccugaagucccagcuacuugggaggcugaggugggaggauugcuugagaccaggauuucaagguugcaaugagcuaugcugcuaugauugggccacugcacuccauucuaggugacaaagugagauccugucucuuaaaaaaaaggggugaggggccaaaaaaauugaauagauaugucuccaaagaagauauacaaauggccaaaaagcacaugaaaaaaugcucaacaucaguagucauuagagaaauacaaaacaaaaccacacugggauaccacuucacaccugguaagccaggaucccaucauugaauuggugguaccaauauuugauccuaguucugucucuaaagccuggauguuugcaugauauagucucaccugcuagcaaagccugaguuuggaucugaaguuaauaucuuggaggaauucugaaacuaccccauccuaacucucaauucaugaaaggauaccaucaccacuauuuuaauaaaaguuuaauacaauccacacuucgccgauacucagauaauaacauagaagaccucuguacaggcuggaaguauccuuguuuuacuggaugcagcuauggugaagugacacuuguuuuuuacguaacaaacuagauagaacucacacauccaaacaaaagcuauacuuuacaagcagugacagcacacuccaaaaauauagcuguugcucaaaacauuugugcaacagucuucugucugcauuaaaaagccucauuguuuuauuuacugcucuuuuuaaauuuuuuuuuaccuaaaaaagauauaucccuaaccuuuucucuuuauucaucacacuuggcacucaaagacucaaagacuugaccacccaggugccuccaagccccugcucugagaaagcaaccccacccccaaauaguaagaaucugacuucacaugaaugcaauacacagccagaggacugggcaggggcuaggaggcucuugagauuuggagcaaucuuaaccaaagucaguccucagauggcaccaggcuggcaguuacagaagcaguauuugauacuugucuacaagauggggaaaguggaggaggagaggaagggaugagaaugcaugucagcaaugguuaagagccagauaggccccagagaugccauacccccucucugcccuuuucaugcaugugggaaagagaguaaaagucauaaagccagcaaggagcagaccugggccuaacagggaaaucagagccccccaagggagggcaggcaggccuaggaagaauggggguggugguaggcacaucuguuuagagaagaaaagacugagggcagagguuccaggaagguuaagggggaggacacaauguagccacugagacagcagugugcccugucacccuauggcuuauccagacacagaaugagccccaggugugcugggagccugcagcagugaaauggugccugccuccugccccugcucuuccugcagcugucucugaacaccccuccucuguccacgcccagagggaaugacucaccaccugggucacacacagcaggggcaugucugcagccauaaauccagcagccuccucaagaggagacuuauccugauggaagcagcuuugccugcgggccuggacuugcuacucuuuugagccaggaaggggagaggccagcuggcuaggggguaguagucucuccccuucacagaacucaagcuguggcacagacucucauggagaagaaaguacagagauugcacuuugguagggcuacaagggauacagucuugggaggcuuaauagaggaaauauuaaaucaaugaaaccucguuuccaaguucgguuuagcagcagaauccauuaaccuuauauucacccuuuccuuuccucuuaugauacuggggaaggguucaaaggcaugauaacuuauccucagggucagugcauucuauucaauuacugggauuugaguuuucaagcuaaaagauauauacccauuuugauuauaaagaaccaacccaaaaagaaugcuucuuucuuuucauuuugcagaaaaugccacacaaacacaaccauggguauuuagcucuacugaaacagaugagggaaguaaggcugacagaggagcucaaaucaguucugauuuuucucuucauaaaagaauuuccauucugcagcauucauucaggaagcacucaugaagagccuaccaggugccggcccuggccuggggcugggcuuagagccggggcaggauggcccggcaucugcuccauggagcucacagcccagccuaggcuggcaacuccagucugccccaguuuccaguucuguccauuccccuugcagcucagcauggaugaagcuuugaaauccagcucucccucucccucucccucucccgucuccccacggucucccccgucuccccacggucucccucucccucucccgucuccccacggucucccucucccucuguuuccacggucucccucucaugccgagccgaagcuggacuguacugcugccaucucggcucacugcaaccucccugccugauucuccugccucagccugccgagugccugcgauugcaggcacccgcugccacgccugacugguuuucguauuuuuuuugguggagacgggguuucgcuguguuggccuggccggucuccagcuccuaaccgcgagcgauccgccagccucggccucccgaggugccgggauugcagacggagucucguucacucagugcucaguggugccccggcuggagugcaguggcaugaucucggcucgcuacaaccuccaacucccagccgccugccuuggccucccaaagugccgagauugcagccucugcccggccgccaccccgucugggaagugaggagcgucucugccuggccgcccaucgucugggaugugaggagccccucugccuggcugcccagucugggaagugaggagcgucuccguccggccgccaucccaccuaggaagugaggagcgccucuucccggccgccaucccaucuaggaagugaagagcgucucugcccggccgcccaucgucugagauguggggagcgccucugccccgccgccccgucugggaugugaggagcgccucugccaggccgugaccccgucugggaggugaggagugucucugcccggccaccccgucugagaagugaggagacccucugccuggcaaccgccccgucugagaagugaggagccccucugcccagcagccgccccgucugagaagugaggagccucuccgcccggcagccaccccgucugggaagugaggagcgucuccgcccggcagccaccccguccgggagggaggugggggggucagccccccgcccggccagccgccccguccgggaggugaggggcgccucugcccagccgccccuacugggaagugaggagccccucugcccggccaccaccccgucugggaggugugcccagcggcucauugagaaccggccaugaugacaguggcgguuuuguggaauagaaaggcgggaaagguggggaaaagauugagaaaucggaugguugccgugucuguguagaaagaaguagacaugggagacuuuucauuuuguucuguacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagagucgucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugugagaaacacccaagaaugaucaauaaaaaauaaaaaaauuaaaaaaaaaaaagaauuuccagcuaaucaagagcaaaguuggaucugauugccucuggaacuaaggccacucaaugugggcucccucacucaguccuguccccaggccagaggaaagcaaaguucagucucauuuauuuugucaccuaaaucgucaaaaccuaaaauaaaaccuggugcaacagcagaaacacaaguguucuagggaacaguggggcaaguccuucccaccagccagcccucuggacggauaauuguaaagugcugaccucucuggugauaugcuaauggccaaggacugggcuggggaagaggcuggguaggguaggccaggcugggcuggacuggacagggcagggcaggccugagcucggguaaucagauacggcucccauuaaaucuucagugcaagagcagcauagcauccugaugccguugccauggcauuuucucucgccugggguaggacccaggccaggaugcccugaagccuugacgcugacagcagugauagugcuggcucugagcaugguuuuucugcccacccacccuccuauguucucugaaaccuaaggcagcccuguuuggaggagccucgcaauccagcggcuuggcuuuuuggcugccgcuuucuacacuuugauguuaaauauagugacuucagaagcagccaacaccagaaggcaaaagaggacugguuuuagcauuuugcauucagcaacauccuuuuggugagaauggagaagaaaacagccaaaugaucuaccuccccaaccaucaagaguguuggggcugggcacaguggcucacgccuguaaucccagcacuuugggaggcugagguggguggagcaccugaggucaggaguucgagaccagucuggccaacgugccgaaacccaucucuacuacaaauacaaaaauuagccaggcaugguggcacgugccuguaaucccagcuacucgggaggcugagacaggagaauugcuugaacccaggagguaaagguugcagugagccgagaucacaccauugcgcuccagccugcacaauggagugagacucugucucacauaaaaauaauaauaauaauaauaguaauaaucacugaaucccaccccauaccauucaaaguagaaccucuggggcaugaggcucagguauuggugcucucuagaagcuccccaggugguucucguguacagccagggcugagauccauaacuuagaggaaggguugcuaaugcagucauucaucugauguaaaugcauugcacuacugccaagugcugggcacuggggacccaguggaaggcaagacagaccuagucccugcccucacagagcucacaucccagagggggaagggagucaagugacccuggcuguaguccuggcucugccacugacgauccugagcuccuggaccuuucccuuuucuucugcgggccccggguuucccgucaaaggaggcuacagacccaaaugaucucugauccccacccugcuacucccugacccagcaguccauugaccuauguauaauuuuucugucuuuuuugguggugguuuuuaaaauacacauaacauuaaauuuaucauuuuaaccauucaacaaaaaguuuuuuaagagacagggucuuacucuguugccuaggcuggaaugcaguggcucaaucauaucucacugcagccucaaacuccuggacuuaagcaaucuuccugccucagccucauuaguaguuaggaccacaggcacaagccacuaugcccagcuaauuuuuaaauuuuuuguagaaacaaugucuugcuauguugcccaagcuguugucaaauccuggauucaaguaacccuccugccucagccucccaaaguucugagauuacaggugugagccauuuugccuggcccauuuuaaccauuuuaaaguauacaguucaguggcauuaaguauguucacauugugugcaaccaucaacaaccaucuccagaacucuuucauuuuccccaaacugaaauucuguguucauuaaacaauaacuccccauucccccacccccacaccccccagcagccucuggcaaccaccauucuacuuucugucuuuaaauuugacuauucuagguaccugauuguaaguagaaucaucuaguauuugucuuggugaaaggcuuauuucacuuagcacaaggcccucaagguucagccauauugugcaugcaauaggauuuccuuccuuuuuaaggcugaauaauaauccauuauauguauauccauuuggcuuauccauucuuuaauugauggacacaggcuguuuacaccuuuuggcucuugugacuauugcugcuaugaacaugacucugcaaauaucuccucaaggcccugcuuucaguucuuuuggguauauacucagaaguaaaauugcuagaucauaggguaaugcuauguuuuuuguuuguuuguuuguuuuuguuuuugagacggagucuggcucugucgcccggguuggaaugcagugacaugaacuuggcucacugcaagcuccgccuccuggguuuacgccauucuccugccucagccuccugaguagcuggaacgacaggugcccaccaccacaccuggcuaauuuuuuguauuuuuaguagagacgggguuucaccauguuagccagauggucucgaucuccugaccuggugauccauccuccuuggccucccaaagugcugggauuacagacgugagccaccgcgccuggcuggguaauucuguguuuuaacuaccguccuguuuuccauagcagcuauaucauuuuacauuuccaucaaaaguguaaagggguuccaauuugucuauauccuugccaacacuuguuauuuucuauuuuuuugauaguagccauccuaaugggugugaggugauauuucauuguguuuuugacuugcacuucccuaaugcuuagugauguugaaccucuuuucacauacuuguuagucauuuauauaucuucuuuggagaaaugucuauugaaguccuuucccauuuuuuaauuggauaguuuggguuuuuuuguuauuaagcuauaggaguucuuuacguagucuggauauuaaccccuuaucauauauauaauuuugcaaauauuuucuuccucugcagguucacuguguuguguccuuugaugccuggaaguuuuuauuuugauguaguucaaaauuuuucuuuuguugccugugcuuuuggugucauauccaugagaugauugccaaaucuagugucaugaaguuuuuucacuauguuuucuucuaagaguuuuuuaguuugagcucuuacauuuaugucuuugauccauuuggaguaaauuuuuguauaugguguaagauaaaggguccaaguucauucuuuugcauguggcaauccaauuuucacagcaccauuuguugaaaauacuguccuuuccucauugaguggucagaaagucauuuuguggaugagauaaaauaauguacgugaaacacccaacaccacaccuacaguggcuugauaaccaaugguccuuucuuucucccccuuaucugaaauguaguuuuuaacuacugcaauugauuuuuaauaaucccaauagcaaauaccuguauaguacugacugugugcuaggcucuguucuaaguguuucauguauaucaacccauuuaauuuucauaacaaauauaucagguaagugcuguuguuuucacuagcuuuggcaccuagaaguuaaguaauuuacccaagaccacacaacuaguaaguaguggagccuguauuugaaccuagguaguuuggcuccagacucuacggguucauaaaccuaauauccucauguuuggggugauuuuugauggcuuaggccugucauaagcuuuucagucuagaguuuggugaaugaagaaccucguuauaacaucagcccucaggccaggaccuuucccggguguucucuugugauaauagcacuccuagaauggcucuguuggcucagcccaucugcuugggagaagaauguggugguucuggucucuucccauuuccugccaaggcccacuuauuccaggagaaauguaaacccauuuucucucugauuucacagaaaaggcaacagauggcucccugcaaagugaggauuggacguugaauauggagaucugugacaucaucaaugagacggaggaaggguacgugugccccccucuccugggaagccucucugagcuuuuaggggccacucaaagcuugucagggccuaaggguggcagguuuuauuuuuuguuuuguuccuaguauguuugguuuggcaucgaauaagcugacacucugaauuaucuguccuuuuugucuucaucccucccccacuugcccaauggcagugcuuggagguagaacagggaugaccuccuuuaaucaccugcuuuuaaucacaaguggaaaugaagcugcuugauuacuugguucccaguggccauuagucucugcagcccaagugucaccucgucccuccccuccucccuggccucugccucuccuucacagccugucucugcccugguuugccaggagucagagagcaccaccguguccauggagggagguccagggcauggggcagacacggccgggagugggaaagcggcaugaguggacuuagaacacguugccccuccugcauuccugcacugcuggauccguuccuguuguuauuuccugaauccucuuuuguuuuacagcugcacucuauuuguacuucuuccaaacuggucuguauuuagcccucuguccauaccacuaacacuuacuuuacuguagccaugcccucuuaaaccauuuucaggaguggcaaggagagcagcugggacucaggcaucccugggcuggcaucucagcacugucacucuagccuugccaugugugaacuggggaccagccucucaagcuugguccugcuuucaugcaacaaauauuucucgaaugacuaccuugugccaggcccuauuguaaauacugaggacacagcagugaacaagauagauuccuuccccuuggggagcggccagucuagaguaguagggaggcaggccauaaacaagauaauuaaacauauaaccuggucagaugaggacaagacuguggaagggagauggggagagaggaggcugggaauuagcaauguuaaauagagugaucaagaaaagucuuggcugggcucggugggucacaucuguaauccuagcaccuugggaggccaaggugggccaguugcuugagcccaggaauucgagaccagccugggcaacacgguugaaucuugucuuuacaaaaaauacaaaaguuagccaggcgugguggugcacaccuguagucccaacuacuugggaggcugaggugggaggaucacuugagcccaggaggucgaggcugcagugagccaugagcaugccacuguacuccaguuuuggugacagagaaaaacccugucucaaaaaaaaaaaaaaugaaaagagaagacaaaacaacagaaaagucucauuuagaaggugacauugaacaaagacuugaaggagaugagggaguagggggugaggauuauacaagggaagaacugucaaggcucauggaacagcaaacccagaaguccugggacagagggugucugauguguuugaggaauagcaagguggcuaaugggcccggagcagaguggucaaagaagagaguaccuggagaggaaguuaccgacauacuggggacccagauaacacagggccauguagaaccagagcaacucuggcuucaaccuuuuuggagauucaagcagaggagugguguggucccacucuuauuggaaagagaucacucagucuacuguguucagaguggccugacugggggcaggccaaggacaaugcagaaaacccagcgauggccuggcauaguggcgugcaccugcaaucccagcacuguacgaggcugaggcaggaagauugcuuacgccuaggaguucgaggcugugaugaaccaggacggugucacugcauucuagccugggcgacagaguaagacccugucucuaaaaagaaaaaagaagaaagaaaacccagugaggagguuaucacaguaauacuggugugagaugaugauuagaagugaugggauucugaauguguuagaugguagagccaauggaauuggcugacauaagacaggaaugaagaguuaagggaaauugcaagguuuggggccugaacaaccaugggauggagcugcuguuuccugagguggagcaggcuggggagcagagaucagcaguagaucuuugcugccagccaggcuccuggaagaugugacagggaacugcacagggaacuugaguugggggcaguggccugcacuggaugaaaacgugggagucuuuggugaaagguggcauauuuucaccagcuaaauauaggugaucagcuuggugccugguacacagacgugacucacaaauaguuguuagggacuacacaucucuaaucccaucgucacugggcuccgaguggcuaccuuccucacguccuccuaacaugccacucauucacuuguuuguccagucaucuggccauguuuacugacccccagggguggagguauagcagcuacgggaugccaaggugaauguuccagccugcccuugaacgcucaccuggcaggacuggcaagggcuguggccaaggccugucccugaugccauggucccagagggaaagguggguaucaaugcuuccuggaggggcugucuuccaggauggcaggagaaaugugucccguagccaaggguggcaucaaaagggccagugugucaagggauacaagcugucuaggauagacagggugacauugggggagcgggagggucuggaauccggcuggaaagguagucaaggucaggugcugcauucucuggugucugcacuuuacccuagagguggaccucugcuucgaccccuucccuccuaccccuuccugcugcacaacgaccaaguugcucccuugcuaacaagccuucagggguuucgcaggcacuuagguuaaaaaccccaaccaggccccucaugaggagccccagaccccucggcagcuccacuuugagcucuucaacccugcugaucuuucagcuccuugaauuuuccauauuccugggcccagcuugaaauucucuacagauuugagcaauauacaaauauguuggcaacucuuauuuuccagugaauugcucaaauaucucuauggcuugagggcaggaagcccaggaaccccaggagcuuccuuauucugaaggggccaaugccuucuuuuucaaauccucaauucccagaaggcuggucacacacaucuuucucuucaaguggcuaaagcuccuguugcuaccuuuuugagugagagcaccucagugauuccugagaauguuuucuuguugccucugcugugaggugucucaaaaucucuuccuagcaaggugcaguggcucaugccuguagucccaccuauucagaaggcugaggcaggaggauugcuugagccuagguguuugagaccagccuaggaaauguagugagaccccauaucuuaaaaauaauaauaauaauaauaaucucuuccugagugaaagaaacucccacaaguuggacugacaguagggcaccccacccaccccuuugugcccucccugaaggccucugaccugcugucccuucuguucucgucaccucuuucacuaaguagaucccgucauucacuggaucucucaguuugaaucucauuucccuaaccccuuccccuccugauuuggacaaguccucuguuauaugauuucauaacccguguuguacugaugcucaucacaguuuaaacuuacagaucugugggacgguuguuagugucugucuugcccugcaacccccgcaaggcugugaucuccaugaggacaggauuuccaucuguuuuacccaacauuuuuuuuuuuuuuuuuugagauggagucucgcucugucgcccaggcuggagugcaguggcgcgaucucggcucacugcaagcuccgccucccggguucaugccauucuccugccucagccuccugaguagcugggacuacaggcgcccgccaccacgcccagcuaauuuuuuuuguauuuuuaguagagacggaguuucaccauggucucgauccccuuaccucgugauccgcccgccucagccucccaaagugcugggauuacaggcgugagccaccgcgcccagccaauuacucaacauuuugucccuagcaccuagcacaaugcauuugauuagcuguuaauaaauauuuguuaaauaagugaauaaaugaaugaagucucuaagguacucacagucugaugaggaaugcaggcauauaaacauaugcauaacgagugcuggguggggggcagggagagagagagaagcuauauauagcuacggagacuagugcaguggcaguggucagccuugggacuuuuggcagcaaagccuucuuggaggaagugacaccagacuggagucuuacagagugccaggguaucagccagaugaggcagguggaugaaggggaggaagguggacaccacaggcuggagcaauucuaggucaccacucgcuuauugugcgagccugugugaguuacuucaucucccugugucugugucccauuuccucacuuauaaaaugggguugccaauaauaccuaucucauaggguuguuacaaggauuaaaggaguaaauauauaugauguaucuggcuacauaacuguaucuucauauccauacuauaucuauguggauguacuauuucacuuuaaagauuuccauugcccaugacuuuugucaucacuuucauuugggugucaguuaucugcccagucuuggugacuaucuugguggauucacugcccuuacccugucugcugucugugagcacuuggcaugugccacgcccugcaggcccuguguccagcccugcagugcaucaucacaagcagcgcccccuacccccaacaguucuauaugguagugacagccuguuucaguguuaaggaaacugaggcugaguaguuuggucacuugccaaaggccuugcagcacagcuuggaagggcacaugcaggaugcaagcacaggcucaccuggccgcagccacugaagugcugccugcacuucuuguauuugugcaauacuuuaccaaugggaggcugugguccuggugggugcagauugguaaacugcccgaaaggccucuccuugggcuuucccuaauguccagagcugaggucaccaucagccugaggaaugcugaugccuaaggccuugaugacaguccuucaggcauuaaccaggaguggcugacugaauaaccuaccugggacuguuuuuauuuauuuauuuauuuuugagguggaguuuugcucuugucgcccaggcuggagugcaauggugugaucucagcucaccacaaccaccgccucccaggcucaagcaauucuccugccucagccuccugaguagcugggauuauagguguguaccaccacgcccggcuaauuuuguauuuuuaguagagacaggguuucaccauguuggccaggcuggucuugaacuccugaccucccaccugccuugggcuucuaaagugcugggauuacaggcgugagccagagcacccagcugggacuguuuuagacucuguuuuccaggccucaccucagaccuacacaaucaaggcacagcuuguggauuugggaauggcacuacaggugacucugaugugcagcucucaugaggaaccccugaccugggucauuuacauggccaucucuggacccuccucagcucauagaaucuuuguguucuaucuucuaagcuggagagggcacagaggaggaacugaagacaugcaauagagcaagauaauaauggggagggcauguucagggugacagaagaggggcagccauguccuccuugggggugaugaggagaaagcuuuuccagagaguaguccugaagcugaaggacaaagauacaaaggcuguggcuggagggaugacaggaggcuuguuuggggaucagggaagaguucuuauaagucuaggguccagggagacuuugaggagccugaucauggcccagaggccaaaucacgaggcugugagcacugccugaggagccugaccuuuccccugaaagcugcuagggcuugaugccaucucaacacaggccacugauucuuccugauccuuucuuucugcuccaucuuggcucuugacacaugcuucugucucuucuccugguuuccaacuccacacuaucuaaucugcugcagcuucuugaaacuuuguguuuccuuugacaugacuuugauccuccucucugaagcuuuucccccggggagagagauaaauacuugcuuuugugcucacccaucacucucggccaguacuucccagagccuauggaugaauuuucauuuuaaaccucauccaggaagcugcugacugucugauuucccaccccguggcccccacaccaggagagcccugagugugcugguccucugccagccagaaaugauugcagcccucaggcgcucuuccuauuuuccuguuccauggaaguucaagaggacagaagagaggacugagggguguggcagcugugggucagggacagcagugguuuggcagagccuuggagagaggaaaucaguccaugcuguuggccaguagccacugaauuucaucagcucucaugccacaaacagccuucaaagcagagagccgguuaagucccauauuugcagaaaucagcauccccuuuuggaaauggcagccguacugcagacauacuuggccuugggcccaguccccauggagccuugugucugucucaucagcccuuugacccaggggccaagaauuccuacagggcagccauaugucaagcugggaaugggaaacaggugauucaggguguuuuaaaauuuucuucuaguagccuugcuccuuaaacuuuuuuucuuucuuucucucuuuuuuuuuuuuuuuuuugagauggagucuuacucugucacccaggcuggagugcaguggcauaaucucagcucacugcaaccuucacaucucagguucaagcaauucucuugccucagccuccagaguaccugggacuacaggcacacaucaccaugcccagcuaauuuuuuuguauuuuuaguagagacaggguuucaccauguuggccaggcuggucuugaacuccugaccucaagugauccacccaucucggccucccaaaguccugggauuacaggaaugagccauaaugcuggacacacuuucucuuuuuuauuuuuauggagaugaaguuucacucuugucgcccaggcuggaguacaauggcgugaucucagcucacugcaaccuccgucucccagguucaagcgauucuccugccucagccucccgagcagcuaggauuacaggcagcugccaccacacccagcuaauuuuuguauauuucaguaaagacgggguuucaccauguuggccaggcuggucucaaacuccuguccucagguuauccaccugccuuggucucccaaagugcugggauuacagacugugagccaccaugcccggcccaguuucucuuaaauuaagcugauuagcagagcaucaacccuuuccccuccucaacuuccucauacacauuugaaggggccuuuucauuugguagaguauaaauguuuuaaaacuguaggaauaggagaucccugacuuaacaaacgugcaagcugggaaagaccaguauauugacacauagauuaguggaaggcuggaacccaugugugauugcaaagcgcuggcccacagccggacugagggcuccccagagcauagggugaugggucaggucagcacaggggcuuugugccaggggcagcugcuaggcccacagcuuuguugaauccugaguuagaauaaauuaaauuacauguuagacacaagaccuacauguaauauguauacuuagagggcugccugggaauccugacucuaagguauaagaguaauuaaggaagaacucacuccaacuuccaaacagcuccacuccaacuuuuggacagagcccauuugugaacugaguacugucuauaauucugcaagauuuuaucugggaauccaccucagaucugucaccuaaaaacacaaaacuuguuggguuuuaaggagacucacuuaagcuuucucugggaaaaggaguuccauggaauucaggaagagccgggcauccagggcucacaaggaccuggcacgcucucuucugugucucucauaugguuucucuggaaaaacucucuucuauguacccacacaccaguggguuaguuaggguuuugaauaaauaauacuugcaugugauacagaauucaagaggucugcaaaaaggcaguccagugaaaaaccucccuccgccuuugguucccuuccuuaggggcagccacaguuaccagguuguuauagcucuuucuagagagucucuucccuacgcuggcaccugugcuauguauguuugcuuuccuucuauaacucaacuaauagcaagcuuuguacacuguuaugcaaagaacuuuaugcacaugucuuugaguuugguguauauuggugcaugaguuucuuuauucuuuuuugcagcugcauaguauuccauugugucaaugauuuaauuuaaccuguuguguauugauggacauucaguuuguucccagucuuuuacauuuacaaacaugcugcagccagcaaauagucuugcauauauacuaguucacauaucuguaggaucguguccucaagugggauuguaaguaucuuuauaugucuguucuuuuuuccaggccaaaggaugccauucgagcccugaagaagcggcucaacgggaaccggaacuacagagaggugaugcuggcauuaacagugagugcuauucuccuugaggagagaagucaucuggggaacuccuugcuccuggccuugccccccucacagggccuucccucugcccacuuagcacaaccucugaauggcuuggugccugggccacuggaguccagcaaagccuucugguauugccuuuggguuuuccuguccucugaaacagggaguggugagcuucaauuugguaaauguauacgagcagaagauaaggugugugcagugcugucagguacagaagcccagagcagaggagcuaaagguuuugggugggucccuuuucugucaccagccugcucugagacugagaccaacuccuucucuagauaucaguuuccucuuuguaaaaauguuggccaggcgcggugacucacaccuguaaucccagcacuuugggaggcugaagcgggaggaucucaaggucaggaguucaagaccagccuggccaacauagugaaacccagucucuacuaaaaauacaaaaauuagccaggcaugguggcaggugccuguagucccagcuacucaggaggcugaggcaggagaauugcuugaacccgggagguggagguugccgugagcugagaucgcaccacugcacuccagcuugggcaacagagugagacuucgucucaaaaaaaaaaaaaaaaaaaaaguuaacuuccaccuauugaguaccugccccugccugggacugugcugaacuuuuuggacauuaaugaauauguuuacaaccacccuccaaaagagauuuuacuauccucccccguacagaugaugaaacugaggcucagagaggucuggagguuuacccagccuucacagcuagugagguguacugagcuguggauugccaucauaaaguggucuuuugcaugggguaaaaacugaaaauagcuacaaagacucuugaaaaagucagccaagugauuuuuuucaggaaggaacagaccagauuuuugcccuuaccaaagcugucagagaauuuaaaaagacgacuucagguguuauuucugucuugagaacuaacaguuuuucagauguggcaaaaucugggccacagugaguucuuaaaauagaaacuguaacaggucaccaggucaacuucucuggggcuuugaaauaguagguuauuuauccaaaacaaccauguuuccuuuuaaagcagagaaccuguuuggauuuuuugcccaagcgaaaccccaaaacuuauuaagagaguucugccagggaauugggauuugaauaauaaaggagaaaagacugguugagaaauagggaguugaagcuuuuauuuuauuuuuucucagaauuugagccacagcauucacuaaaccaggagugaugcccaaaacgaguggcuuucaauaacucauaucacgagggaaugagcucuaauauaucagggaauuuuacugcuaucuaaaacaucuccauuuacacacccaacuucaugguaaucguguuggauggaaaucuuucuaaagugaacucugcguuuacuugccuuccucuagcagggcaugauggacacuguuugaccuuuccuuggguuaggucuucacuacaaacccagccaugccuuugggaggccugugaaaugcgcagggcugccgucccuacacugaggccccauccuagcgcgcuuugcauggucucacgucugcugauagggcuucacuuacucucuuagucacuuucaguccuccuguuuccuguggcccucuccggacuucauaucuguacccaccaaaauuguuaauauuuacccaaaauaaguuaguaagaagcccugaggggcucucugcuugugucuucauuuguggacuuaaacaucacuucugauugcuuagaggccccguuuacuuucuccauggcuuuuggcuucauucuggaaaauuaccacuguauguuucaugccuuucaaccuauagggacaaaacugccaggguccuguuuggcaggguggccuaaagcggcucuugccagcccagggaggaccuccuagaucuccugcucagauaggcuuuggggcugcucuguggcacaugcaucucuguccagggcacuuccaagaccaggcugggacacacugaccuugaggacugcugugcaggagaaacuaagcauguauucccuaauggcgggcagugguuccugccacuguugcucugagaguggaguggagccccaggcugcucuacuccucagaccuaugccuguuuuuccaauucucuuccccacucauaauugcagccucaccuuucccaccugcuucucacaaaauaaagcauacuucuugccaucugccuugaccccaacaccccacugccugaguugggaggaagguuuuagagaauccuagagagaagggugccuguaaggcccuugagaacagaaagaaccccucugguucauuucagugcccccauggaucacuacaagagagugaaugccaauuaccucacgguuaccagaaucaggcacaagcagagacucagaaaggaaaaugccuccuuggcuuaguaaaaccuguggucacucagaggcccugagggugcuaaccuccagaaucuuccuuggcaagcccagaggaacccggggccuccuaaggugcagccagcagcaaggcaaggaacgauucuggcuggcugcggagcugccuggcauggggagucccagcuuuggccuccuagguuaaguuacaugguaccucugauccucagcuuccucaucucuaaaaugggaugauucccaucuuacaggguuauuucaaggaccaaaggggggaacaauaaaucuaacacauguugccugucaucugaggcacucuuagcugauguggcugcuuggaggagagcugugagggagggauggcccuguggccucaaggugggcgaggagacuggggcuccagagaaggcuaaucacagcucuugugcuccuucuggcacugacugacaauuuguaccuagaucaaugucuucaccuuucuaaaccucuuaacucuaaaacaugggauauuaagguccacuuaaggagaaguaauuaguugugagaauuggauaaaacuccauauguuauggaaggaucucucauagugccuggcauauagucgcauucagucaguguuccaguuauggaccuuucuuuacggcuauguuuuguccagguaaagcccacuugcuuggaccuagcccugugggauggcugcagaaguuaaccagugguuggauuaguuugggcaaaugagaauaauugagguagucagaaauguucccuguugcuggugacaucguuuugaggaggcauuccccaguuaguagacuguggcacugggggcuguuggcaugggaagggccagguaauccuauggguugguuuacacagugcugggaaguucagagcacucccaguuggcaccuccgaauuccaagaggcuacauaccuguccuaugggaggauaagaggccauccccuucgucguguguacagcagccuucugaacaguaaucacguaaucauggucaucaguuauugggcaccuccccuaugcaggauacuuugcuaugugcauuauuuuaugcaugcaugcaugcauguauguauguauguauguauguauguauguauguauguauguuuuugagacagaguuuuguucuguugccugagcuggagugcaauggcgcgaucuuagcucauugcaaccuccaccucccagguucaagcgauucuccugccucagccucccaaguagcugggauuacaggcaugugccaccaagccuggcuaguuuuuguauuuguaguagacgcagggcuucgccguguuggcuaggcuggucuugaauuccugaccucaggugauccaccugccucggccucccaaagugcugggauuacaggcaugaaccacuaugcccggccuaugcuuuaaacguauucuugcuaaucuuuccaacaaucuugcaagggagagcucaucaucucugcuuuacagaugaggaugcugaggcucagaaagaucuguccugggccauucagggagaaagugguggagcugagguucaagcucucacugaccgucuggccagaaccaguaugcugggcuuuucugagcagcuaaagccugugucacuuguuuucccagacaagggaggagcaggcagggucugaauugaacauggacauuaaagucaccuggcagcugagguccacaaaccauuugucaagaguggaaaauccuuugucauugccaauuuugguugcagaagcaggguugagugggggaugugugugugcauuugcuuucucacauauaagggccaguaacucacuaagcaauucaagcugucauagcagccuccucuugugacagagcccauguccgauuggcuaaugccuuauacccagaggcccagagagaggaguuaaaaugcuaauuuucagggaccgcucagucauuuugaucccauuaaaacacuagcauccuucucaugcaaaacuggugccucaauuaccaacuaauugccugauuauugugcagggacaggagacuucagucaguaaggggcugcugucaucccuggagaauggagugugggaaugcgugugccaugcagguuuggcucuggaggagacgugucagaaagcugaucuaggagcaagacagaggggaugguggaaacucagcugcgcuccucaguucccagugucuucuccagcucccacuggggugacccuuuuccuucccuccccacaucaggugcuggagacaugugugaagaacuguggccaccgcuuccacauccuuguggccaaccgagauuucaucgacaguguucuggucaaaauuauaucucccaagaacaacccucccaccauuguacaggacaaagugcuugcucugauccagguagguuggaccccuugcccaauuuguuggaacagaguaagaugaagucucuuauugaugaguccucaugcucucccaccauuuggaggaaaaaaaaaauggagacuucuacauuuaaaauauuuggugcaaaauacuucaaaaaaaauucucaucccacuggaaugaaauucuaauugauggcucuccagccaguuaacagagccuuccugaagcuuucugggugccaucccucugcugcucacaaaggcagguaggguggccucaacaggccucugagaaaacuuggaguaggaagaaccauguuagagcuacgugcggguuuggugaggucacagggcaggggccaacucugggucaggcggagcaagguaaggggcuggggaugguguuaagggauguuucacugaggagaugacauuuccauuggacccugaagaaugauggggaguuugguggaaaagucagugggagagacuucacaggcagggagaauagcaugugcaaaggcccagacgcaucaaagagagcaguuggcauauuuggguuguauuuguuaucacucacuguguuacaaauuaccucaaaacauaccuucaaacggaaaauguucauuaucucuuaguuucugugggccaggaauucaggagcagguggcugggcaauucuggcuuggagucucucuugagguugcauugucugaaggcucgacuauagcuggaggcuccacuuccaccauggugcacccacauggcuguuggcaggaagccucaguuccuugaugacuauuggcaagagaccugaguuuaucaccauguggacaucaagauuaggucuugaugaccuagccuuggaagucacauaccauuuuuuucuguuauauucuauuuguuagaagggagucaccaggccuagccucaagaguaggggaaauaaacuccaucucuugaagaaaggaggaucaaauaauuuguggacauguuguagagaccacuauguggggaaggggguguaaugaagaauguugggggcagggcuuggggugggggagcaggcaggagaugggaccagaaggaugcccagaggccaguggccaugcaugcugaggaggcaugcuugguccuguaggcagugggaagacaucgaagggcucugagcugggaugugugcagaccuggguuuuagacagagcacguggugacacagaaggcacauaagucaacaggcacauccagccugggugauuagugcuguggcagaggcaagacaagggccugcaggagccaagaggagagacaaaccuagggcugggcguggggcuccagcaagggcaaagggaggcaaccaggcagaggcagcggagaaugcaggaaguggagugccggggcaggccgggcucucagaugggucaggugugcagcuggagaggagccucuguccauucccugugcucacuucccucugccugaaaggucuuuccccagcuuucagagcagugacuccuccuccucauucacaggugccucggaggccuccagcugguuuuaagcacacacacucucugucucacaucauccuuuuuuguggucuucaagacuggcuuugcuaacauuucuuuugucugccucauucuucguucccuaagaacccagggacaugcuguccccagggucuagagcaguguaauguguagagcggguguucaguauuucuuuauaaugaaugagugaauguaguuaauucugaggaacucugggaggccuuccccuguuuacccuaggguugucccucgucccuguucugcccacccaauauccuucugucucucugucucccucugacacacacacacacacacacacacacacacacacacgugugcaugcacuuuaccuuccucauacaccccacucuaccacagcccuuccuucuggggcugcacuccccuaccucaauacccccaggaauucauguuaggaaaacaaaugguggcuucuucucacaaagcauguccugugguagagcuuucugaccccgaggccugucugcaggguggcgggcccagcaggguggcuagccuaccgcauggcaagcacaguuaucacaaggggugugaacugcacugucccugcugacuguguggggaccauggcugagggcagacacagccuucuucacuggcuguggcccacaccucuacccugaggaugccuguccccgcacacccugcccucaccuccaagcuuuccuaucaggaucaccccuccacacuuuccagcuccuccuagcuuuuacccaguccugcugcuaaccucagacagguguacuaauuuauugugggcauguaccaccuuaucuguaaaauggaacuugggguucuugccugucugcucucaauccugagcccaugagaucagcccaaggugugaaguggccagcaccauguucugaggccucccccugcuggucuggcaguagcagugugugcuggccauggggaccugagcagaacagggccuugagaugccucacaagcuucugccuggcuggacaguuuccugguccagcugugaaaagcaugggcuucagauaagggugcuacuccuagauggggguugauaacccagcuggagaguguucuuccucuccagauuugcaguguuccugaagagcucuuaccuuugguaacggcugcccagcagaggacagcaggcagcauucagcuguggguggcuuggcuucuguaacagggugaaccaauggaauaaacaggaucccuagcccuuucuuuuuuuuaaacuuuuaauugaauuauaauauauauacaggaaaucacacauaaaaguguauacaacuugauaaauuuucacaaacugaacauguaaccagccccugcaucuagaaacagaauaugaccacacccaaaaccucccaccuuccggaugaccacuugccugagcucucacagcauagacgagucuucucuguuccugaacuucauccagagugcucuguugccucugcuguguuugugggugucacacgcauuguugccugugauucuaggucuuucguugccauugcugugccaaguccuguugugugaacacacuacaguuuauuuaccccucccacuguugauggggacuugguguuugcaguuuggggguacugugaaaaaugcugcuaugagcaucuagcacuugacuuuucuugagcauauauauauuccuuuuuaaugggaauauauuaaguugaauaugugaaagugccaucuuuguuggucaaaaauggccaaauauuagcaauuucauauguauccaccucauaccggggugugagguugcugugugguggggaaugggcuccacugggcucuuggguguucucagccaccagcacccaagaauguuaguugcuucgcauccucacccacacacccuguuuucaaucuucuucauuagagcauggaguagcauugcauugggucaaccuuuuuuuagccccuuugagaaagaaaguacuuuuauuugcauguugaauauacuuuagaaaacuuaagacucccccagagacucugacaauucccccaggagagaaagugcugcucccaccaugagacaagaaugggguuggaggugacaggucacuggcugccuugccagccugugaguugguagcagcucucauaucaaugcggcuaggcugagaggagguucagcuaaguguggggugccagagcgguaacagacuucucugcaccaucgugguaucaggaugcuucuuggugcucuucagagaagugggacagggucaguccuggcccuacccucagggagccugcaguuuaacuggagaagcaaagguuugcagaugacagagggugagggcccagccaggaaggacuuaaacuggcuuuugacuguuuguggcuuggggguggagugggguacagccuuaaccuuuccauuauggaaaaguagaucgaauguguuagcacuugaaaagcuuucaagguaaaggggccacacagacgugccucccuaacaccuccugccugugaggcaugguuggggguccuggcagagguagaacccauggcucugauuaccagcugcuggccaaagcccacugccccuuugguugcccugaggaugguggaagcagagcugcagccagauugaggggaagggggagguugggcuccacacuagcuuuuccaaagucccccugugccuauagggaagugggugauagagcucauccgugcauaucugccugcccccagcccaccuucugauucccuuucagagugccauucgcaggcauggucagccuacccaguggcaccuuugccaucaguagcacccuggccaacugcaaagagaauccagcugaugccuaccccuccuuuccccacuguacuccuuccuuucccguaugggggcuuucugucuucuggcugcccuccagccauccguagccaccccaucccccucaacccgccaaaagacagacccagcagugugguucugguacuuuuuaccaacaugugcgagggcucagucggcuuacccgcaccacaggaucugccuuucuggauggagccggucucccugggaggaugggaggaaagacacauugagaguggugcagccugguugguagcuugcugacacucacuucuacccccaggggcaccaaagacuucccuuccggcagcuuucagcuucaccccuauguuuucaccucaugccuuggcugguguuuuggcuugugucccuuuuuguuugcuuacauuaagucccauuuguugagaagacaaaaaggaugcucccacucuaugccaucccugagccuuucccuugaaauuguuuucaggagcggaaauggagucauccuggcagagucaccucaguguggucaugccucuccagccccccuccccaugccccagcaauagucuaaccauaugcacuuuccacugaagaaagugaacugauugggguggggaugggaguggggacaggagaaacuggagguguguguucuuugaagacgucagagccugguagcugggcucuggccagauucuguguggacagcagcucccuggggacccugucacugggaauaggaagucuggucuggggcauaagcaggagcugacagaagcucccuucuauccaaaggcaucccagagcccauaguuuaaaucagcaaugguuuauuggucugaaauuugaugauucaaagcuuugucaaaacuuucagggauacagaaaugaauagguuaugguuuauguuuguuucugguuuuauucugggguuuuguauacgguccaaaggaaugaaggagaucugaauugaucucuuuccuuuuuucuccucauuagaccuuccucugggucuuccaagccccuaaucuuguagccacaggcaggaaaagaaggcuuccagugaacugaccacuuggccauuaaccagcuagcuccugugacaggcccucagagugugcucacaccgcugcaucacuuugcuuucugaaaaggcagcuuuaagagggggcagccucccccacccucagugcugcucucaggcuucagguuaagcacuccaagaguggccagaccuccugaggcuugccacaucuucucuagggaguauucucagcugggucagccuuccagcaccccuccuuugucacugucacuucagucuguugacagccuaaguggccaucuuuccucuguucucugaaguaggaaaauaaggaugcuuaguaacugugagaacugaauucaguuuaaccugauaaauguugacugacugccuucucuguacacgggugagagacucggugucugccuucaaaaggugucugggcugggcgcaguuggcucaugucuguaaucccagcacuuugggaagccaaggugggugaaucccuugaguccaggaguucaagaccagccuaggccacaugaugaaaccccauuucuacaaaaaauacaaaaauuagccagguaugguggcacaugcuuauagucccagcuacucuggaggcuaaagugggaggauugcuugagcccggaggcagagguugcagugagcugagauggcaccaccauuguacuccagccugggggacagcucugacccaugcccaauuauugaggcaugucccaagaagaugcuagggacacauggcaucucuggaugucucccaucuguacguuuucacauaugaaugggagacacccagagaugagagacacccagagcugcauuuauucagaggcgccccugcaccccauuuuuuccucuguuggcaugagaauccuauucaauagagauugccaucaugaauaucugcucuguuagcagccaucucauccagucugcacagaggucccagauaaggguuggaauuguggcagguaggaagcggguagauuagccaagacuacuugaucgcaaauaacagaugccaacuccagcuugccuaggcaaagagaagaguuugucaugacagggcagagucucccagaaguccaggucaccccgcccugggaagggacagaaaauaucaggaaggccuuccaaauccucuccuguacgccugcaccuccgagcacucuagcugcuccuucuggagaacauaggcugucucugcuuccaguccugugcuggcacauggcccuggaguuacagaggacaguucugccuacccagugagaacaucccagcuucuagugcugcugaguuccuggaaggaggagcaucugauuggcccaacuugggugugcauuucccucccacuccagucugucucugugaacauggaagcagagugccuuagaaaguggacccgaagaaguauccuccaacuggagagaagagccauaguucuuucaucuuuauuccuauuaucucaaauuuggcuuggguagagagcuagaugaauugaaaggaaucccuggagcuguugguacuccauguacaaaggcaugaaguggugccaggaagaacugccauguguuuuuuccccagccuccgacagugggcugugaaacugguuuuuagacccuaaagucaacacccuaaacuaaaaugcuagggcauuuugagguuggcgucacaggacuuagcuggauuuugaaccagguggaggcagccagcgcagcuggugggggcggggccagaggcacucccuacgggcaaccuacucuccuccagcugggccuuccagacagugcucugugaggcacuuucuuuggcccuccucagaauccagaaggaguguuggccaagaggggcuguccugauccaguaguuuuaaaucccugagcaugcaaauuaaauaagugcaucagggaaagccgggcugacaguacuguuccuggugagaugcaucagucauaauuaaggaggcuuuuuggaaacugaccuuuuaacuucaaaugggucuguugguuagagacagaguuucuguggcugccucaggauugguuguaccacauugcuggagugagggagacaguuaaauucugugacaaugacagacuuggcaauggagucaugggcacaggaggcucugccuccuccuuuggguauguauggugaaugggacagcaugagaagggccauuucugggaaggccuuugaguauucuguuuuugauacaguccaagacuuccaaagaacagaauuuuuuuuuuuuuuuuuuuuuuuuugagacggagucuugcucugucgcccaugcuggagugcaguggcgccaucucagcucacugcaagcucugccucccggauucacaccauucuccugccucagccuccugaguagcugggacuacaggcacccgccaccacgcccagcuaauuuuuuuguauuuuuaguagagaugggguuucacuguguuagccaggauggucuugaucuccugaccucgugauccguccgccucggccucucaaagugcugggauuacaggcaugagccaccgcacccagcccagaauuuuuuuuuuaauuuuuaaguuucaugagucaacagaaaugauaaucuacuugaauuuuugcucuuuccucucugugauauguuuucacugaagggaaucuggugauugugcuuuucuugggauuuuucgauuugggcacacaugugcugacauuuuuggcagcggacaucaugaaagaagcuugggucugggaaaaggaccccugggggugaacuccccagucuggccugggucuagcucccaaugggcucuucuucccuugaaccacagucaucucaccuacuggcagcagcgcuagacagagcuaggcuagacaagcucagcauuaguugucucugaucugaggaaaccuguaguuagccuuuacuucaugucacacaucaauuucuccuuuccuuucugcucaauuuguugccgguucccaacuccaccaguagaagcuuucagggcagaggugcucccgcacagagggcaggcacccugcugagcugacaaggcuccagcuuccacucccugcagcugaacagccccagcaauugauuuccuugccauuagggaaauuccugcuuuuuaggaugcaccaccgugcauagguguuauuucucugucucuucuccaaggaaauacaugcuaaauuaaguuuuguguuuuuguucacgcucagcagcaccauugaaagccaggguuucaccagcugugucguggcagcaguugcggaaggagaggaacagaauagguuuagccagugcaauuugcaugugcaaguaggagagcacuggucucggggagaggacgugggccacuuuggauuuucagauaccauggcagcucugagaaaugcuuccuaacaggccuucuauuaucccaggcaugggcugaugccuuucgaagcaguccugaucucaccggcguugugcacauauaugaggagcugaagaggaaagggguugaauuucccauggcagacuuggacgcucugucucccauacacacaccacagcggguaagcuuccagcuggcacuuucuagaaagaccuacugcagaacgggugagccaagcugcugcagccacccuucugcugcugccuuugaauuauucagcuugucaucaugcuuucuuaaagcucgggggcauuccuuuuuaauaacaaggggcaugcaggagugagacagcugguugacuggugauuaaguggcagcagugucuguggaagaauauaauaaagggaucaguucaggguuuucauggaaauggcuacuugggcggagccauccugugagggucauuagcaccugcuuuucagaggccccuagaaucuggugugggaauccuguugucccucagagcaccauagcaccucagggcuugaugucacucuugggucaaaaaguagcuuucuguuuuuucaauuguaccaagucaaauggaucuaaaauuuauuuugagcugugaguauucagcaucaauccagaauugauucuggauucaauccuugauuccaucagccuugggaucaaagcccugggaaggucccuuuaggggcaucccaccaaagcuuuugcagugccaacaguaacuugagcaccguggagggggcagcuuggcacuucaggguuaaaagcauguaggucaugccucaugguuucucaaggaagcuagucccucuacuggcugggaaucaacuccacuccuagccugggggagagccaggaaagcaccagggucugggagaggcaccucaucccaguacacuucaccuugccugcccccacugcccaucucugagaaggauagcacaccugugcacaucucucguaggaacacgacuuaauuuuaaugugcaagaggucaucugagauacccaaagggcaagcaugagggauugcccuuucucuuuuuuuugagucggagucuugcugugucgcccaggcuggagugcacuggcacaaucuuggcucacugcacgcuccgccuucuggguucacgccauucuccugccucagccuccugaguagcugggacuacaggugaccgccaccaugccuggcuaauuuuuuguauuuuuaguagagacaggguuucauuguguuagccaggauggucucuaucuccugaccuugugauccacccgccucguccucccaaagugcugagauuacaggcguaagccaccgcaccuggcccaggggauugcccuuucuggaggcuguuuucaucaugaucccuccagaccacgcgcuaugcuuugugaaaucaacauaaccuguuucauucuucuaauaaugacagagagcaguguuguuguuccuauaauuacaaaaaacauuugguaaauugcauaauuacuauuuauauuagucuacuuguaaagaccaaaaaaguaauucuuaugguaccaaguaaagaucugugauuagcaaaacuuaauaaccgcccucccuccacuuggaucccgagguggucuuaauaauaggaaccaugaccagagggcucacagagcacucucggugcugccuuuuggaguugcuuucauuggucugccacacauuccuugagagguaaguagagggaggagccauuggcagccccacuucccagauggagagccugggcucagugggguucugugaaccucacccgggcagcaguggagcagggccuugagccuuucgugggcagccuuggggaagugcugcauggggugggguagguaccagguccagcuaugcaggcagcccagguaaacagaggacuuuguuguugccaugccagagugucccugaaguggauccagcugcgaccaugcccaggucccaaucacagcagaggacaagugcugguuccuauuccucgccgccuccugcucccuacuccgcaccgcaggccccagcucugagugugacuggccccaucacagccaauucagaacagguacuugcauacuucggggccauaggcaagccagcugacuauccuuuuucaucuuucugggagacacuuacaaaggccucccaagccagguauugugcuggguguuagggacacagagauggaagggcucaauccccaggggagagagaugcugaggaagucaugauggauuguggucaggcugugguggggagcagaaccaagggcucagaguugugagcccaggguugaguggugccugggaggcaccggggaccugacaugcagaggguccugacacaggaguugggcuuugucaggugagaccgcaugcucagcaaugacauuuaaaugcagagaugcagacgcugcucucucggagcagcagguggcuugauuggagagcaggcgcauauguagggcccagaucugggaggaaaccauggcagaaugugaggccaaaagcauagacgugcagcugaguugugacgggcuugucuaucaugcagaggcuuagaucuaucccauaaaaaaagucagccaucagaggccugugaccugaucagggaggcccuccugaagcacaagaagccugcuuuuaucccaaacacuccccacccucccggguuacuuccugauaaacuaaugcaguuuuaaccccacacuggauuuuuuagaugaauuggggagugcucuuuagaagaauccauagaacuucaauuaguuacaauuugagaauuggucagacuugggggaaaaaaaaacucuccaauguuuauauuuaccaaauccuuauuuacuauuugcgacaaugucaugacuguggaaccucacugaagcagaggggucaagcaauguguguguagggauagcaauguguguguagggauggcaguguugugucguguuccucacacuucccugcuagcucugagcagggaguacggugagagcaggaggagugaacuugaagcccccagggccugggugugagcccccagcucugcugcucacucuaggcuucagucaggacauuuaaccccggucucccaucaguagaacaagugauuuguuaccccaccaggcagcugugggcuugacaggcagauggaagagguccucauuguggcuacccaagugcugugggaaagaaggucucuggcuuuuggcccugcuucuaugggcagaacugugcccuuccugcucugagggaaggcagaaaauguuugaaguuggacaguuacugagccccuucaccgacucaaagugugggaggugcuugggaaggcccuccuaguagccagaagaugcugggucugcagggucugggcauagguagcacaggagcccugaggcauguugccccuuggagagcagaaugcaagcagagguaggcaggucagcacccagccuggccaagaggacccagggcuucagagucuacuggguggcugcccauagccuuccugggccuuccuagccagaaaccucuucucucuaccaagacuuugaagaaaaccccuggaucauccaccaggcagagccagaggcuaacaagagccucucaggacccagaccaucucccugguagaccauugauugaggucuccugucccugucucugugcugaggguauaaagcucaacccagcugaguuccugcccuaagaagcuaaaggucugcugagagagcccacccacacaggagaggcugcuacagcugcaauaguggaagauggcacagcgagugggaaccugaggaggcgggagugguugcuucuaccucaggaugggguggggagagucagaaaaggcuucacuggggagagaaguugucacuuaagcugggucacagugcaggaagaaugacauuacaguuccucucucuggaccuuugagcaggaacaagggccguauguguguaguagagagcauaccugcaugccaggcgccgcaugggaaacucacagcagccuggugagguuagugccaccuuucuguaggugaggaaacgaaggcucagagaggcucagguccggcucuggauguugcugcugagucuuccagggcucccuccaguguccugugcaguucuugaccucuguccagcguuauuuggucucuugucacugagugaugggaccaguagccaccucuaugcagauucuucuaugauauuucacugugggcaaggaaggucccugugguuucugcagauccuucgaggggguugagggagugaaggggcagaucugaggcacaggacugagggcaaggggagaaaguguaugaugucucuguugcuggagaggagccuugggccuuggcccagguccaggcuuugggaucgcugaugggcaacuuggguauuuuucaaggggcuguguuaccauguagggagcuggguggggaaggugucuccccugucgucuuccccuguucucucauucuugccgcagcagaaaagugcuauugacacugcccagccucucagagggauccuaguguuuagauguaaaacuccuaggagcagagucuauaacucagagcuuuguagaauaggaucucagcucugaagggaucucagagcuccugcccuccugcacuuggauuuuaaagagcaggaacggaagcccugagagguucagcuucuacucaaguucccguggugggagagccgagacggagagccagcuuggugcacuccugacacggagcccuucacuacgugguacugcuuucgugucacagucagagaggcacaacagacuguugguggcagggcccauucagcucucucagagcugacaggcaggccagagggagaugagaagguggccucugcagugugcacucagaaaggcaacccagaucucccagugagaaggauugucacuagacuaggagcaagcugauucugauauugcaagugcaggcugacugaccuuuccuuccugcuuuccuuccucguggcccccaccagauugccaggcugcggagugaacuggacgucguucgaggaaacacaaaagucaugucugagauguuaacagaaauggucccuggacaggaggauucaucugaucuggaguugcugcaggugagucaucuuucagaagcacuuggccugugguggcagcucuuccaccguacacuguuggaggaucccacccggggacacagcggcaaggcgggacagguccaguggcccuguuguugauaguccaugugagcacacaugcagccucacguugccuacggacaggcagaggccaguaccacugucugucuuuuuuauuuuccuuaauaacauuuuuuuccugauuauaaaaugccaguuguagaauacaugcucacagaaagaaaaagaaagcacagaaaagaaaauaacuuucuuugacccaagcaucuguaaauaaccacuguaggugcuuugauguauuuucuuucugacuuuuuuguagguuuauuuuaaauguaguugagcuuguacuauuucuguauuuuggucccucaacaucacauuuugcaggagggccuguucaaccuugacugugcacaggagcccuuguaguggcaccucacccccaagguguccugagacugagaugaagugugaugcucccaugcuuuucccuaacacugaggauucccaggcauauugugguuugccauugcaaacuggccuccccgccucuggacagcccauggaucugggggcauggcagaaugggguccaggagugggcggccugcagucuaccccugaaaccagggucaaggcccccaccucaggccuguuucccagggcagccagguccagagccagugcccagaucuccaccacacccagccucagaugacccuggcauuugcagaaaaugucagugguacugcccuuagaagcagugaccuucuggaggguggaagaaggaugcugugaacugcaaggccccacacacuuuucaaugggaggcaagaugcuugagggaacaggucaggagccagacugauuuagcaaccuggcaugaguuucucaugauacaccugcugcugcugcugauacugccauuugugucuggcccuccguugucagucuugguccccaagugcuacaccuucuacccugcugcuggcacaugcuugccgccugugaaggcccuguccuggucccaaguugcugcuuauugugcccccuuccuacuccaaagccaucggcucuuaugggggugaggguggguggagaccuguuccaggccugacacaaaacacaguccuaggggcacagaggugcaugagcuguggucccuggagcuugcagcuuuuugcaggaaauagaccgggaaacaacuugucuccauguaacuacaccagccugcucuugaagcugagaaaaguacccuuggcccagccccagugaggaguccugaguggccucucccuaguucccagaccucacuccugacacaccugcaucagcccaggcuugccucagcucagcagauccagcugaauaugugccacacuccaggggaccuggcuucccuugaaugcauugucauuggccuccauuccuagccugcaggaagguucggccaggcguuacccagaugcacaggauucugaggucaguccagaaacugagaaggccucuugaggcagcuuugugcugugucagcgucggaauuccugcugacaggggggauuugcucuggauagagccgugcuccuggcagcaggggguguguugaacaaagccaagaugcuuccagacagccagagcagacccagacagcaggaauacuucguguuuuggggggagaggggguuugggauuuuuuuuuuuuuuuaaacaagcccaucagccaagacaaacagaaccuaaucuccuggcgucagcucacagcuuucaaaaauagguugcuucccaugacguuuuccuucccucuguuuuguuccaacuccaagccucccagcccucacugcuaucuuauaaaucaaauagaaaaggaaugacucucggugccagugggaggcuguccuuccagcaacagcagauucaggagcugggcagcacuguggacagccgugaacagacacagccguccuggcugguuggcugcacgccuccgccauugccgacaucuucccaccccuucuuccccuggcagucaaaagccagcaggcagggucucccaagggucagagccacacugaacagccaaccuuccauguggagaaauaccacugucugcuuagaaagugcuggaaucagaauguguccccaggacccuccaucaagcuggagggcagccagagugcucggggcagagaauacagagcugagagugcuggcuaggccauggaaacaacccagauguucccaccaacagaagcugcucccaguucaaguauaaauuccugggguaggagguggggggaauaggaagagagauaauugguggugucagcccuaggaugaucauaacugugggcagguuaugucccgguugccuccugcacaucgcaaagcacuuuuggguguagcuucccauagugaagcaagagcagcagggaagcuuggcagugugagcuguuugccugcagacucauggguauguggcuguauuugaggagaggcugaggccacucuagcacccugugcugucagcguagcuggagcgccugaggagaaggaaggaagggugcccagagugaacacagcaacuccuccucuugagcuaugcgucaaauccuccacucucugaguugggagagaccuuccaggaaguugguucaguucuacaccuguguucagauuucuuccacagcaucuuaucuguugggucuuucugcguguccccagugacaggcuguucacagcagcccucuugcuuucaaauggacaucuugguuagacuucgggcagcagcacagcaggcauacaaauuacacaggccuaugaauuaaugccuccccauccuugcccucccacugaugagcugggcgaugccagguaagucaccagccgucuccaggcccccuucuccucucuagacuggagugaucacuugcaccuuggcagugccuggcgcagggcugggcuuaggcaaggccucacaaauccuagcuuucgugacuauuguuagaaagcccuuucacacauugaucuaagguguggcucccuauaacuuugauccuggucugucuucuuagacacuagaacaagacuaauuccucuuucacauggguagauccuuaaauauuugaagauugccauaagccccacccacugcacagucuccacauggaacaaauguggcauuuggcagcauuuggcagcccaccacagggagggauaggcaguucuucacaagaagcagacauaaaauggagagcuuccaucagcugaaaacccugcugcgucacuucucaucuggugguuaagccuaucuuugucauccuguucaaggaaccuuaggucugggcccgaaauucaagacacugcaucugucccugcuaaagugcaugcccuuaccugcagaaagccugaguuuggcuuucugggaucuuuaaagauugcgauuaugucauccaguguccucugucucucccaauuuagccuuuugagcuuugucuucaaugaauaacuuuuaauuaauacaaugaugccaaaaauauauguucuucuguggccguucaucagcauaagauaauaacagaggccuccucguuucuccaaguagcagaugguguaucuccucuugcuucuugcgucucauuucaacaaagacagaacggccaaggccauuuucucuagagaaaucuaguuuauucuacauguuuagcuucauuauuccccuuucucaucaacaaagacuuuuuucucccucccaucuuugcagcaacagaaaacagaucuucaggaccuuauuccguguuccuucaaacuuguggagggcucagaggaaauccauaaagaugauuaaaagacuguugcgugagguagagaugagaaugucccuugaagaaaagauaaaggcauugggauuaauuagauagaaaaaagaggauauuuaccaagguguucuaauaguuggagggcuuuuguacaagugaccagcuguucuucccucuguugaggaccagaaaugggagaaggccaaagcugaagucgucagcguuuaggaaauuccuguccuggcuguugcacaguggaaagggugaccugagcaagcaguaggcucuugggugucuuaggcccaaagagaaucacacuuugagugauuuggagguggaggaagcagaggaaagucucccaagugagccugcugagggucuggcugugaugacaccacagaggacaugcagguggccggcuggcacugugguagcaaaagucuuuaacaucuggcccuccuuucaccuucucaccuucuguccuuuuuuuuuuuuuuucuuuuuuucuuuuugagaaggagucucgcuuugucacccaggcuggagugcaaugccaugaucuuggcuuacugaaccucugccuccuggguucaagugauucuccugcuucagccucccgaguagcugggauuacaggcaccugccaucaugccuggcuaauuuuuguauuuuuaguagagaugggguuucaccauguuggccagucuggucuugaacucgugaccucaagugauccaccaaccucggccucucaaagugcugagauuacaggugugagccaccacgcauggccuuuucuuccuuuuugagacagguguaaaagacugaagccaagagaugguaaagcuuucucugugcagagaccccuggaaaucccugauguggaagccccaggucauagucucugggccugucuuuagcauagcucuuuggaaagccaucaggaugcuucuccaggauuggagcauagaggcccugccugugggguugggagcugucuaacccaccaccccagugggaaggcuguggggaagaggcagcaaacacaaggccagagcagauguuccuggugcugacuguugaugagaucacugcauucugugcccuuggggcucauucuuccuccaagcugaggucacaauguuagagccucagaaaucaucuaacacuuuccaaacguuuuuuuaaaguaauggaggccaggcauagugacucacaccuguaaucccagcacuuugggaagcugaggcaaguggaucacuugaggucaggaguuugagaccagccuggccaacauggugaaaccccaucucuacuaaaaauacaaaaauuagccgggugugguggcgggugccuguaauccuagcuacuugggaggcuaaggcaggagaauugcuugaaccugggaggcggagguugcagugagcugagaucguaccaccguacuccagccugggugacagagcaagacuccaucucaacauauuaaauaaauaaauaaauaaauaaguaauggcugggcgugguggcucacgccuguaaucccagcacuuugggaggcuaaggcgggcagaucaugaggucaggauauugaaaccauccugacuaacaugguaaaaccccgucucuauuaaaauacaaaaaauuagccgggcuugguggcaggcaccuguaaucccagcuacucggaaggcugaggcaggagaaugucaugaacccgggaggcggagcuugcagugagccgagauugugccacugcacuccaggcugggcgacagagcgagacucccaucuaaaaaaaaaaaaaaauaaguaaguaaauaaguaaauaaaguauggaaccuuuuccuccacaaauaaaauuuuacagugaauggcaguguuuaaaaucgagaaaagcagagcagccucagcugcccuggccccgugccauggaggccgcugcagcaugacaguggccuucugcagaaaaacuuccucaugaaugcagcccccuuauuuuacccagggagaagcaggccuggagaggacuggagacuuggagaguguauccagucacaggcuacuugcugccugcagcuucguccccagcacccagcuggggcuagggcucuguugaggagacugacaucaaccccugcucccuuccaucaggccgccggugcugggaguauuuguagccauguuucugagacacuuccugcagucuacugaggaaucugguuugguucuccucuaaauccagugaaccacccuugaggccuacucuuuguuucggggcuucugcuguguggagugcagaugggggcuggucaccccuugcuggagguuuuuguagaggggcucugaugacagacuggaguguguugaaugcuuugggagucuugaggagggugggguggugggagauccccagaaaacauuguauguggacaggaagaugaauaaaugggaaguacguguuaaagcugucacuguaaaauguuaaugguacaaucuaggugauaggcauauggugucuguucacuguaaaauucuuccuguuuugcuguauguuugaaaauuuuuaugacaaaauacuggaguggggaaacauccugaggccuugaaggaugaguaagaguuuguuugauggaaaaggaaauaagggacauugcaggcagauggccaacuucucaggagcccuuaagcaguguggcaagugccugaggccaccuauauucuggaaagucugagguguauuugaagauggccugugggccuuaggugcugauaccccagucuucuggaggguaacuuggaucuguuucccacaaccuacugccacacuccccugacuugcacguccugugccuugugauuggccugcaguuugcaugagaagugauugacuuuuuuccuucucccuccccagccaaggacagccagggcuugcugcuaggccacaagccccagaggccacacuuucuuguaaugggccuguuugcuggaggggguggguccugagcugggacuugagauccuuuugcucaucagagauuuuccgcagacaccuggagcgcuggagcaaagaggagcucagcagugccuggcucgguccucauguguguuggcacguccacaucccuggggaggagacccgcacgguggcccggaacaguccauggcagagcagagaggcagaaguuuguuugaccucuuuucucuguccuacugcccagccucccuuuuccauccugcacacuuuggccaggucucccucuggugcuucuuccaaaguaugggguaaaucuacugcccaaguguuggccaaguauccuuuuuuucuuuuaggaagcaggggaggauggucugucaaaguuaaccuaaaucugugcuccucugucagcccugaacagaugcucacuguguuuuaacaaucuauuagaaauacuauaauuauuuuaauuguucacuucaguccuggcuguuggaauccuucacgugaucuaugugauuguuucuuucauaaguuuggacauuuuuauuuuguuuuuguuuguuuuaauguuaagggccugccuugguuuucugcaucacuccugaguaugcuucauucuguaaugaguguuuccccuguguuguugguuuuccuguguacaguaauugugacuggguuuugaccugugaguguccauuggcgccuguggccauuauugccuggcaauccagaccacgucuggcaggccccaaggcccaggcagcuuuuugagagccccucuccugccuggccuggggacaugagccauucacaacagaggagaguggguauuuuguggaguuuucucuuuacuggauaguaguguccccugcaauuaagaucccguauucaccucuuauuaauucuagcacuugucuguauguuuauaagugcuuacugcugguucaguggggccugggaugaguccuagagagggaaaauuagauccuggaugaacaagaauuccccauucucugagugaagagugcugagaagacugagaguauguggauaacugagcugguaauuugcggggaccaagaguucagaauacuuuauauuuuauuuuuauuuuuuggagacagggucucacucuguuccccaggcuggagugcaguagugcaaucucugcucacuguagccucugccucccggauucaagcaauucucccaccucagccuccugaauagcugggauuacaggugcaugccacugugcccaauuuauuuuuguauuuuuucguagagaugggguuuuaccauguuggccaagcuggucucaaacuccugaccucaagugauccgccugccucggccucccaaagugcugggauuacaggcaugaggcaccgcacuuggccucugaauacuuuuuuuugagauggagucucgcucucucucccagucuggagugcaguggcgugaucucggcucacugcaagcuccgccuccuggguucacgccauucuccugccucagucucccaaguagcugggacuacaggugcccgccaccaacgcccggcuaauuuuuuguguuuuuaguagagacgggguuucaccguauuagccaggauggucucgaucuccugaccucgugauccauccgccucggccuccaauaguuuugggauuacaggcgugagccaccacaccuggccccggccucugaauacuuuagagucauuaauuaauucucucagaaguacuuggggagagccucccaugugucauggguaccagggaaauaccuucucugcccucaaggagcuucagucuagacgggagggcagauaagaagcccagccccugugugagugcuguguugcaggauaccagggacaugcaggggggaugccuuugauuccccacuggcugauugaccaccuuggugauguguucagcagaugauuacugggcuuuuucacuguguguggcucagugcggggcuugagggcauccuugaguggauaaaugguaacacccccucaagaguuuaugaugugguaggaaggaagacccuguagccaagcuagcaagauuaugagacaauaugaggaacuaaagagagauugccgugucuccugugaauaaaucaguuacuucuaccagaaacgguuucaaaaugaagucguuuugaggcugagcugugagaaggagagacuuauccuucaugucuuauccccuuaacucacuggcacccuccagugcccagguaggugggaacagcauuucccucugcuuuaacccuguauggcacacugggacuuguagcuuuggucacaugcuugggggccagccuggcaguguugccagcucccuccucuguagcauccucagucuggcaucgagauggcaaggggccuggcaggaauugacggagcucuguaagcaaguuugaacaagggcaucaguaagucugcuguucuggaacagggaaggcucauggaagccaggccauaaagugcuaaggcucugucgucacggggauguugcuucuaaggguagagagggcuccaggggcaaccgggggugugcgaauuuccucuuucggccagccagggagcugccugggcuucugaggucucggcaaaguggcagacgugccaccaaaauauaccuaaugcagucauaaaauacacuccugcuguugcuggaaguguaaguaaacugaugucauauuuuuggagggccuuuuacuauuacuaauuaauguuauaaaugaccauacccuuucaccuagaaauuucccugcuaaggaaccuguccuauggaagugcuugcccaagugcauaugcauguguguguacagguguucauugcugcauuauuuagguuggccacaaaaagagagaccacaaucuaaauguccagcaauagaagaauggcgagauacauuaugaaacacacagaaaggaaugaggcagucuguaccaagugauggagaacggugucuggaauauuuuguugagaaaaagcaaucuggaaagaaucacauuuuaauauuuuuuaaugauuuguacaagcauguacuuguauacauacaacaguaugucuggacauuugucugcugaaaaaguacuuguuuccucugcggaaggaggggcaggcagugaagagggaacuucuacuuugaauucggcacaugucugguuuuaugaacaagcauguacuccuuuugugacuuuuaagaaucaguacaaauuuuuucaaaggagauagaaugugacgaaaagcacacccagcaggcuacccagaggugcauguguucccuaggagcucaacaggaccugucgggccaugcagcagcgcaucguggagcucaucucccgcguguccaaugaggaggucaccgaggagcugcugcaugugaacgaugaccucaacaacgucuuccuucgauacgagaggugggagccggauuucuuuuuuuuuuuuuuucccuugaaaagauuguugccauaacagagggauuucuuucauaaacaaaggaaagagagggagagggagagagauuagaguuggaaaauacucaucagagaugcuaauuuguucccggcugacaggaaaaaugcuucuuguccuccugggaacugagcagcagaagcagcaggaaguugacgugcagaauuaggcucugcccuuuguaagccucaggcugcucugccuuuccccacugccccgccacccccagccccagggagggguagcacuugggggccucugggccccagagcuucugcaccugcuccuuugaugauccuuugaauuugaaaaggauuaaagggaaaaaaaaucucuaguaagaaaaaggauuuccucuuucccaucuuaaaaaaaaagaaaaaagaaaaaaagcuuuucccuuugcaaaugucaauguuaucuagagcauucaggggaagcaggcggguguaagugccggaaugcugcugcuuagggaagcgugcacacauucauuccaguucuuucugcagccaaaucauuuuugaguuugagguaacaaaccugcaaauucuuuuucauuuccaaagccuucccucaggacaaaguccaaaaugucuuauuuagaccuaguuuuaaauaggaggaauaauggcaagcacaguucccaucucaucaccugaugggagcacacugggcuuucaugaaggacucagcauaaggaccagaaaggaccaugaucaggccaaccuuuuccccuuaaagaugaggcuugagaggacaggacaguggcuugaguccccugcagauuuaagguccugguccccucugccgcaccagcugacucacaaccuacugcuggauucaucaggaggacaaggaccuggcaucaguuagggugagugggacagaugcuugcauuugcguuacccuuuggggaccuaaagggugauuuuguuauggcugucacagccuugggccuugucucaucuuuugacuacggaaguacacaccaguggcucugugcccaccugacaggugaauaaaccucugcaguaagugugggggcauccccaggaccccccagugcaucaguuggagaacaggagcagauauaaggggaccugacucccagcccgaggccccuuugucuugccaugugauuccaguuucuccaugguaaaugggcuuggguuuaaccuauuaaaccuauuuaagcccugcuagaaagcauaacaggagcuaacuaauaugaguauuuucacccaagagucucccaguccaagcauuacacauaauucagaggcaaagccuggggcugguggcuggaagugcuauccugguuagagugucuuugaugauacucauuguucauugaagaugagugugggaaagguaccccaggauuaaaauuguuucagauguauuaauauuccuguucuccuuguagaccacuguugaaaaaacacacaagucguuuuuaaaaccacaguggacacucacugccuuacccagaucauuccuccuggggaucucuuucuugucaccagcugcugaccccagcaaguugggagacaaaucuggagcagcauaacucacuaaagcugggugucuaaggcuccagcuggaaaaagucucuuagcuaccgcugcccauggcauuuggaguuuuuaaauacgauacagaacauaaucuauucugccccaccccaacacacaccucauaacuacucuuccguuccccaccugacaggaggaugaccuggccuucgacaguugcucaaagccaacucccccugcacugccugacugggugcagaggacacucacuccacccuccuagcaguccuucgaugacuggcccaggccucucuguagcagcuacuggcgagcauuuccccaggccguagccagggccaugcguccgccuuccuccugcuggugcccacccuaugugugccccacccccuuuccccagaggcugaguugggagcauguuaggaacacuagcuaguugcuccugaacacagcccuaugaaauagggagucugcagcuccaagguaaggugguuaagccacccucccuccagggcccaggugugugaggagaggcuggggacacucacaaugaccuccaugaugggccagccaccaccccuuucugaugcccacucugggugcugggugagaagcugauccucucagggggagccccacacagaggaagccguggcagaguugauauaugguuucacucccuagcccccaggugggacuggcuggucuuggucccagggauucuucauaggacuagugagcaccccacagggccauaucacaggcauccucucuccuuacuucugcuuucccuuccccuguuagguucgaacgauacaggucuggccgauccguucaaaaugccaguaauggaguaaguauuccuucagaauccugucaucuccugaggccagaccuaccccuccacguuuuggaggcuggagagaccuccaguuuuucuaacugguuuugaaauauuugggaaauugaagaggcaagcucugguugaugggauacuagggcagagcuagcaggcaccccugaugggaagguggcaagcaagcccuaaguuugcaucucccaggacagucacuguugacucagcaaccccuccuucuaguggggacggggaggaggcagugagcagggcucacugacauccaggcccaccauggaccuggaaggcaggugggggaaguggccuugcuucuguacuagagcagcgcugauacuuuucuucuuggaacccugcauaguugccuugccagcuucuaccucagagccugacuccaggguucuggggcuuauggccaaucucauguucugacagguacugaaugaaguaaccgaagacaacuuaauagaccuggggccagggucuccagccguggugagcccaaugguggggaacacagcgcccccaucuucccucuccucccagcuugcaggcuuaggugagugucucacagggacaaaagggccuaccuacuuccuaccacuggccucccuugcaggccaccucucuuucuuucuuggaagacccaaagagagucuuuugggaaauacaugugaaaguguauuccugaguccuagccaguuguaccaccuuacuuucaauucauaccuuuuuucccccuaaauuugaaguuuaaaaucuauguuggaaagcagggaugggggaaauuccaaugaauuaaagaaaggucacggccgugcgcaguggcucacgcccguaaucccagcacuaugggaggccgagguggguggaucaccugaggucaggaguuugagaccagccugaccaacauggcgaaacccagucucuacuaaaaauacaaaaauuagcugcgcauggugggcaccugcaaucccaacuacucgggaggcugcggcaggagaaucacuugagccugggagguggagguugcagugagccgauaucgcaucauugcacuccagccugggcgacagagcaagacacugucucaaaaaaaaaaaaaaaaaaaagaaaggucaccugccauguuuuauauggaacauucccuaugauugaaguaauuuccuuuucaauauuaacuaggucaaggccgggcgcguaaucccagcauuuugggaggcugagguggguggaucacuugaggucaggaguuugagaccagccuggccaaaauggugaaaccccgucuguacuaaaaauacaaaaaaauuagccagacuugguggcgggcaccuguagucccagcuacucaggaggcugaagcaggagaauugcuugaacccgggaagcagagguugcagugagccgagaucgcgccauugcacuccagccugggggacgacuccaucucaaaaaaauaaauaaauauuaacuaggucaaggagggcagauagguuucagcucuuuggcuucuuggaacacagguuugaggaggaugcugaagccacaucagggcuuagaaaagucugugauugauugauugucaauaucuacagagggcuuggaaacaggagguagcagcacugaaauauuugcucuccuugaacuuuaccaucagccuaaagcaguccauugucuggaacuuaaaagaaacucaccacuuuccacaguucauuuaguuuguacauucaaaguguguauaugacucuagcacauugguuauacuggaugauaccaauuuauaacaaaugaaauuauaacauugaaauaauaagcauggcccucaaaauucuuuccucugucuugcuuuucuguuuuccuuuuuaaaaaauauuucucgucuacuuuccuuucauuugacuugaguuaaacuucuaguggcuaucaguugcuguaauuguagcuucucaauauuucguauauuuguagccacuauuucuguaucagaacagaugucucugccuucagucaguccagcauauaugacugccagauuuaauacuuaaaauucaaaguguaacaccgguaaucccaagacuuugggaggcugcggcagguggaucaccugaagucaggaguucaagaccagccuaaccaacauggcaaaaccccaucucuacuaaaaauacaaaaaucagcugggcaugguggugugugccuguaaucccaacuacuagggggguugaggcaggaggaucgcuugaacccgggaggcggagguugcagugagccgagauugugccacugcacugcagccugagcaacagagcaagaugccaucucaaaaaagaaaaaaaaaaaaaagccgggugcgguggcuaacgccuguaaucccagcacuuugggaggccgaggcggguggaucacaaggucaggagaucgagaccauccuggcuagcacggugaaacccugucucuacuaaaaauacaaaaaauuagccaggcgugguggugggcggcuguagucccagcuacuugggagacugaggcaggagaauggcgugaacccgggaggcggagcuugcagugagccgacaucgcucuacuacacuccagccugggugacagagcgagacucugucucaaaaaaaaaaaaaaaaucaaauuggauucugcuaccucucuucuuaaaaaagguauaguaggccaggcauaguggcucacgccuguaaucccagcacucugggaagccaaggcaggcggauugcuugaguccaggaguucaagaccagccugggcaacauagcaaaaccucaucucuacuaaaaauacaaaaaaauuagcugcgagugguggcacacaccuguagucccagguacucaggaggcugcaguaggagaaucuccugagcccaggagguugaggcugcagugagcugagaucaugccacugcacuccagcuugggcauccagagugagacccugucucaaacaaaacaacaacaacaacaaaaguguaguguccaccaggggugguggcucacacuugcaaucucaucacuuugggaggccgaggugggaagaucacuugaggccagguguuugagaccagccugggcaacauaacgagaccuugucucuacaaaauaauuuuaaaacagcugggcaugguggcacauaccuguaguccuagcuacuugggaggccaaggugggaggaucacuuagcccgggaggucaaggcuaaagugagccaugaucaugccaagagaguaagacucugucucuuuaaaaaaaaaaaaaaaaaaaagucuagugucuucccacccacuccuuuaccuggcauuugagguauuaccagccacuuccuccacaaauuuuuuccugugagcguuguucacuucacacacccuggccuccaaaccccgugccuuuuuaucugccuuuccccuucuccccacagcauccuccucauuauccuuacagacccacuguuguguugguuuugagucuuuccugaugucucaagccaagcacugcuguggcuugucucuugcccacucugaccuucuugaagcugaggaccauaucagauucaauuuggucuacucaagaucuagcucugaacaugguggguaccuaagaaauauuugcugaauaaauagauguuccagguccuuggacauugugauugaguuaaugaggagcccaagcgagaagggcauuauggaaaaucugcaggugcacuggcgccagucccugccuugucaccccagcaaucucuuuuuuguuaugacucuuucgccuccuugagcaguuugaggggcaguggcuguucugucccccaucuggcccgcccuggcuccuccggcauguggugcacugggaguaccaaggaaagucccgccccacccuccccauggaaccuaaacccaccuggcuggcguccuagcuugggggcccuucaucagaucuacagucuacauuuuguucucaucugccacccauuuguuuuguugccacagacuuggggacagagagcgucaguggcacccucaguucacuccagcaauguaauccccgugacggcuuugacauguuugcccagacgagaggaaacuccuuggcugagcagcgcaagacguauguggggccccuuuuaguggcucucuaaagauauuggggggauugacccaugccuggucacaggccagcacaaaaaggcauuuauuuaccauguccaggacugccaggaacuuuaaagcauggcuguaaggacuuggcauuagaugcagauacugaauaaauaccaacugcccaccuccucccccacccccccaaacacacacacacucuccugcccuugggguugauuggagugugauuucuccugucaguuguaagagacagcuuuucucuuuucuccccaugcugcugcugcugcagacaccacccugccuggccccucauccacaggagaagcuuggaagcaggagggugcagccaugcagggugaacccauuccuuacagcgagauuuuccugacuaaaauaaguggucagagcagaggcuccucugauagcagcucuggcuaggaugagccaucuggaauucagggaguugauuccaaaagagagaaucuccuacaucucagggaggcacuguacauguuuugagcuuucuguucagccuaaaggcgggugaaacacacuuuuucccaccuuucccagggacccagcaucuuggugcacucagcacccugaguccugcuuggggcucaguaggguaagcagaaacccaaggucccauguacccuucaccaccaaagguugauuguaaaacagauauagcuaaaggagucggagaguggaggaagaccucccauaaucagugacaggcccgggucccagagaccaccuucccugucaaaugccacugaggcugcugcuaauaaaauaagaauuaauguuacuuuguguuuaucuagucuucccucugaggaguauuagggcacuuuggacauucagcuucagagaugcucaguauuguuacucaagagagggauguugaggugcacaaaaucugagaucgcagagauuaguggcucagccugagcuaggacccaggccuccuagcauccacugcagggagacagacaacaugagcccuuagccucugcucaaugucaagguuucaggaaauguuuuuccaaggacaucugaggaaggaccauaggauagaagugauuacaggccacuaccccaucccuccaugaccacuggaggaaaaugaacucugcuugugcugcuucuucaucuccaggguaaccuaugaggauccucaggcugucggaggacuugcuucugcacuagacaaucgaaaacagaguucagaagggguaggucuuuaacccuguuuuucugccuggagucuucuggagggaaagucaggugguuuggcaaagcuggcuggguaauucagcagaaacuggcuugcacagggggcagggacacccugggggagagacccacgggggacaccccguggaacccagguagugccucauugagucuucaccucaccccgugagaugaggccacacaugagcuucccaauccacccaagagaaaacagucccaggcaggugggagacaggcugagacacccagagagcagacagcaagcugggguuccaauccuaggauuaguguccauuuccagaaccccugcuguuccuaccacaguggccccaaguucuccaggcacaagucuccuauggucaccuguuacagugccacaggguggucagugcucugauaaaaccauggccugcaccaggaaggacaaugcugacccgagccacaucucugauggccauuugucacuggccuagcagagcaguaccaaccccauuagaaggcacucgagagccaggguuuguuuacagagcuggugcaguugggugguggcugggaggguguccuguggcggugagggggugcggcacagugaaguggagggaaugguauguguuugggccuccccaaacauaaccaugcuuucuguacaauuucggauuacugaaggggaaagaaugugugucuuaaugcuucucaugagauuuuuguuuuugccuaacaaagaaauguguaugaaugcacgucuguuugcaggggcagggaggaggaggguccuuggaauagcugccgacaacagcuggaacuccugucugggucccccagcugggcuagagagggcagugaucaucuguccacuggacaggaagguuugcaaagggcuguuugcuuacugggucccaauuuuuagccuucugaagccccuguccaaugggcccaggcaggcagcagugcugguuuccacgggaugcuccuucuugggggaagggacucacucccucauccaugcuggucuucaccugguggaucugagggcaugcaucccucugcacuggucaccagagggcgcagaagagccagcuggcugccuuggguccucagugccgugccuuuccacaggagugggcagugccaccugaaccccugagacugggacacucaaaaucaaugcagugcucauggcucugauucucccauuacuuagaauguccucccaccugccccagcgugggcauuagagagcccagccaggggccuaccaggauacugccuggugaggacauccccuccucguggccaacccuggccugcacugggagcagcccuguugugccccuaugaggcugaccucauuugucccucacucuggguccaggaccugccuuguccaugccaggguguguccugcugcaccccugccauuaucagcgcccaggccugggucugagcccaggagaugugagugacuucccgcccuucacccuuuguguguguggcuuggacuagcucccuguuuucaaagguccugaugacuccagcagguuuuccacccagcaguaggcagauugcuuuuuuugagauggagucucgcucuggcgcccagguuggggugcaguggcgcgaucuuggcucacugcagcuuuccucucccagguucaagcgauuguccugccucagccuccugaguagcugguauuacaggugcccaccaccacagccggcuaauuuuuguguuuuuacuagagacaggguuucacuauauuggccaggucggucucgaacuccugaccucaggcacucugcccgucuuggccucccaaagugccgggauuacagaugugagccaccaugcccggccaucagauugcuuuucauguuugcugcuccauggggcaaugccauggccacagccuuagcgauacagggcagcagagcaugugggcugugugugucugugugugucuacacauauucuugcccaccugcagcauuucagguuaccuugucccaucccaagccaugcugaccucgaaaugaaaacgaggccaagggagaaauuaagaacacaauaaaaaaggggaaggcugggcacaguggcucaugccuguaaucucagcacuuugggaggccgaggcgggcggaucacgugaggucggaaguucgagaccagccugaccaacauggagaaaccccaucucuacuaaaaauacaaaauuagcugggcaugguggcacaugccuguaaucccagcuacucaggaggcugggguaggagaaucgcuugaacccaaaggcggacguugcagugagccgacaucaugccauugcacucgggccugggcaagaagagugaaacuccgucucaaaaauaaauaaaauaaaaugaaugggagaaaaucguguagccgcaccucuacaaaucaaauccaaccaagucagucaagaaaaggucaucccagggcugggcgcaguggcucacgccuguaaucccagcacuuugggaggccgaggugggaguucaagaacagccuggccaagauggugaaacccugucucuaauaaaaaugcaaaaauuagggccgggcacaauggcucacgccuguaaucccagcacuuugagaggcugagguggguggaucacgaggucaggagauugagaccguccuggccaacauggugaaaccccaucucuacuaaaaauacaaaaauuagcugggcguggcagcgcaugcuuguaaucccagcuacuugggaggcugaggcaggcgaauugcuugaacccaggagguagagguugcagugagccaagaucgugccacugcauuccagccuggcgacagagcuagacuccaucucaaaaaaacagaaacaaaaauuagccaggugugguggcagguaccuguaaucccagccacuugggaggcugagacagagaauugcuugaauccaggaggcggagguugcagugagccgagaucgcaccacugcacuccaggcugggugacagagcaagacuccaucucaaaaagagaaaaagaaaaagucauucuagcuacucaggaggcugaggcggaaggaucacuugcgcccaggaguuuuugagaccaguccgggcaacacagugagaccucaucucaaauaaauauuuuaaaaggcaauaauacaccuaaauuuaguauucaagaguuuagaaaaagaauacacaugccacuagaaaagagaaaaaaaaaauguaggaaaaagaaaaaaguagaauugcuuuuguaaaagcugguucuuugaaaaguugacccccucccaacccugauagccguaauugagagaagcggcucuggucaaccuucugugaucuccuggagauuuuccaagggcacgggaguaguuggcaugaguauguguuauccuguugggauucuugguuacuaaacuuuucuucuuuuuuccaggcagguaagggggacgugcugggguggagguugggagcagggcaucacauuuccuuacguggcaaaggaucacgucugaagagugacuuuucuguuuccacaauaugugcuauugacuucuuucucaugggucuugcugugacuuuucuuucugagacuuuucuguccucggcccagaagagagguagagguggggagucugaccuggagcccauagacagcuggcuuauaacccaaggaauggugaggagucaccagccgagccaagccugcuguccaccccagccccuaccuguguaacagcucaugucuuccucuugugaccugccgagccuuugugaaucagacaguacaaggccacacgcuuucuuucuggcaggggugccaaauuuccccuccuauuuuugcauaaucucuguaagccacagauucccagucccaaaaauaccucccuguccccaggccuuaagagucugggacauuagcagggaugaggagaggguccuuuccuuccuuuuacugucuccggagcuccgagcaguauucacuuuuccaggaugagcacaaguuacuguggcuuuugcuugggagggaacaauucuaagggaacagacucaaagcaucugaccagucagggaagcccucuguagcccagugccugugaauuuggcaguccuaggcuugacagauuuuuauaauauaguugcuuauauccacuaaguccgucaaaaugauuugaaaccucuugaagaauacacaggccgggugcaguggcucacgccuguaaucccagcacuuugggaggcugaggcaggcagaucacgaggucaggagaucgagacccuucuggccaacauggugaaacccugucucuacuaaaaauacaaaaauuagcugggugugguggcaugugccuguaaucccaacuacuugggaggcugaagcaggagaaucgcuugaaccugggaggcagagauuguagugagcugagauugcaccacugcacuccagccuggugauagagugagacucccucucaaaaaaauaaaaaaauaaacacaguagaaacagaguaaaaagaaaacaaagcccaggggaguucaauguuguaaacacaguugguucucauguagcagagcuuuccuggcccacagaccugcaagggucucuccugccuugucuguucagguggccugagccuggugcauggagagagggucagcucaucucaggcuguaugucuugggaugaccauuucaccucuagcagagcccaaagcugugguacaugugauggagccugagcuggagagaaugcagagaaggaaagaugaugaaagcagugcaaacaugugccucucccuccaggugggguggggugagaggaauacauaacugcccauagugugcuaugcuaggcuguggccagaggaaaggccagcagguccuagacugcaagcagcacaggguccaccugcuugagcaaagcgugaccagugaguaggaacuugggccaugcaggaucacccagagccgugggagcaaggggcaucugccugccacccagcuugggcuggugcccucugcacagcucugcugucagccugggcaggucuccugccaccucucauaguagcagcauacugcugcucugcgugagaaggcaguuccuccacuagaccccaagcccauucuuagagagaugugcuggcccaggccucucauuugcuucuucagggacaggcuggccucuggcccacaugucaggggccuuugcagcagggcuucuggaaaccauguccauucauugggaagauccagcccacaugcccuugugccuauuaauccugcaaaaaaggauacugcccacacaaacuccccugaggguggccuuggcagcuggugguggugccugucucugcccacacagacugccucgccacugccaggucccacguagagcuccagucucuaacuucccagaaacaaaccuaacuaacagcuaaccuggugucuugccugacugacugcaguuuguuuuuuuuuuuuucuuuacaacaaauauuaauugcuuugccuuauuucccauaguguagaaaccuugagucuuuucaagccuccugaguacaaauucuuuacuuggaaacuuuuuguacuauugagugagaucaaaggcuuuuagacuuggucccagugggguggugcuugaagugacauaggaagggauucacagcuucucuggaaauaguacaccugagcuacagaaauuguucuuguuacauugaaaacuggacagguggguuuccuugugggcauggggcugugggaagcugcagaggagcaucuguuggaacccuuaugcuccugggacucagguguguggauagccaacacagaaguuaacugacaccaccaggcuuauuacugguugaagagaaaugagacuugucaaugggcuagggccgggcggcucucagggagacugcuaggcuugugcucucccucccuggccucucuagugugaggucuuuuugccucucuuggcuggugaucagcuaggggugucucccuuuugcagggugcagccaggaaaauauccucaugugagagaaucuaagucaaaacaagaacagagguagguuaguaaagaaugcugcugccaaaacccaggcuuggguuuggagggcgggacucccuccucagaccuggaggcccccaaggcucuuacucuggaaggauaauccuaaccccuggaguaccagacagacaugccucucccccuugggcaggcaacccucccuccugaucccugaggcagagcugccccugccugcaguuccaagugagaaucagcugacagcaggauggcucaccugccacucagaucaaaaccuguggcuucugacauccaagaugucuguggacuuugaaaaugggcagggcuggucuaaccacugccucagccaagccagccuggccuaccuaucuucagaggggcugagcuucaggcagcagucucuauuggagggcauuccucugcuagcuuccuuccuuuucucucuucacaugucuucuuccuuucugucccucucuuccaacucauacgcuucuucagaucccucagaccagccuucagcuuggaucauugcccaagaaaaugcugaaacuauggcaugucaggcugggugcaguggcucacaucuguaaucccagcacuuugggaggccaagcugggcagaucauuugaggccaggaguuugagaucagccuggccaacauggcaaaacccugucucuacuaaaaauacaaaaaaaaaaaaaauuaggcaggugugguggcucacgccuguaaucccagcuacucaggaggcugaggcacaaggauuaucugaaccugggaagcagaggucgcagugagcugagaucgcaccacugcacaccagccugggcaacagagcaagacucugucucuaaauaaauuaauuaauuaaauaaauaacuaaauaaauaaauaaaaauaaaaauaaaacuaugacacaucagagccaacagccuucuuaggaaucugcugggccagccccuagucugacagaugaggauaccgaggccuccuaagggccuggugucuugcccaaagcugcagggaagaaacagaguccccuaagacucagcgcagugcccccugcuccaaccagggccccacuucccucccaucagccugacaaggagcgcguccucggccucccacaguuucuuugguucauauuuuccaagcaguguacauguuuagucugagucugauagcaccuacauuauuagaaggaacuuugcccuguuauaauacucaaggcauuuauuuaccaggacaagagguuuagauagcuaagguuuugugucuggccacaagaaagucaauuuaagcuuacguuauauaagcuuaacuguuaaccaucacccugcuccaccaugguucacgcccugaggccaaguggcuucuauauuguaaugagucaguuuccauaauuucugacaucccuggguuucugaauuagaaaacagaagcaccaaccugaaaguuaagguuucugagucauaagaauugaaagccaaauacaaucuagcaaucgccuuauuucacagaugaggaaauugaggccaagcauugcucaggccucuguccccugcuccugccucuccacccaaaucucuaaggcuucuuaggauagaagaaacucaggagcucuccggugaagaaagugggguccagagaggagcgacucaccccagguccugccaccagugagugugagggcccagauggaccccacccagugcacucuccucagcgugcccucuagggcuuggucuggaggaugccauuccauaaacauacuacuuauuuggaaaaaucuaggacauggaagaaaaggguucccaugagccagcuuuugggaaguuauuuuugaggaggugaggaauuucuuaagugucauuguuuauuuucugagcauguuggcucucaagauuuauccccaaagaagaaaauuaaaguaugaccccaggccucaagggauuuguucuuuagcagcaacaaaacaauuacaagaaaaaucugaagguuuaaggccccugaccccuuaaugucuuuguuguagcuuuugcaacacauuggaaagcucaggacaucuagucuguuucugcuaaguggacaaaagcuggucagguguaaagaaagggcuggugcacacucuaaccgcuagugugggacuauuuucucucuggagaugcugcugacuuucuaagcuucaguuuuggggacucagcauggcaugcguccucccagaggccacacauucugacuuacagucauugagagcaugauaacugguguguccuguuccaggaaugucucaaggcagaaggccugccagcaagcacagaguagcaguguacccuacugccuuuugaugggcaagggcaaggaagugccagccuuaggcauuguuaacacaucugucagucauuugugcguccauccccccagugaggacccacaugccuccugucccuagguuucaugucugggugauaagacucccugauaccuuuucaauucaauguucuuuuuuuuuuuuuuuuuuuuuuuuuuagacagaguuucagucuuguugcccaggguggagugcaauggcgugaucucggcucacugcaaccucugccucccagguucaagugauucuccugccucagccuccccaguagcugggacuacaggcgcauaccaccacacccaacuaauuuuguauuuuuaguagagacuggguuucucccuguuggucaggcuggucucaaacucuugaccucaggugaucugcccgccucggccucccaaagugcugggauuacaggcaugagccaccgugcccugcucaauucaacauucuuaacuccccaguaagucaaagaaauaaugagcaacacagacucuuccuaaucugaucagugacuggcuugggccuuucugaaagugcucuugugggcuucccacauuggguccgaaguuaggacacagagcacauuccucagagcaaggggccagcugagcucacugagggagugaagagcucugguggcaucguagauaccugcucagagugcuggacucuaccugggaccccaaaccacccucccccaccaucagcagcaggugucaacccccaggacuggaguugucacaucacugcuggugauauguguucuuuguucuuuuucuuugugaaggucguguuauuuuuuacauuugauagacacugggguaugcauuccuuuuacugcuuauuuuuacuuuagucuuacccuagaucauggcauugggugaagccagcuauagacagagcuggcauuuuuguaauagaaauaggggucuugcaagugagccccggaaggguaccucccagagccaggguaggugaggaggugauuaagggucaucaccucauuucucuaggcugggagccaacauuccauuaacauggcuucuagggagcuucuuaucaugucauauuugauggcaacuuaaaccuuuuuagccaugugcauuuuucagagucucugucccugaggugcuuggcacaggggcccaagcaaggugacugcucaggcaaccccgugguacaccuuaguaugccuggaagcugucaccucccuggcucuggcugcugcgccccagugcucagcugaacuugguuucuuugacuccugaagcacagccagccauugaacacagggaagaaaggacgagacuaaagggagcuguugcuuucagggcugcuucaugaauuuccccuaaagagacacaaagaagacuaaagccccauaguccccuuugucaucagagcccucguuuuugcuguguuucuguugaugguaaaaugugccugccucugucuaccaggccacacccagcccagcggagcacgcaccuccuccaguuccccucuccacucagaaaugcaccaggacgcauuucaaaaucucuucagcggagcaaacagacccccugcauccccccggggcuggugcugcccugcccucugagcaccuguaccccgcucugggcaggcugucacuuggccuucccuggguugggcuugacagcggacugucauaguggcugaguucaaaaucagccugcguggcagcgccuuccugaaguuagaagguguuuugcagccccgggcugagaggccccgcaaugugagaguggacacucauagucaaaaaguucuccauuucaagaacgcguacagccaccuuccuuaccgccggcccugccgggagccugcuucuuaucauuugcaccucauugcuuuccucaccugccaucucacacguggcugcccuguguugccccugugugcugugccaauuguguuuuuuugcucuguguacauuuugguuuuauuugggguugcuguugaugauuuccuuuguuccgguguucugucuccccucgcuggcugugugggggcugccuggcccgcugcuugccgccuccauagauccccguugcgcagccaucugucauggacgacauugagguguggcucaggaccgaccuggugagacucgacuuuucuauuucaucugugggguguggagcggcagaggcucuucugaggacaggccuugggggagcaucagcaggggcuccaccccugucugggucaguggagaagggaggucugggcaagcuccauagcugccccuccuccccgacaucagcccauagcugugggugcugcaguggccucccggccugcggaggccaacugugcugggggcaaggccuugggcacagccuccuucacccacacaguccuagccguagcuggcuccaaaacacacacuugccuuccccccaguaucuuuuccauuucagauguaugugccgugcuuugguuuuuugggggagggaguguugggggagcauguuuuuuguuuuguuuuguuuuguuuucauuucuuuuuuuuuuaauugugaaguauacacacagugcuuuuguuuuuaauuggcugucaucccccuccucccuuccugauuuuugauguaaaagaaccccugccccaaagacccauugucuccauccucagagauagggcuagaagaugaggauacuaugcaucugaaaauggcaacaggucccaagaaaggagagcugcaguggcugcaugugauaacugcuggccccucccucuguucuuuacaaagcacuuucacucucagcagcccaguagggggccaggguggcggaugaagaagugcacucugggaaguggcuugcccagagucaugggguaguuggauucucccccagagcuggagacaccucaucucccuccuaggugccuccucuguagggggccuuguccccaggcagaagagccuguugaguucuuuaaccacagggucagccuggcugucugugggcuggugaccuggcuaccucccacaccaggacagcaggccucagguuggggccucuggcugcucugggccuccuccccagaaggucagcuuuccaaacacaugccuugccaaagaaggcagcugccugggugucagggaggaagaacacaccccgggacaucuuucccaaggggcugucucgaaaagaaauugcuucucucacagaagcaaggcaggaaggaccaagguccuuaacuucuaagggggaccccaggguccagacagggaggggauguguccaguaaggcuacauagcaggucagugguagagucaggaaggaacccaggucuccuagcccagcccagggcuuugucacuuccccauccugccccuucccaaugaggcccugcacaugcugcucuuccccaguccccagggaaccccaugagcucaagacacuaccauguucuccaaacaaaaucaagucugaugcacuuuaauuuuugagugcacagagccuccauggcuccuugaggagccagcagcagauaauauaaucugggccacgggaggaggcuggugcagcucccaggaggcugcaggacauggcuucuggaggcacagccuccacucccaaaguaccuacugagugacaggcccugugcugugggcuuuguggcccugagccaucaaggccucaugcgguuuccagcuauuggugucaacagcgucuucccagaaacccuguggcuggcagugaguggguguuguguugggcacacgugacccugugugugcucaggcucagcccccuguggcuacugcucugugccucucccuagagccucaagagugccaaagguggggucccgcccucugcagcccaggcuggagaaccagccugcaccguuuuuggaguuuucuuuccagccuuucuggaggaucaaaaccuaaaacauguuugaauuuuuugcuuuuguuuuuuaaaaacaaagcuucuguuucuccaauaagaagagcaguauuuuacuauuacagaaaucuggaaacagggaaaauuaggaaguuuuguucaggcuacccugggcagugcuguccuaggguggccaugggcagacagagguggcugggcgggcagugcuuggaccagugcccuaauuucauuuucucugcuccucccacagaagggugaugaucuggaggagggugucacaagugaagguauggccuggccaguggccuuacagcccccuuuuguugccucugugcaggcugcacaggagccagcccccaucaucuuggagcccccgcugccagagcaccuacuggugccaggcccugagccaugggcuucacggguggcuuugucccacccaggucuuacgcugauuugggaagugugauuuaucucgcuuauugggaaacaggucagaaagaacaugucaauuccacaaaguugcagagcuggugaauagcgggugcagauugccaccugguccugacccacaggugcucagcccagcucagacacgcaguuuguggaggugcgcagcagcacccuugggccacugagccagaagggaggagccucuccugggccucagcugaugggcuggaugggagcagcggggucuuaguucucccacauggccacccccacauccccugcccuucacauccugccuccccaagcucaucuugccccacuccaucugccucuccgugcuccuguccuccucuccccaggucugccagacccuguggccagaccgcuccgcagggagggaaacuucagaggacccugcucccuagcucucagugcccauagaaauggggcacuccccccuccccacugcauuccucagcaucuccucaguccuccauuggugggcaagggugggguaggugggaugguuccugccuguuuaaucagaagcuggccccuccagcuuacccugccccacccccagugcugaucuggaaaauggacaaaacccagugcugaucuggaaaauggucagcgguagggugagcacucugggcuguguuuuccagagccuuucccuccagggcaggaggacugggcacagccaggagccuccccccacacugcagcucacgaaccccucccuacccaccugcuccuaggugggcuucaugccugcccuagaggaggaaacgggcuggggaguggaagggugcgcuuccucugguggccugcccucaccaacccugacccuugccuugguuuguauugcagaguuugauaaauuccuugaagaaagagccaaagcugcugaaaugguucccgaccuccccucgccccccauggaggcuccugccccagccucaaacccuucuggccggaagaagccagagcggucagaggaugcccucuucgcccugugagcagcucugugguuugccuccccagauggcggguccccgcucgcaccccguggacaccgggcacuggccacuccuacauccccagcuccacacggccugcacaccuguguuuccauggaaaugccaccgugucugcucccaggccucccacuagucaggaccagcuucagccacuucuuuucucugaguggugggacaacugcagccagagacucucuccccucccaccaugggccccucugcccauguuuccucccaggaagagcgggcagaguggcccagccccaggcagugcuuccugagcagaccacccggacugucuuuccuccacccgcccauggagaaagagcacgcccggccccgcccugugcucaccucugccuggcucagcgaccuucucaggcauucugcccuccugggccccucucucccugaaggggcuuuguggcaucucuggaagagcagggugugcugcacucaugggccuggucucacuccuuggacuugucaccuugugacauuuggcuuaucagcauuugagaaggcucugcugggucuccauggugggggucucucaccuucuugacccucucuccaucauucagcugccagcccaggcuucacacccaagcuggcucagcagccgagccuggcaccgagggucccugcaggcucccugggcagggagagggccaaggacaauugggagggcagcaggcagcccgcagaugguggccauguggcacgcugcugagacgacacuaccaauaaaccaaacugccacgcacacacugcaggcucacacccgcacaccugguccuggcuuguggagggacuugcacuggagguauugcucuggcuugccuggggaagugucacagaugugcacaugggccacacucagugcuguggccuggccugccguagccucacacaucugccucaagagccagcagcaaacagcuuuguggcauccuuggagguucccagugacugagaggccugggcagcacuaaggccccugcucugcucccuggcauaggccuuggccuccuugcacagacucuccugacagucuggccuccucccaccucagagguccucuggccaccaauuuauacucucuccccaagcugauccugaaggcaggcagagcagcuaggggcugguaacauguauucccaucccguguccucacuggugugucuccuggccaugggcaagggacucgggucaucccaggcccugguccagccagacaccuggccccacaccucccaccaggcugcuguugcucagaaggagaauacugcagcuguaugcauccccgugugucuugggcccagcucgcugggucagucugcuccuguccccuccagcaugcacugccuaggucagcacagguuccugauccaugguguaguuagcccuucccaccuggcaggacggcccagaccaccagccaagcagggaaagggggcugggcuugacgggagaagagaccagcgacauggucguuggggagcauucaggauggcgacuucagcugggggucaugcugagcaccaacaggaacuauuccagugaagagcaagugcugcccgacccaggacccugugccaggcuagcagcccuccagcucccuccagagaggaaaccucugucuggcugagggugggacuagcugggaugucucacuccaguugcucagguucacccaggaagcuccuccguggaguggccagccugauucuagcccuguccucucuggcagcacaugccacaccugccugggccuucugcucccugaugcuugaugagccccugccuccucaauguuucucaaagacagaccccccugaggccagcuugaaugugaagacugcugaaguuagcuggcuucacuugagcugcagaaaagguggcugggauggcccaggugcacccagaggccccagcccuuuggcugccuuuggguugugacuuggguugucucugaggcccugccagagcugggccugcggguggugggcgguccgaccucgggcagucagugcuccgcagccucagcacugcaucccagacccaguguccucagagggaagagccagccucccugccucauggaaccaggagucccaaaaagucaggagccuggaggcucugaaaggagcagggauuccauagugcgugaagcugaaauaggcgcccuccuggggagcccccagcaaaacuguuuuucauacccacucccagaacugccccgcuccagcuccagcgccagcgccagcugguugccaggcaucauuggagaggccuggcugccccaggggcagcagggagugguggaccuguaugggcuggcaggaggccauuggccaugcugacaagugucaccugccuuccuagccuggagccaccccucagguggccugcuugcaccuccuauccggagguagccugccccaccuguaggcagagggggcucuugcuugaggccugcacaggaagcaaguauagccccggugccccagaguggguuccacuuagcccuggcgagauggccuguccugagaucucugcucccagaccccaccaucuggggagcacaguccuuaggcugccugguccaggaagggggugcggcucugucaggaaaccuggacucucaaggcccaccagccucuccgugaguguuagaaaucacagauacaguauauacuuaauuacacuaaauuauugcugggauuccuuauaagcacuaauuauaccugauuauagguuaaaauauuuauuuugucaaaauauuuucuugggaauguguuuaacccuuucugcguucauuguugcugagaugugaaaacuaaccauucccuccugccuaccuuuuuggccacugggcggcagagaauggcgcuaugugcaguugggccccuggcaccaugggccuuuggccugccugcugcagaguagcccugccugggcagucuccaggcacugagcaggccaucuguggccaggcugagagaaugacuggcucgcuuaccagcgugcaugggacaaggagcuuuggagccucaagggguuguugcuggccugggcuagagggaaaggugaccauccgucuguccuccugucuuucuauuagcgccuccaugugagugauggugccuugguucacuagccuucccccaccaccccaccaugccaccugguggucuuggggccugugcugucacuccagccccuggggaggagaggacccagcccggagaguuggggcaagggcuccacauggcccaagggcaacagaugcucgcagggcagcugcugccgaugcucacgcuccugccccccuccuucccgcugccacaccccacccugggcccccgcagacacgcaucucuaacucaguugggcccagccuucuggauggcuugggguaggccaugggcccaccuggggccaggccagccccuggggcagcucuggaagagcaguguggaggagcacuugcuugcagccuggcuucagccucuggcacugcuggaguggucccugggagcuucugcacugucggcuuuggggacgucucacccacuuggguuacaguaggccuuccccacccagagagaaguguuuccaccccagagacauugucugucagccccugaagugcucgccucccccagugcccgucaccagcccuuccuaucugugggguccaagucaggcuuccccugcggccaccagccauagggagcagccaucagcccccgagucagaacugcuucugucuguccauaccuccaggcucucccggagagggggacggauauuuauuuccuaaaguuugcacuuaauugugaggauucucaggauuguugggggcuacugaaaagaggaauguguugaaugucgcguuugcuguccacucguccuagaaguuuaguguuuuugucacugucauguguuucugugggcagagcugguucuggagggugggucagugcacccgaggcucagagcauccauccaccccacuggcccuccuuccagauacccucucucuaauuggguucuugcauguaaaauacuccacaauaaauaaauaauugaacaaauua

SEQ ID NO: 21272 - RNA, 30537 nt, Homo sapiens
ucugucuccggcgccgcccgucgcggacucguccuugcugcagucgccgccgcaguccucgccgcagucgccgccgccgccgccgccgccgccgcugcuccuccgccuggccugggccgucugcccgcagccaugagcgugcucggccccgguggagcccgcaguccucuagauuagucuccaccgccguccaggacccacuugcagcauggagucgcccgccucgagccagcccgccagcaugccccaguccaaagguaggcgcucccggccgggaccucggccugaccccgcgccuaaucuggggccgggcugcaaaccccgaccuuucuuuggucccaccccauccuguucucgaccuggcagcggcguccggucccggaaccccuuccuguucggggucccgggaccagcccccgccugggcccucaccuggacccccacguuaggccuugggacugcacucaggcccgagaucacccaggcuggacccagacuaggacuuuguucugcucaccccauccaagucaggagccucauucugaccucauuugggccuuauggcugcagccuggacaugaacucucccagucuucucccucagcgggacccaggugagauucacacuggccuucaccuggguccuugggcagcacccagucccauuucuagcuucgggucccagggcuguauccagguugggauuuaacuugagucuccaucugggccccagagugcuccuguuguugcggaccucacuguacccccuaugcgggugcucuggcuacaccccagcucggaacuccccguccuucucucccccagcucuucuuauccuuauaggcccuauguugccccuucccuggcuggccugcacccuguccugcagcccugggcucccaggaaccuuccuuguccucccaccccucccuaagguacagcccccucucuaccggccucucucugucuugaguugcaagcuucucccugcacuggggguucucaccccaucuuauucuuguccuggcugccugggaucugggccagccgccaggccagggugcuggcugugcaagggauuugcucuucuccaaguagcuggccuuccuggaaauuuuugugagguggcagcagcaggauuugucaugcggagggggaaggaugaaacucggagggcaaaaggggaauuuuuuuuuuuucaggaagaggaaaggauguuuuuggugcgucggaguuucaguaggcuggguugugcgagagauuuccaaaccggacauagccguaaugaaugggcugccuccuggcuuucugaaccugcagcugcuucaccccagcaagcucccuggugucucugggccucaguuuccuuuucuguaaauuggaaguaaucgcaccugcuucuguggacgugggaguguggugugggguggugaauaguaaagagcucugaggcguucucucagcguagcaccuggcgcagagccggugcucaccaggguacacuggcugcacacaucucgcuauuguuuccauucuucuugcuggaaaggccuccacugcuggaagugcagccucagagugagcaggaggaagcaccuagcagcgggcaccuagugggcacuucaucaggggucagccgcucuucuguucuggagggugcaggccaaugggagcccuaugugggccuggggagggcaugggcucuuccuggccccugcugcuggcugcuaugguggcuggagccgggugggcuggauaauuaugccuuacauaagugggaggccggaucccugaccauugcccaaccacugugaguaacucgggaggcacucgacgggggaggugucuggggagggacuugcacugcacagaccucguggagcuugggaaccaggaaaucagacacuucuccacucuggagagcucggggaaggguaggaagcacuguuuguuuuggaggcuuuuuagcucuccaggcagagaaugccucaucaaaauaaaaguuccaguugcagaguugugaaaggagaggggucauagaugcagugagaaugcugugagagggccaaaaugaacuucuagauguggacccagguccuagaugagguugagggggcuggauggagggucagggaccucccucaggcccagggacucuguagucucuuuggggucuggggaaggaugugguggcagagccacaaugcccuucaccaaaaacccuaugagcuccuucuuuuuuuccaugugccaugcauuuucucauuuauuccucauagccccauuuacugauaaggaaacugaggcguuaagugccuugccugaggccacacagcugugacaggcggagcuaggguucccccuaggacuguguuuccacaguggccuuccccgugcuccccuaugugccccucccaugcuggaugccugagcugagcugguggggugcccccaccccuggccuugcucagagcaugugcagugggccuguccucauggccacgucagaccuagaggacagacugaggcagaggugaugccucuccugugcacagcgcuuuacacugggccuguugcauucucgcugcaaaaucccacucauuugacagaugcagaacucagcuuggauggaggaguggccggacugcccccauagguggagagccucacucugugcccaccccauccugggcacugggccucccagcacugaucccuucuccaccuucucaaaggaauuugaacaaagcagggaguggcuggcgcuugaccuuacuggagcuuuaccuuugagcuuccugccuggcagcaggugcccugcacuguuuccaugccaugggccuggggaguuuucuaugagugugugaggcccucaggcccacagcucugcugguuuuccccuggccuccuugcccacauggccaucucuggcugggguuagaggccaaguggcuggcgcuggggccagugggugggggcaugugugcaagccacauuuguccuuggaggguaccacacguguccuguugucguucagaacauggguucugccccuucugcccuaagagugccaccugugggagcacuucauggcuaaucuucacacagcuuggacuguggcuguaggacuccugacugcccgauggugacacugagguuucauagagcacuguuguauccuagcccugccugcuguggccacccccccaaccccuggcugucggaaagacuggagguggcaccucggggacuucccccaccccucuugugacgcacaggaaacucucugucagccaacccauggcccagcgcccaaagggagcaaaguucucaguuggcccgugugaggagaaggccggggcagcggaggcuuccggcggugagucagcgggcacugggugcugacucacccgcugggcaugccagccggcugccuacagcuuaaaggggcgaugccugccagccugguggguggggaggggguuacguguccugcagguggcaccuagcccugagcuggggcacuggagguggccccuuccugggccucggacugggcugggaaccccugggcaggcccucugugccccacccaggaacuuccucuauuaggcaaggggcucugcuuccucuugcucacagagcaggagcagguggcagugacuguuuaccacccuuggcccaggggacaccucagguucagcugugcagcugggacucagggagggugaggagcagagguggugcagggucggcuggggugggacccggccugagcuccuggaagauggugauguggagaggcuaagaccucaguuuccagagccugacugccuggguccaaaccccagcucugucccuuuugcgaugugacgugggacaaguugcaucugguccacucucugcacucuguaaaugauuucuguccccugggcauggcccagcucucagaggagaagcuuccauuuccucaucugcagacugagaauggggacccugcuugucuggauguagacaguuccauuccacacuugcuaagugucaggcacaagucauagugagacugcccucugccugcagagaacccagccgaggcaugccucugucaggcaggaagccggggguccugggcucugcugggauggcccuggguucgaauccuggcuccacuacuuccuuaccugggcaagucuugugcccucuuuagcccucagucuccucuucuguaaagugggaguaaacaugcucccuugcaggguaguggucgagauugaagauagcauuuguuaagugaauggcaccuguuauuauuuuauuauuguuacuuuuguggguguaguucauugguagguggauaaacaguagcagggcuucgugacaaugugcucguaggcgcugugacaugaggccucuuggcuguaggguccuuucacgcaggccagaauuuaccaggcuuuagggccucuuaacccacugguccccaacguggggcuggggacugccccuggccuccugggccucccuugggagggugaguggggaacagagagcuggggccugcuccugcaggccugcccugccccuggcuuuggcaugcagcauuaacaggacgaauauggggaagguggggugggacugggaauuagaacucaggccccugggccagcccgggaagcaagagggccuggggucaugguucuaggggcucaguccugagucagggguguugggggguggugggccaagcugaggggagcaacugggugccagugucuugggagggucccagaggagggcugcugggcagcagcauggaggacacagcauuguggcagggccccacgacugaugcccacaugccguccacgccugcccuuguccgcgccuccuggcgcugcccaccuccaucaggccugugugcccaguggcuucugcagaugccuccccgaagcaguggcccuggaaaccucaaacagccucuugccaggggcaugaaggccauacagggccaggggaggcagaagcaguuuguugggccccuugcagcuuccagauaccaagccugacugcggcagcuccagagagggccccagacuuucuuccccugaccccaguccugggcacauguccuugucaccucccugcccugcacuccagggccaccuucccugguuucucuggggaggccauguccagcugucccucucccagcugguccccugcccaggguggccggcaccaccuccugccauguggcccauggccgggauugcaccuggcucugcugacaccuccuggcggcuauaucgagugcccugacuguccuugccugcaucacugugcugaugcccccaagggcuuccaaggcccgucccaagguuuacaugugccagugugugcggugaugcggugacaggccagggggcugccucacuggggcagggcugcgaggggcuguggaugccagcgguguguucagaccuaaucaggaggugugugggggcuggggagcacugcugccugggaggguugcuuuggcggugucaguuggcagcugaggcacacguuggaggccugcccaggacggcucuggguauggggauggagacagcucccauccccuugucauucugcucuugccuggcuuagccuucuggucaacccauagccuccugccguuggcauggcacacggcaucccggauggcuggggcagaccccaggguggcgcgggcagacacucguugggaaagucugcagggacuuccagguggcagggcugguucuaggccagcucccuaccuaccucucagggcugcuguugagggugaaugagaccuggcaaguccagggagccccuagguaccagacagcacugaauuugaaccugaugucugugcuagcauuuccaucaccaagaaccccguuuuugguaugucucaucaucaaucccaugcuuuguaagauuuuaauaguaaugauaaaucccagccuuugggaggccgagacaggaggaucauuugagggcaggaguucacaaccagccugggcaacauagggagagcucaucucuacaaaaaacauaaaagauuagcugggcaugguggcacacgucuguagucucagcuacucaggaggcagaggugggaggaucguuugugccugggagguugaggcugcaaugagugccacagcacuccagccugggugacagagugagacccugucuguuuaaaaaaaauagaaguaggccaggcacgguggcucacgccuguaaucccagcacuuugggaggccgaggcggguggaucaugaggucaggagcucgagaccauccugucuaacacgguaaaaccccgucucuacuaaaaacacacaaaaaauuaaccgggcgugguggcaggugucuguagucccagcuacucgggaggcugaggcaggagaauggcaugaacccgggaggcggagcuugcagugagccgggaucgcaccacugcacuccagccugggcaauagagagagaaucgucucaaaaauaaauacaauacaaucaauacaauagaauacaauacaauagaauacaauacaauagaauacaauacaauagaauacaauagaauacaguacaauacaauacaacacaacacaacacaacacaacacaacacguagugauaacagugaagcacagauggcguuuguucagguuuguuuuccguucugcaggagcagcagcacuggccugucgacagugcagguggcuggcaauggccuugcugaccucgagccgggcccacguggggaccuuuggagcacagccuacgauccuggugcaaggaaugucccauucuucugaugcucugggagggcugagcaucacuugugggucccccugcccugucauggccucuuaaagccugagcauggggccugccccacagugugggagccuggggccagagucccaccgaucugaccccuuuugugcuggggauuuugugugcauggacuuguuuggucuucacggcuacccagcaaccuggguguguugucaucaaccccaucuuaggagugaguaaacugaggccuggugggauagugaccugcucaaggucacgaaggacuguccugggagcauggcuuugucuuuacaacuccggacccuugcucauccuuucccagaggucauggccccuucacccguucauaggacgucaaaggaggaaaccgaggcuugcacagagagggaguguggcucgcccccaggcuggcacgggccgacgcuguggugguuucuccacugaggugcggggaaggcaggagcugggacccaggcugggggccugacucugcugcugcccuggugcgucaccucaggcguguccuggggccccuggugucagcaucugcacuggacagucucuggggcacccuccagccugagcagccugcugcgggggcuguacugugcucagugagccuggcugccccuucagacagaggagagugcuggggcuggcuucaagcaggccucuuuguuucuucuuuucuuuaaauugccugcacuugaguagccuuuaucacacagugcaggaaucucaaagggacaaaaaggcagucucuuguuucuccucggaauacucugcacacuccagcauuuucuuuccuucuucuucucauuuuuuuuuuuugagacagugucuugcucuguugcccaguggcacagucauggcucaccacagcucagacgauccucccaccucagccucccagguaacugggacuacaggcacgcaccaccacgcccacuacauuuuuguuuuguuuuauuuuuuguagagacaggauuuugucauguugcccaggcuaguauugaacuccugagcucaaggaauccacccaccuuggccucccaaagugcugggauuacaggcaugugcuaauuuuuguauuuuuaguagagacaggguuucaccauguuggccaggcuggucucaaacuccugaccucaaguaauccuucugccuuggccucccaaagugcugggauuacaggcgugagccaccucacauggucugaccggcauuuucuuucucacacugcuguacuccugcugcucuuggcucuuccugucccugggaggccacuccucgcauccugcugaggaccugcaggauccucaccaauuccaugugccagccuuuugauucuauaaacccugggccucaguuuccccaucugcagcauggagaucacauuaguaccugccucaagggguugcugagaggaucaaaugagauguaaugaaagaaauuugcauaggccaggcacgcagaggacaccccaggacaccccagcacauaguagguauucacuaaauguuaguggguguuguaguguggggguaagcugcucaacguggaauuucuggaugcagaagaaugggcauuuugauggccauggggcauggaggacccagaccggugaggucuggccaugggaggccaggcugcacccugaugcccgcagccaccugcugugggcccccugucuuucacgugccuugugccccagccacucugcccgggguccucccguguugccuccuucccucuccagcgaggcccgugccucuggcccuucccuacguccuucccuccaaagcacaagugguuccauguugcaggcgggccaugguugucucugcugggcuguuggcauugggcgggaggacccucuggcagccaugguugccccugugcagcugagcaucuggccuccccaccggauguuaggggugcucccgagccaugcugguccggagcaucaccggggagggggcgcugccagguggauagucuggggaucccccguucucugcaggugaggaagucccuguaggguagagagguggggagggugugaggcccuggaggccaggcccuggccagguggccuugcacagccgggcagaggcagggcagggcuguggagggcagagccuuggucacuccuccucacccuagccugcugcacaccuacaaggugaggauagagaagguagggccugcaguggccguguaugaggccagauggcacagccugggccuggcauggagcaggcacuugguuagaugggagaaccuuccccuuguccugcauccucuccagagcccaggacaggggccccagaaccucagggcaaggggcccugccugaaggugcauggccacccccugcugcccacaggugcuuggcaguggcgucugcaguaccucaggaccucugauggcaccuguccuggggagaggggccagugucuggcaggucgcagccaaacacauccauccacaccgucgagguacaucugcccacgcaaaagccugugcccacuucucggggccucaguuucccccgugccauggagcgcauuggccuuguugcugucccucugagggacccuggggaauagagguggccuggggcagggcggcgccucuugcugcucacaucucccagcccuuguggcuccuucccuggcaggcccagaacuucugcaguagaacagggaccuccuggaacauccggaagucaggugagggcagugaacuaggagcagggauuacuucuguugucagaaaccuggugaugcuccugcauguggcaugguguggggcugacuuuaugaguggaggcggagcaggggcugcaaggagggguugucaucuugccccugugggugacccuuagagggucacacagcuuggucuccccaggcccaggguagagggagcagccgaagugggggcccugcccucaggcuguugcuguuuggacguuggagccagacagaccugccuuuauggccacuccucaccagacgcccaccguguggccucucuaagucaccucuucucccgcaugcuugauacaacagauaagugaaccuccccuacucccuuguggagucacugagaggguggacagggguggucuggggcugagggugguguucucuugggagcugugcacuuccagauggccccaucuaaucuccacgcgccaggcacugcuauggcaugacgcugauaacccggggagguuugucuguaaucuccacuuuacauauguccagagaggugaagccacuugccugagggcacacagcuaggaaggggcagaguugcaguugagcccaggccuuggcuccagagugagugcucacaggugaccugcugacuggcucucugagaugguaacugcagaacggccaccugugggacuccacagcagagaagccaucaggccacagggagagccggucacuggggccugcgcagucaggcagccucucugaacuggugaaaggcaagacgacguaguagcuaggacagucacagggaagagcauuucaggcagagggaagggcaugugugaaggcccugcggugggaaagcaggugucucauucagagaagggcucacucaagggucgggggcucuaguugggggugagugggaggagauagggcagagcugccacggccagugagaguuguguucuagucugggggugccucucuuuaccugugguguagccucaggucaguggcugaauucuggucaguuucaguuuccuugccccugccugggggcugcuaugaggcuggaguauguggaggacaccccaggacaccccgugcugagagccgggacaggcgggcuuaucguggguugccaguggccgccgagagccucuguuuguuguggugaugguugccacaacggcugcaccugggcagcccugggcugccuggccaucugggcccagcucugacgucugcagcagccugaggccuguuucuaggcugucuccaugacggccucacccacucccucugacagcuggguggcuuccccauggagccuguggcccuccugaugcaggcuugguguccccaacaggccgguggaugcagaggccaguccauauaccacccaggccugcgaggagcgugguccccacccauccagcccauaugugcaagugcccuugacagguggggaaacugaggcuuggugaagggggggccacaugauacaacauucccaaaucccaaggcaugagguggguggcaggcuggggccagagggaccaagagcagagagagugcagggaggguguggcguggaccccacagggaaagggugggacucaaggggcugggggcaaggucaaggcccagggucucugugcagagcuuuaauuuuuaacagaaaauauuuuauauucugguuacgaaaagccugacaucaggaauaaaagcuaccuauaauucucauuacuuagggcaguuuuuuuuuucaccucugcagagaggcuggucauauccauggugaccauuuaugggccacaacagguccccaucugcgcagugaacccugugcugagcaccuugcagacgugaucuugcuucguccugcagcacugugcggggcagguggguggcauuucugccucgagcuguuuuguacaugaggaacccaaggugcagaggagggcaccaugccagggucgcagagcuggaguuuaccacggcugcgccacuccaagcccagagccucagaaguucagagacuuuggcccagaggcaggauagaaguggccucagaagcugcuggcccugugugccaugguuuuuccuguuagaaugugcugagccucugcaucuccagacucuguugccguuucuuguugagcacgagacuugggccccuccuuccgccucagggagggcucccuguggcaggggugcugugagccauggccuggccuguuggggucugcgagucaauaaacucaggagugacuccuggccagaccccugacuugcugugcagccuggggcaaguggcuucaccucucugagccuguuccccaaguaaagugagguugggagccccucccuguagggcugugggaguaucuggagucacagaugagaagggcccugccuguggccggugcuguggcugugacagacucgcagugagacccaugcggucccugacagccaggguguugcugcaucuuaaaaugagauaaaaacgcugcgcacaggaguagugacuaggcgauugauucauggggugagcaguuagcaggcaggcacccagugcauguggcggcagcugcugcugcugcugcugcugcugcuucugucuguggacgcuguuguuuccugaagccucuggggccuggcagcgggguccccgggguggcuuugguggaaaggcugcagguaucugcuugccuggcuccugcacucugcccaccugccccaggauggacccugggaccccugucccugccaaggcuauucuguuuccuguuguucuggccuugucuucccaguagcgguaaccacccuucgcccuccaucugggcuggguuggcugcugggccccggugcguggcucugagauggggccacaagucuguguugcaccguggccaaggcuggaucugaaccuggcuuggaggcggcuucagagacuggggucuucuuggcaggcggcagcagggccaugggcaguuucuaagccccaguaccagcagccagggugagccagcagcagggaguggcggguggugggugagggccaagauguggcaggaucaugcuugggaaaugaugaggcagaagcucccacaagggcaggcauguggccagcaugucuguacuggguggucuccgggagccgugucacucccagcccugcugccugauggugccagagcaccaggugacccuggcaucucugauccuugcuucuccugccuguggaauggcggcuaugccuuauucaaagggcggcccugacuacagggagcucucucugcaugccagccccacugugccuggagccccagaaaugcugacccuccguuaguaccagcugagugcugugcaccuggccaggcucuuguagccagccugagagguguggacacuggggccucucgccugucccuagggguggagugaggaagguacugccccgggacucuggccugccuggugcaggggaggggagagagccagcgcuuuucaggggagggagagaaacgggcaucgggugucggccuccagggugagcagggcccagcagagcuagccuggagggcagcccgggcuggaguccccgccugcuccaccgccuguugcccuuucugggggccuggccuuccucaucuuggaugcaguaugagccccauccugcuaccugcagcuaaugaagccccuguacaguggcugcugcaggugcuggcuggacccccgcugggccccuucucaccccacaucccauugacuagucaggcagggcagugaggacaccucacagauggggaaacugaggcccagggagguacucaagaugugcccagugggcagggcugagauaaggcccuggaguccagccuccaggccugggucuguccugcucugcuccccugcagggcuggugggccuccuucccccuuugaaggccuaacggccuggcuuggagagagggggcucccggcaugggugauggcagaggcuggcacccuugugggccagggccugauggcucaugggagugcaggggacauugaugucaagggauaggccagacgccucaccuucucuccauucuaggaaaauccaagaggaagaaggaucuacggauauccugcauguccaagccacccgcacccaaccccacgugagucugccucaguuucucccuggcucacccuggagaggcuucccgaacagggcucaauggaaggagugagaggcagguggggccagcccugcuuuaccucguccuguccugggcagccccugcugugcauacagccaggugacggcugcuggggguucaugcagcaccauuugcucugcucugcucacuucucacccugucuuggaggcucgaugaggccgugcccagcucaguguagaugcucagcagccagugagaggagguggccggagaaggcgccuccggggcaggaggcaccucguccccacgccaggccccacacuggcccaucuacugcugcacuuggggaagggugugguucucucugaagcucacggagucuucuuucuccacagacccccccggaaccuggacucccggaccuucaucaccauuggagacagaguaggugccagccgccaccccugcagggccucucacuucaccugacgagcggguagagcugacccugcagggccacuuuggggggaggugacugaggggucagagagggucaggcucuggagaagagccucguccugcgcugcuggcuguguggcccugggccacccacucuuugacccuccuggugggaaugaggaccaucggcugccugacuggagcuuggcgagcccagagcugguaggaagguuucugagcugagagcaaggcccugcaccucauccuagcccuaggggagaguauugaacaugcaggcuccuaggccgcccuggacccgcuggaucacucccucaggccagcaccugggcaaccugcauuuuaugcuuccagaagccucggaagggcacuagccauucagaauccuggcucagggaccgugcuaugccccguuccucccaacagaaacccuacucccaggccaggugcaguggcucacaccuguaauccccacacuuugggaggccguggcaggaggaucacuugagccucggagcucgggaccaggccugggcaacauggcgaaacccugucuguacaaaaauacagaaaauuagucagcgugguggugcgugccuguggccccagcuacuugagaguaugagguaggaggauugcuugaacccaggagguggauguugcagugagccaugaucguaccacugcccuccagcuugggugacggagugagaccccguuucaaaaaaaaaaaaaaaaaagagcugggcacgguggcucacgccuguaagcccagcacuuugggaggcugaggcggguagaucaccugaggucaggaguucaagaccagccuagcuaacguggugaaacccugucucuacuaaaauacaaaaauuagcccggugugguggcaggcgccuauaaucccagcuauucaggaggcugagacaggagaaucgcuugaacccaggagguggagguugcagugagccaagauuaccccauugcauuccagccugggugacgagagugacacucugucuaaaaaaaauaaaccccauucccuaggccuguccuugacgauacucccuccaggcugucgcacucccugacacucaccaucugcuguccuguucaucuacuugcuuacuccuuuuugugucccucccaagagagggaaacaucugugaaggcaauacuuuuguuuuguugucacuguguccccagugccuaaaacacauuguggaugcuugguaaacaguuucugaaugagugacucauucuagccagcugaguggggucgggaaaagagggacagggcaccucuuucucagagcuguaccugcuggcggggcauuuugucucagucacacuccauagcagccuugggguguuggcacugugccuguuuuauagagggcaucgugaggcucagagagguuaagugacuugcugagggucacacagcagggagcgguggauaugagguuugagcccagaucuaaucagcugguccucuucaugcugcccagguaucuccacugggcauggggugaggacuggcuuccagcuugcuggccacugacucucuuuuccauccuucaagaacuuugagguggaggcugaugacuuggugaccaucucagaacugggccguggagccuauggggugguagagaaggugcggcacgcccagagcggcaccaucauggccgugaaggugagcagggccuggaggcagcugggagggcucccuggaggaggcgggcugagcucugccauggggcccugccuaucccucucagugaucaguaccgaggcuaggcuuuuuggggcacacugggcaguggcccccugagcuccuggcccuccugucaugaguguggguguuggccucugccacggcaaccucugaauggcaguccuucccugcagcggauccgggccaccgugaacucacaggagcagaagcggcugcucauggaccuggacaucaacaugcgcacggucgacuguuucuacacugucaccuucuacggggcacuauucagagaggugcguccuugcaugaugcagcuggggaucuccaccucccacccaucagucgccugcaacccacugucacucagucccuccaguacgccaggugcuggggacaccuggcauacuggcaggaggcucccccgucucuuggcuguuacuguccugcucagugccucaguuuccuugucagucaaaugaggccggugguugugggugccuccuaaaguugacacggaagguaaacgacauggccuggggccuggcauucagcugcacucaguucugucugugugaccauucgcauccccauggcauacagggcgugggaauggcauauggggcguggggugcccaagcaggcaacggccauggagauaugagaucuggauucuggguucuagguuuguggacaggauggggugugugcugagagagugacugaggcuggaagaguggagcugccuuccgccaagccgggugggugugggugagcagggaggccgggagccuaggcgaugcugggcucauacuggucacuugccccucaaagagcuguggcagggucagggcaucugaguccagccaucgggcaaggucagggcugcuucaccuguccucacucgucacucaugaagagcucagcauccucugugccagccccuagccgauggggccccugcagccugcgggugcccccugcgcaucucccaaccuuccugucaggaggguccucaggaguucacuggggaagagggagcagguccuugcaggcagggagccaucugccagggucagcuggcaugagggugucugucggucagcagggccggcuguugccauggagcuggugcaggugcauccugaagcucugguggagggacccagcgaggcugugugcuaauccucuuccucccuggagacaccuggaauuagggaucagauagaggaggcuggcgcccgaaccuggcagugcaggcagaguuggagggugggggaagcgggcaaguggguggugggugggagcccggugaacuguggcugagugggugggcacacgucggagagggggcuggggcuggggcuggugcuggggcaggcagugcagguggugcagacacgggcagcccggcagccuggcugagcucugggugucacccacagggagacguguggaucugcauggagcucauggacacauccuuggacaaguucuaccggaaggugcuggauaaaaacaugacaauuccagaggacauccuuggggagauugcugugucugugaguggccugggugggcuggcgggggguccuaggugcauaggcagaggcccagcccugccagcaggcauggagccugccuauugauggugucuugggcagagcugggcaucaaugugcccccugaaccugggcagcugcccugcauaggcccuucuccuccaccccagaccagagccuuugugcuuaggagaccuccgcuccuggggcuccuggagccccacagauuuggcagauccaggugucugagccauugauuccaacucuugaguuccagaucauuuuuuaaaaaaggaauuuaguauuuacaacagcgucauacuaaaaaugccccggggcagcucacagagguacaagcuaaguugggggaaagguuagcauccaaaaugugugcuuuuugagucuaaaaaguccuugagggagggcagcaacacugggcuugagcauuccaguagccaaaggaaaaaggaaaauagaaccagugagacugguucaauccucacugcaucuggaaacauuuacaauauaccccugccucaggcuccccacccagccuucccaagggaaauggcuccaagcugcuagaauacuggcucugccacgggaggggagaugggacagggaggcugccaagagcuggguuuuacccaagaagaguguggcaggcagugaugaugccucccugggaggugagcccgggaggaugagaggaggcaggaggccgagugugucugcaccaggauuguuaggaugcuggggcaaaugccaggacagggcaggaggcugggaugagagggugcguagccugugcagcgggagcgggagacagguggacauggauggggucuuacugcucugucguuuuugacgugaccaggaauaacagaguccugucucuucccuccuccccaccccaccgccagaucgugcgggcccuggagcaucugcacagcaagcugucggugauccacagaggucagugcccggcagccacccaggcacgguguagccagugggagggaucccaggccaaggcggguggacgucucccuaugagcaacuguggcuccgagaggugauagguugugacgugcccgaugggguuccagccgcuuuccaccugcagcccugcagcugccuccccucagguuugcuggugcucgaagcaaggacuggcuugacuucuguccugagaaagguggacuggguucuguucugauguauaguuuacaaaucgugaaacuccagcauagagugcauauaaucauguucacacccaugcaaccaccucccuccaagaugcaggacaauucucucacccccucccagaauguucucuugggcuccuucccugccaucccccaugugccuaaggcacccacaagucugguuuucccacaguggguugguuucgcccuuucuggaacaucagccucgcuugauguuucuggacccaccugggucugguguggucucaguuuguuccuuuuugcugcugagcacaagucuauuuuuccagauuuacugcuuuucaaaaaaugaauuaggcuuaguucccauuguccacugggugcccaucccagccccccaggucacugugguuggcgguuggcacggaaccuucugguccuuuuuaugugcauuuccaucuuuacacacauccccauggagggcacggggaugugaguguccuaugcgcauuuguauggagaaucccugcugggcugcucucccaugcuggucuguggggacuccauguccaaacacgcagauccugccucccaggcuuuaauugauccugcugcccucugggagcacccacacaagccaggcucucacuggaccucaugucuggagggcggaugcaggcacggugcucccagcaaagcaccuggaguccugccuuccuugcaguggccgggccgggcugggcacguccuggcuguucccugaggaccaaguaugacucucagcuggcccggcaccucuugcagccucaguucccuggucugacccuugggacccuggugcaaccugcccacuggggcaugggagggggcacaggaggggucuugggcgagggaggggggcacagcuaugcagagcauggcaccugccuccagucgugcuccacagacguggcugaggcaugucccucccuggcagaugugaagcccuccaauguccuuaucaacaaggagggccaugugaagaugugugacuuuggcaucaguggcuacuugguggacucuguggccaagacgauggaugccggcugcaagcccuacauggccgugagugguccccaagccccccaggcucaggagaggauggggcggggagaaaucugcccaggcuggccaccccggccauacccucuguccguaggggcagagccuccccacacugcguuuccugcuguaguggggccaccugugucuugcugcccaggggcagcccuucuguaccccguuguuaacugacccccacagugccccaguugggugauaagcucauggaccaccucugcggaggacacuggugggcugugcaggucccgccccgcccucauugucaggagggccuuaggggccugcucccggguagggucagaccgaugcaaggguugggccuucuaagcaugacccaggcccuccuagccucaguuuccucccccgucacaugggcaggugggcuaagcugagcgcucaguuuggggauugggaggcaaggccuagccaugggggcuuaccuggggcggguguucacgccucacucuucccuccugcagccugagaggaucaacccagagcugaaccagaagggcuacaaugucaaguccgacgucuggagccugggcaucaccaugguacuguggggggccagggccugcccuugguggucaggugggguggguggagccgugccuggggcccugagcuuuugggggacucaucaaauaguuuagguucuggaaagaaguauuggcuucaaaaucugagaagaaaaugugccaucagaaauuaccaucuauuuaagggaaccuccuagggucagggucacucaucgugaaguccugggugcuuugugauaugguggccacagggcuuucucuggaguucuuggugcuuguugagaaaucacagccaaucccaaauuacguaaguuccugguauguaaaucaugcaaaagcaagaugguaaagaucuuuucaaaaauauuucauagcagaagguuuguugucgguggcguccugguacauugcgguggggugguagaaagggugggcgggcucucaauccugggccuguggaagccaaaggcaucccuggcuuggguagggugagggcagauguggcagaaguccgaaguccagguguagggaugggcccagagcaguugcuucuggaguugccuggcagaaccccaugccuuccguguuggggcucaggucaaggugugggugagcccgcucuggcuccccuguggacaguggauuggagggaugggaagaccaccaggaugugucccccagccagggcuaggaagcugugcaggagacgcguggaaggacgaugccaucagcaggucgggcucaggcugguggccuuggccaguugaguggcuugggaccaauggaguguccugggcgucagcuccuucccugcccagggaagccuggcccaggacauuccugcuugucccuagucccuuugacuguuugguguuggggaugaggccgucagauagaaucaguaagauguggugagaagcgcuggcgggguguuuuccaacaccgcaacccauucucggauucuccagacacccacccagugcccugcaguuccguucgguucugaugcuaccuggaguucgcacagaccccacagguuaagggcucugucccaccagacugcccccaacaucacacaccaguuggaaguagcgggucucccauacuacuggacugaccagcuacaaauuggggguccccaugacccucucguaagguuugauaauuuccuagaauggcucacaaaacucagggaaacacuuuauuuguguuuacugguuuaucagaaaggauauaacucagggccaaccagauggaagagacucacgggggaggggugugaguguggggugcagagcugccgugcccucucagggccuggcacccuccugguaccucccugugcuugcgaaccuacaggcuucucaagcucauggaauuuuguuguuuuugacacagagucucacuuugucacccaggcuggaaugcaguggcacaaucuuagcucaccguaaccucugccuccuggguucaagcgauucuugugccucagccucccgaguagcugggauuacaggcaccaccaugcccagcugauuuuuguauuuuuaguggagaugggguuuugccauguuggcgaggcuggucuugaacuccugaccucaagugaucugcccgccucagacucgcaaagugcugugauuacaggcaugagccaccacgcccagccucacauggagagguuuuuugugagagagggucucacucuguugcucaggcuggagugcagugguaucaucgcagcucacugcagccuugaacucccaggcucaagccaucccccuaccucagucuccugaguagcuggaacuacaggugugugccccuaugcccagcuacuuuuuuaauguuuuguagaaaaggggucucacuauguugcccaggcuggucuugaaauccugggcucaagcaaucugccuaccucggccucccaaagugcugggauuauaggcacaagcuacugcacccacugaaaguuuuuauagagcacagucuccaggccccccuccucucagcaucaguuggcgggugaugcugagaguucccacccucuauaaucagcuggguuuucuggggagcagccccaucugaggcugucuaggggccuuacccugagucaccucauuagcauaaacucaggcuccuuguggauaacaaagccacuccugucacucaggaaauuccaaggguuuuaggagcuccaugccaggaacaaagaccaaauaaauuccuuuuuaugccacggggguggagaagacuggagcagguagggguggcucuggggacagguggaaggccacuguugcagaugcggaggccucugcaaggagggcacccugcugaccugagggcaggguagaccagggggugcaagugcaaaggcccugagguggggcugugccugcugugugccuggguggcugggucagaggagagggagggaggguugggagcgagcgaagagaagugucugguggguagagaguugacgcagguguuguggguuuuacugguguugcugcuaccauuguuaucaucaucaugugguuauaacuuuauuuauuuuuaauuuuuauuuuuuugagauggagucucacucuguugcccaggcuggagugcaaugggacgaucucggcuuacugcaaccuccgccuccuagguucaagugauucuccugucucagccuccugaguaacugggauuacaggcucgugccaccaugcccggcuaucuuuuuuuuuuuuuuuuuuuuuuuuuuuugagacggaguugcacucuguugccuagccuggagugcaauggcaugaucucagcucacugcaaccucugccucucgcguucaggcaauucuccugucucaaccuccccaguagcugggauuauaggcgugagccaccacaccuggcaaauuuuuguauuuuuaaaaaagacgggguuucaccauguuggccaggcuggucucaaacuccugaccucaggugaucugccugccucugccucccaaagugcuaggauuacaggggugagccacugugccuggccuuuuuuuuuuuugagggagucucacucugucgaccaggcuagaaugcaauggcacaaucucaguucacugcaaccuccgccucccagguucaagcaauucucuugccucagccucucaaguagcuaggauuacaggcauuugccaccaugcccggcuaauuuuuguauuuuuaguagagacgggguuuugccauguuggccaggcuggucucaaacuccugaccucaggugauccaccugccucagccucccaaaguguugggauuacaggcgugaaccaccacgcccagccuugagccacugcgccuggccuguggcuguaacuuuauaaauaguguaucuguagacagugacugggaaagacucaaagucgaaauaauuuugucagagaggugggacugggccauaccuucaauuuucuuuaauuggugacauguaauuuuucaauuaaaauuuuuuuuuuuugagguggagaggaauauucaggcugaaggcaggugcuguaucugcaauaacaguuuuccaaguccuaaguuugaugcaaaggacaaguucuugcuguauuuagacugcacagaacugguuggauauuagagacccugcucaugacuaccucacacauacacacacccuaugucccuuccccaucucccugucucccuuccaguuguccauccaucaugauuguuggggccaccauggcuaguggccuucugauauggcugguggaacuuggacaagugugugcuaaguguauauuucaguuaucaaauauugcauagcaaaccacccuagaaccuagugacccaaaccaacagcgguuucuuauuucucauguuuccaccacuguggcugggcucagcuggauggcucuucugcuguaccugggauuggcuggggucauggcugggcugggcuggucuggaaggcccaagacggccucacaaacaugggccuccucugccuggccucuccaugcaacuuacucacauuggccugcucccugggcuucagagcauggcagugucagcagaguuggaguucuuucaugauggcuggcaucuaaaaggaaguucucugaagugcuaggccuggaacuggcacagcaucacuucugccucauuguguuggucagcgagucacaggccagcccagguucaagggcagggaaugcucccggcuuaauggaggaucagcaggugcacacagcgggaggcggagguggucacuuuaggcacagguuagguuuuucuuucacaaguuacaaacguaguggaaaccuaacauaaaaauagaggcacaguaaggggaaaaugacuguaguuauucuaccuagagacaccucuuaccccguuucagugccaacauugugcauuauauuauauauauaauauuuuuauuacauauaauaaaauacguuuuauuaaaauuuagagaaauacaaacaauauguaaugcuucucuuuuuuuguuguugaaacagagccucgcucugucacccaugcuggagcgcgguggugcgaucucggcuuacugcaaccuccgccucccagguucaagugauucuccugccucaggcucccgaguagcugggacuacaggcgugcgccaccaugccuggcuaauuuuuguauuuuuaguagagaugggguuucaccauauuggcuaggcaggucucaaacucgugauccacccaccuuggccuuccaaagugcugggauuacaggugugagccacugcgccuggccucguaaugcuucuuuuuaaaaaacuuuuuaaaaaaaauuuuguagcauuacauguuguucauauuugucucucucucucuguuuuuuuuguuuuuuguuuuuuuuguuguuuuuuuuuuuagauguaguuuugcucuuggugcccaggcugcagugcaguggugcaaucucggcucaccacaaccucugccuccuagguucaagugauucuccugccucacucaaucucccaaguagcugggauuacaggugugcaccaccacauccagcuaauuuuguguuuuuaguagagaugggguuucuccauguuggucagacuggucucgaacccccgaccucaagugaucugccugccucggccucccaaagugcuuggauuauaggugugagccaccgcaccuggccaauuucucuaaauuauaauagacuccuguauguaucccuuccaaagacuccauaaccaucugccaccauucagucacccugucugcugauguggguuguuucccuuguuccugcuguuuuccuuccauuucaaauucucagccauccugggggagcgacugaugaaacagagucgggagagucccccuggguggggcucuggccucggccuccccccauccugcaagggccccagagcucucuuggcguuggcuuuuucccacucacugcacaagccucaggaugccagugggaaucacccagaacagacaggggucaugccggggauggcccuuggccaggagcaagugcugacugggugcuggccuguuaguguugucgcuggggagucacaggggugcgacuacgguccuggcugggucuccgcccccaugguggggccggccccuggcgcuggacauucaggcuguuucuuaguauuuccuggcagaaaacaccauauggcacaucuucgugucuggaggcuauuuuuguuguuuuucauuuuuugagcucuuuagaaaaaauaaaggaguacgagguugaagguuuggacacuucugcuuuucuaauuauaacucucauggccgcugguccuucuccuguagcucguaugggguacuugcucuacauauugcagucagugaaaauucuaagagaaaagccccccaaaucgguacgguuuuguccugugaacacgcaugcacacaugcacacacacgcagugggcccugccuguguggguguguuugucugagcuggaaagggccucuagccugaugggaggcacagucucagcacaguccuuagggucuuguccgggcuccaguugccagugccaaguguuugugcugaggucucuuccguucaucauggugaugacggccggcagugagggcccuugugcuggagccucggaauucucuguucuuccaggccggggccagggcugacauaacuuguuuuuuccauccagucaucaugauuggagcccagaguugguuguaagcuagcuaguccgucccuuccaugaugacuuccugccaaccacagggcugggagcuuggagcgaggacagagacccaccggcccgaugucacccacaggaaaucuggauccagcagggcacauguggccacacaggccacuugucuaggagggaaacugcuggggcccugcagaagaugaggcugcaggcucacgggugcagaggcgaagcagccucauggucucacacucuguccgcggccuuggagacagcuguguguguguguguguguguguguguguguguguguguguguguagcauuucccaugugccuccucugugaaaacagcccaaauuaaugacagcagaugcugaagucugagauggucagauguuaggaaggggauuggcugugaccaccugggaccugcccaccuggcucaugaggcuacggcccaaaguugccagcuccucagauuuuuccagagcagcuggaaccugcauuguuuuguaaaaucuucagaauucagguuuucugaaaacccuaugauggucccaccagucccggugugggcugaaucugcuuccugagcuggguccugcuggcugggucggaggagcuaagagcuggcauccccggcuuucucgccuuuguucugcugggaugugguagggagaucagcugugcagcuuugacgccuggcucugguaccaggaugggugggagcccccaacccucgcuccugggugcagagcgugguuguaucuggggccggggccucugacccccuguccccgcugcagauugagauggccauccugcgguucccuuacgaguccugggggaccccguuccagcagcugaagcaggugguggaggagccguccccccagcucccagccgaccguuucucccccgaguuuguggacuucacugcucaguggugagucuugggugcugcugagcgccugccacugccccucccuggccagaucccugcaccuuccugggcccuguuccuuuauuccuuuggcaaauaaacccccagaugacuuggcauccaaauauguaaggcagaaacagcuggagcaugaggagcauuugacaaaacgauggucuuggugggagauuuuaauacaguucuuccagaaguggacaaaucagauagacugaaaaagagaacaaaguauauggaaaauuugaacacaaaaaacaaguuugcuuuuauugauaucuagaacuuuguaccaaauuaaagaaugccccauaggagccuuauaaaaaucauguuugagaggcugggcacgguggcucacgccuguaaucccagcacuuugggaggccgaggcaggcggaucccgaggucaggaguuugagaccagccugaccaacauggugaaaccccgacucuacuaaaaauaggaaaauuagccgggcgugguggcgcaugccuauaaucccagcuacucaggaggcugaagcaggagagucgcuugaacccgggagccggagguugcagugagccugagccgagaucaugccacugcacuccagcaugggugacagagugagacugucucaaaaaaaaaaaaaaaucauguuugagguuacagaaggaauaaggaagagggcaacuucucugaacuuaauuaaauagagcaagaauuggguaaggaagaagcggccgggugcgguggcucacacccaugguccccgcacuuuuauuguugaccauaaucagcaacagaggagcccagcagagucccugggcagucugaccccuuuaauuguggacuaacuucucccagaacccaugauaaggaguuucucuccugauugaggauaccaagugugugacuguuaggcagagcauugcagccccauuuugguguugauauggaaauuccuaggucacuaugcagacaagaaaaccaggaccccaggagccagagaaacuugcugcaagucucuaguuugcuccuaugaaugccccuccacccuggaagaagcccuagacaguccugucccuucuucccugggugcacguguccccugcugcuaggccuggggcaauccuggggugguuuggcuggcccuugggggcugggcuuccucccugccagccuggccacagcugcacuauucucuccuagccugaggaagaaccccgcagagcguaugagcuaccuggagcugauggugaguaugggcgggaggugccugcccugcucuucagggcuggcuggggcuggguggggcucuggggagagggcugcauccugcacacagauggguagcuccucuggcuggcccuguguucucuccuuuaggugcucggucauuuguuugcuccugcauaccuggcucccuccucccuccuuccugcaugccaggcccugggaaggguacacaggcagugugugacagaauggggcagaggggccaaggguggcaucagggaaggcuucauggaggagguaccauuugaacugagccuggaaggaugaauaaggguuaucuccugauggagaggcugucccaagcagaagguccagcaugggcagaggccugacguguggggggaaagggagguuaguguggcuggagagugaccacaagagagcugaggaggagccacagaugccaucugugacagucauggagggccuccuggggguggagguccuagaaggaugaguaggauuuugccagucaggagaacacuugggcuggagcugguuggggaagaguggccaccucucccucccgcuaccccuccauggugacugugccuucugucacccccaggagcaccccuucuucaccuugcacaaaaccaagaagacggacauugcugccuucgugaaggagauccugggagaagacucauaggggcugggccucggaccccacuccggcccuccagagccccacagccccaucugcgggggcagugcucacccacaccauaagcuacugccauccuggcccagggcaucugggaggaaccgagggggcugcucccaccuggcucuguggcgagccauuugucccaagugccaaagaagcagaccauuggggcucccagccaggcccuugucggccccaccagugccucucccugcugcuccuaggacccgucuccagcugcugagauccuggacugagggggccuggaugcccccuguggaugcugcugccccugcacagcaggcugccagugccuggguggaugggccaccgccuugcccagccuggaugccauccaaguuguauauuuuuuuaaucucucgacugaauggacuuugcacacuuuggcccaggguggccacaccucuaucccggcuuuggugcgggguacacaagaggggaugaguugugugaauaccccaagacucccaugagggagaugccaugagccgcccaaggccuuccccuggcacuggcaaacagggccucugcggagcacacuggcucacccaguccugcccgccaccguuaucggugucauucaccuuucguguuuuuuuuaauuuauccucuguugauuuuuucuuuugcuuuauggguuuggcuuguuuuucuugcaugguuuggagcugaucgcuucucccccacccccuaggguaccagcaggcagagccuugcccucugcucaggcugggguccagugggaggggcccaagaucucugcucagagaagugcagggggagccuuccagcucacucucccugaggacuggcuugacaggggcuauggguuugcuuugguguuguuuuuaaaaaaagaaaauauauuuuuuugaaaaaacgacugcccaucccggguccuuucccugauggguuggggcaguuaccugguugcuguuuuaauuaaaaaaaaaaaaaaaaaaaggacuaaagguugugug

SEQ ID NO: 21273 - RNA, 32738 nt, Homo sapiens
acuggaacccgggggaagauggcggcagccguucugagugggcccucugcgggcuccgcggcugggguuccuggcgggaccgggggucucucggcagugagcucgggcccgcggcuccgccugcugcugcuggagaguguuucugguuugcugcaaccucgaacggggucugccguugcuccggugcaucccccaaaccgcucggccccacauuugcccgggcucaugugccuauugcggcugcaugggucggugggcggggcccaggugaguccguggcccgcgugcccgcggcccuguggggaggauggcgcggcaccugugcgccgggauuacggugcagugcaagugcgauagggagguugaaggaaggagagcugcgggcagaaaggggauccagguaucaguccggacgggaugcacguauuucuccuuuaucggccaugaguuucuccaggggaaaaaugggccuuauuuuucuguuguuaggcuauuggucggcacacaggaaucgauuagguuccaggcccggucacucacuaguuguauaaucuaaaagucucuuuuuccucuggcaauaucuguuucggggauuguuucgacugacugaaugacgcauucaacaauaaacauuuaccgagcucuuauugagggucagauacuguacuaggcgcuccgguuacagacgugguggcgauacacaaaaugcugcgaaacaagaugagaauugaauaucaggggucucuaaccuuaucugaagacuggcagagauuuuuccaaagaaaccggcguuuaagcugagacccuaaggaugaauagggguuggguagggaaaaaauaugggaggggcuguucagucagaggagagcucaugugggaagacccugugguaggaaggaacuggaaagaagggcaucguuccuggggcucagauguggaggggaagagaguggguacagaugagacuggugagauggguaggcaguggucgggucaugcagagcguuuuaggccggguuaggagccuuuggacuucuauaagaauggaaucugauaaccauucaguucugcaagcuagacacucaaguaauucuaaacucuucuucauacaccuccauaagcaaucugucaaguccuguugauuuuauccuuugaguaguuuucagaucuguccacucuuuuccaucuuucucauugcucccauucuagcuugaacccccaccaucuuguccgggugaaggcacugauucuaagaaggcauauuucuagcccauaauagcugcuccuuauaacaaucuccuaucuucccuucucucccacuaaaccucccccaaauucuacccauccuucaagacccauaaacacgagaucuucuguguccacccuucauuccugggaccuuccuagcucuaugcuaccuuccaggaagaugguugucacaauuugcugggugggucaauaaccuuagccccagauuuaucacagauaacccuaucuguuugucuuuaacauuacucugcauaauugagggugacaaaacuauaucucugcuaucucagcccaauaucagaggcuggagcugauuauguauuuucucuugucucuaaauuccccucuucuaauuuaugugguuuucaucagucaguuauauuacagugggguuuuucuguuuucuuuaucucacaauagucccagaauuauuauuauuuuugagacaaggucuuacucugucacccagguuggagugcaguggcaugaucuuggcucacugcaaccuccauuucccagccucaagggauccucccaccucagccuccagaguagcugggaccacaggcaugcgccaccaugcccggcuaauuuuuguauuuuugguagagacgggguuuugccauguugcccaggcuggucucaaagucccgaguucaggcgauucacuugccuuggcuucccaaagugcuggaauuacaggcacgggccaccaugccuugccccccagaaauuuuuuuuauaaguauuugugaaauauuaccuaucccgccuauaaaugugugauuucuuucaucaucucuuucaggacuuccucuccucccucaaagucaacuacaugaacuuaacgucuugcuuauuuuucuuacaugucugaagucuaguagaauuuugaguaaagaagcuaagagugaugugggaaacuagggccgcccuuuaauauuuccugugcuacuuguuuagauacauccugccuugaauuuuuuuucuacuuguguccuuugaauugggauuauguggaggauuuccuuuccuuccccaaagguuucauucaacaaacauuuauugaguaucuguuauguuuuacguacuguuccucgucucuagguagauaaauaagacaugguccuuucccucagagaauuucuagucuaguuaagaugagaaaugaaagucagcaauagaccuggagcuugcgagcaagggggauccacuguuugaucauccaccuaccaacauggcuuuuccgcagguacugcaagcucaguaguuccaaaauggaaugauccuagcacagugcuccauaucuagcuuggaguauauuauagcaacaaucuucuaacgggucuccuuaccuucagucuugcccucuguaauccguuccccacacaguagcuggagugagcuuucuaaaguaaaauucugauccuguuugcagcuuuuaaaaauccuucagccucuggguguucuuuccucagaggcuuuguacuuacucuucucuuggaaucccucccugugcagugcccccacccccccaacucucauccuccuucccagucuucucaauucuuugcuuauuugucacugccuuugggauauauuucuuggccaccuaugauugacugcucuuuauccuacugucuguuuauuuauuucacauauacuuauaaccucucuccccuacauucagcaagucuuugauuuguucuuguauguaauuaauaaaacuuauauaaaauuucagacauaaauaguauuuuccccaccccacccuaugcugcccccaucacucaaauuuaacagugaacguuugccaauguuauuucauuccucccauagcuuggcuuuuuuuuuuuuuuuuuuuuuuuaguggaacuuugcuuuuucuuucuuucucuuuuucuuuucuuuucuuuucuuuuuuuuuuuuuugagauagggccuuacucuaacucaggcuggagugcaguggccagauuauggcucacugcggccuuggccucaaccucccagguucaaguaauccuuccaccucagccucccgaguagcugggacuacaggugugccaccaccccuggcuaauuuaaaaauuuuuuuuguagacaugggggcuuuauauguuguccaggcuggucuugaacuccugaacucaagugauacucccgccuuggccccccaaaauccugggauuacagaggugaaccaccgugcucagcuugguggaccauuuuaaagcaaaucccaaaugucauuuauccuguauauucuuuugaaggacaaaaacagugucuuguucugucuucuacguaggccucagccuccugaguagcugggauuacaggcaccugccaccauacccagcuaauuuuguauuuuuaguagagacggaguuucaccauguuggucaggcuggucucgaacuucugaccucaaguuauccuccccacucgaccucccaaagugcugagaauacaggcaugagccaccacauccggccacuuuuugucguauuuuagaguguacuccuacuuaaauaaaaaaaucuuccugccucagccucccaaaauguugggauuacagggaugagccacugcaccuggccucucuuuuuguuggaucauuuucaucagcauacaggcucaaaacuucauccucggccaggcgugauggcucacgccuguaaucccagcacuuugggaggccaagguggguggaucacaaggucaggaguuuaagaccagccuggccaagauggugaccccgucuguauuaaaaauacaaaaauuagccaggcgcaguggcaggcaucuguaauccuguaaucccagccauucaggaggcugaggcaggagaaucgcuugaacucggggcagagguugcagugagccgagaucgcgccucugcacucuagccugggugauagagugaaacucugucucaaaaaaaaaaaaaaaaaaaaaaaucacccucuagggcugggugcagugacucacaucuguaaucccagcacuuugggaggcugagauggguagaucauuugaugccaggaguucgagaccagccugaccaacauggcgaaaccucaucuuuacuaaaaaugcaaaaauuagcugggcguggugacgcaugccuguaaucccagcuaaucaggagacugaggcaggagaauugcuugagccugggaggcagacauugcagugagccgagauugcgccugcgaacucuggccugggcaacagagggagacuuugucucaaaaaacaaacaaaucacccucuagcuacugccucauuugccauuuguguacuuccuuuuauggcaaaaacuccuugaaaguguuaucuguacuuuuugucucuccuucuucuucuuuuagcguuacuuugaaauaacugaaaauuuacagaaaaguuggaacaauauuugaaagaauuucaauauauacccuucuccuagauucuccauuuuuuuuuucuuuuugagauggagucuugcuuuguugcccaggcuggagugcaguggugcgauuuuggcucacugcaagcucugccucccggguucacgucauucuccugucucagccucccaaaguagcugggacuacaguugcccaccaccaugcccggcuauuuuuuuguauuuuuaguggagacgggguuucaccguguuagccaggacggucucaaucuccugaccucgugauccgcccgccucggcacucgaagugcugggauuacaggccugagccaccgcaccuggcuggauucuucaguuuuuaaaugcauauuuauguuauucugauaaugacagaucuccuaaacuaucauucugagaauaacauaaaugcacauuugaaaacuggagaauucugggugaagaggauacaggaauucuuucagauauuuuuucuggguccauuuaggaguaaguugcagauauguccuuuuacuuugacauauuuuaguguguauuuccuuaaaaacaaggacauucucuuacauaaucauacucuaucaucaugaucagagaauuaauauugguacaauaaauuauuuaaccuacagaucuuuuuuaaguuuugccaucaguucuccuaaaggcauccauuauaacaacaacaacaacaacaacauuucuaguccaggauuuaaugcaggaucacauguugcauuuaguuguuuuuuuuguuguuguuuguuuugccuuguuuuuuuuuuuuugagacaaucucagucuguugccuaggcuggagugccguggcaugaucuuggcucacuggaaccuccgcccccuggguuuaagcgauucuccugccucagccucccaaguagcugggauuacaagcgccugcuaccaugccuggcuaauuuuuuuucuuuuuuuuuuuuuaguagcgaugggguuucgccauguuggccaggcuggucucgaacuccugaccucagaucauccacccgcguuguccucccgaagugcuggcgugagccaccgcgcccagcuugcuuuuaguuauaaugucucuuuaguauucuuuaaucugaaauaguucuucagccuuugucuuaugaucuugauauuuuuaaagaguacagaauaguuauuucguaggaugccccucagguuaggaucuaaucaugaggaaacagcagacaaauuaaacuggagauuugugcguuuucagcaagaauacugcagaagucguccaggugcaguggcucaugccuguuaucccagcaugagauucagaggcuuagugggaggccgaagugggaggaucacugagugcaggaguucaagacuagcuugggcaacauggcaagacccuaucucuacaaaaaaaaaaaaaaaaaaccuugcagaaaugaugugucauucuuggugcaucacaucaggagcacguauucuagguuaagcaggucucugccagauuucuucacuguuauaaagguaugauuuuuuuuuuuuccauuuguaguuaagugucuuggggggagauaaugugaaugucuuaggucuugucaaccuuucacccacucauuuuaacaucuauuaaagguucuucccugaaugaauuauuacuaugaugguuguuccguugaacucauuacauucaggcuuuuagccuaaaugcugccgaaacaacccuuugcugggugaaaugguaacucuugaagaucacugguguccaucaagacauuaaguucaaaggucaauuugggucaucauauuugacuuaucgcuaccauuugauacaguuaauuauacuuuccuauuuaaaaaacugucuucacuugacuucugggauaucucuccccugucuuuuuguuuuuguuuguuuguuucauugagacagggucucgcuguguugcccaggcuggagugcaguggcgcgaucauagcuuacugcauccuugaucuuccaggcugaggcaguccgcccugcucagccuucuggguagcugggaccacaggugugugcccccacacccagcuaaucuguuugauuuuuaguagaaacaaggucucgcuauguugcugaggcuggucuugaacucuugagcucaagcagucuucccacuuuagccuccuaaaguacugggauuauaggcguuagucacccucccagccccucuccucuccucucgauucuccuguuaucacacugguuacuccuuuccaguaaagacugaucccuccucaccucugugaccucugaagguuugagugccuacaacccaggccuugcacuguuucucuucucuuuacucuuauucccuuggugaacugauccagucucaaggcccacaccucuugaguuuacaucuccagccagaaguucucuucacacuugucuagccggugccuauuuggcaucuccguuuucauguuaaauacacaucacagauugaacagaucugaaacugagcucccuauugucaccccaaaaccugcuccuccugcauuaguucccuucucggugaauggcagcuucaucuuucuaguuguucagcaaaaaaccuuggcauuaucuuggacccuucuuuuuauuuuccacccauauccaguuugacggcacaucccguuggcucuaccuucacaguacuuccugauuuugacugcuuuguaucgccacaguuaccacauucuucaagcugcaucaucauuugucuggaauauuacaguaaccuucuaccucaucuguuugcuucugccuucucaacaagacaacacaaaugcuguugauuaaaaacaaagcaaaacaaaaagcaaaccagaagucagauauugucacuccugugcgcaauuucucucucccccucguggcuuuuaucuuacucagggugaaagucgguaaucaccuauaugucucugcacagucuggucccacucccuuaaccuucaucauugguuacuccucuccaccuugcucacuuuucuccaucaacaauuugucuccuuguuguucuuuggaaauaacgaaguaugcucucaucucauagucuucgcucuuuuuauuuuucuuuuuugagacaggauguugcuuugcuguucaggcuggaguguagugguggcgaucauggcucacugcagucuugaccucccggggucaagcagcccucccaccuuagccucccaaguagcugugaccacaggugcccuccaccauguucggcuaauuuuuaaaaauucuuuguggagaaugggggucucccucgguugcacaggcugaucuugaccuccugggcucaagccauccuccugccuuggccucccaguguugggauuacagucaugagccccuugcccagccuguuuuuuuuuuuuuucuuuuccuggaacacucuuuuuuuuaugguuaucaguaugccuuuuuauaaaaacagcuuuacugcggggguucauggugguucacuccuguaaucccagcacuuucggaggccaaggugggcggaucaccugaggucaggaguuggagaccagccugaccaauauggugaaaccacaccaccacgucuggcuaauuuuuguauuuuuaguagauuuuuagauguuuaguuucgccacguuggcaaggcuguucucaaacuccuaaccucaaaugaucugcccaccuuggccuccccaagugcugggauuacaggcgugaaucacugcccccugccagauuuuuuuuuuuuuuuuuuuuuuuuuuaagagagagggucucacucuuuugcccaggcuggaguauaguaguguguucauagcucacugcagccuugaacgccuggauucaagcgauccuucugccucagccucccgaguagcugggacugcaggugcaugccauugcaccuggcuaauuuuuaaaaauuuuuguagagauggugucucucuguguugcccaggcugguauggaacuccuggccucaagugauucgccugccuugguuucccagaauuuugggauuauaggccaccgugccuggccaaaacagcuuuauugagaaauaauucacaaaccauacaauuuagccauuuuauuuauuuauuuuuuccagacggagucucacucuguugccgaggcuggagugcaguggcgugaucucggcucacugcgaccucugccucccggguucaagcgauucuccugccucagccucccuaguaguugggauuacgggcgcccgccaccauguccggcuaauuuuuguauuuuucaguagagacggguuuucaucauguuggccaggcuggucucaaacuccugaccucgugauccacccgcuucggcugcccaaagugcuggaauuacaggcaugagccacggugccuggccuuuuauuuuuuucgaaauggagucucacauugucacccaggcuggaguacaguggugcaaucuuggcaaacugcaauuucugcauccuggguucaagcgauucucccggguucaagcgauucucccggguucaagcgauucucucagguucaagcgauucuccuuccuuagccucccgaguagcugggauuacaggcgcccaccaccacgccuggcuaauuuuuguauuuuuaguagagccgggguuucaccauguuggccaggcuggucuugaacuccugaccucaugauccaccugccucggccccccaaagugcuggcauuacaggcguaagccaccgcgcccggcccauuuuauuuuuauuuuauuuuauuuuuuuugagguggagucucauucugucacccaggcuggagugcagugucacgaucuuggcucauugcgaccuccgccucccguucucaagcgguucuccugccucagccuuuggaguagcugggauuacaggcgccugccaccacgccuggcugauuuuuuuuuuuuuguauuuuugguagagauggcguuucaccauguuggccaggcuggucucaaaccccugaccucagguggucugcccaccuuggccucccaaaguacugggauuauaggcaugagccacugcgcccggccacaguucacucacuuagaguauacaauuccguggauuuaguauauuugcagaguugugcggucauugcugugcucaguuuuggaacauuuucaucacuccauaaagaaauucuguacccacuuacagucauucccauugcccaccaagcccucccuggcugccuccagcuuuaggcaaacaguaaucuacuuuuuuucuuuagagauuugccuauucuggccauuugauagaaaugaauuguauaauauguagccuuuggguuuggcuucuuucacuuagcagucaguuuucaagguucauccaugugucaagacuuuauuacucuuuucuguuuugcuguguugggucuuguguugccuaggcuggauucaaacucucaggauuagucaagugauucuuaugccucagccucccaaguagcugggacuacaggcgggugccauugugcccggcuaaaacuucauuccuauuuauggccuuuuaugcaauaguccccucuuaucugugcuuucccuuuccaugguuuuacuuaccuguggucaaccguggucugaaaauauuagguggaaaauuccagaaauaaguaauucauaaguuuuaaauuacgugccauucugagcagcgugauggacucucgaggaguucugcuucauccuaccugggacgugaaucggacaugaaucauccuuuuguccaguguauccauguugcacaugcucccugccugagggucaucuuguaaccaucucggugaucagauccacuguggcgguauugcagugcucguguucaagucaccuuuauuuuacuucauaauggcccaaagcguaagaguagagaugcuggcauauuauuauaguugcuguacuguauuauuagugguuguuaaucucuuacugugccuaacugauaaaaucuuucauaggcuuguauguauaggaaaaaaacaguuuauguaggguuugguaguauccgaaguuucugagguuucaggcaccugccugggguuuuggaagcacccccugcagauaagggggcgcugcugcacuauauuugaucuguucaccaguggguggacguuuggguuguuuucccauuuugguuauuaugaaugaugcugcugugaacguccauguacaaguuguugugaggauguagguuuucauuucucuuggguauauacguaggguggaauggcugggucauguguucacucuauguauaacuuuuugaggaacugccagauugcuuuccagaguggcugcgccauuuuauauuugugguaaauauuugagaguaucaauacaucuuguucucacuuuccuuuaggucucugcuaaauggcuuuuucuuuuuuugagauggaguuuugcucuuguugcccaggcuggagugcaauggugugaucucagcucacugcaaccucugccuccuggguucaagcgagucuccugccucagccucccgaguagcugggaugacaggcgcgugucaccauaacuagcuaauuuuucuauuuuuaguagagacgggguuucaccauguuggccaggcuggucucgaacuccugaccucaggugacccaccugccucggcaucccaaagugcugggauuacaggcgugagcuaccacgcccggccuaaauggccuuuuuggagaugcuuuuuguaucuacucuccuaaauaaaauccuguccccuuugccuacucugggcacuccuuuccuuccuuacucugcuuuauuuuuccuuggaguucuuagcacccucugauauacuauguauuuacuuugucaguuguuuauuuucugucuccucuuaacuagaaaauaaguaccuggcaccuaaaauaaggucucacaugaaguauauaucaaguaaauauuuucuuuuuuuuuuuuugagacagagucucgcucuguugcccaggcuggagugcaguggcaugaucucggcucacugcaaacuccgucuccuggguucacgccauucuccugccucagccucccgaguagcugggacuacaggugcccgccaccaugcccggcuaauuuuuuguauuuuuaguagagacgggguuucaccauguuagccaggauggucucgaucuccugaccucgugauccgccugcuuuggccucccaaagugcugggauuacaggcgugagccacugcgcccggccaugucaaguaaauauuuauuuaacgaauaaauauuucccuccacaaaagggagagaccuuauuaauuuuauucagcucuguauuccuucacguaaccucaugcauaguguauguguuggaagaaggaacgaugcacgccguuagggagacgcgggugccgugagaggaggcuggccauuuggggcauggagagguuaccuggggggcugaugaggaaacaucuuucgugggcuuccagaaugugagagaaggggagaacuggaaggaggauucuuguugacucggucuguguuggcauuuuuacagcuguaaggaagccaggaauagggggaggaggauuuguuugagggugaaggaaggauaauggaugaguucaguguccauucagcaagcauuuauggaugucuccuauuaggugcugcccagacauauagaggugaagcagacccaucuuugaagucugguagugggauuaguugggcuguccuguguuuggcacuacuuggguggggcauggagggaaggaucaggcaaaauauaacuugaggaaaggccgagaaacagccuuucccacaggaaaaaaggggaaaagcucaaggcuucuagugggauggccuuuuggccucagaggagaugugacuucagaaaggcuucauaggugcugggacagagaagggcuugaagaaucuucugcauuuuuaacaucccguuugugacucgcuucccuguuuucuuuccuccagaaccuuucagcucuuggggcauuggugagucucaguaaugcacgucucaguuccaucaaaacucgguaagucuuuggcccuuuuuuuucuccaggggcguguucccuuaggaagugggcauauguacaucuuugcuuucauugucaccguccccaggauucaagaccucucucuauucccaagaguguggagaguuacauuccuuuugugagcucacuugauuugaacccuaccuuuuccagcucccagauguccuauuccacccugggauuaccucugcucccuucuuucuuugcuucuuccaccucauuccaaguauuucaggaguuggaaaccacaguggaucuggggaugaagucuugcuguagccuagugagaauaaaagagcagucacuuucucugaagucuagccuccgcccacuuaacaugacucucuucuuucuuugaagguuugagggccugugucugcugucccugcugguaggggagagccccacagagcuauuccagcagcacugugugucuuggcuucggagcauucagcagguguuacaggugagguuucagcugcugcccuacuuccuccuccucccccaucuuauuccccaucuuggauguggcauguucuuuucaacuuggacauguaguucuggggacagaauaauuggaaacaauucccugauagcagagaggauaagcuucaaauagaaacuuuuuuuuugagauggagucucacuuugucacucaggcuggagggcaguggcaugaucuuggcucacugcauccucugccucuuggguucgaaugauucuccugccucagccuccugaguagcugggauuacaggccucugccaccacgccuggcuaauuuuuguauuuuuaguagagacgagguuuuaacauguuggccaggcuggucucaaaugccugacuucaagugauccgccugccucagccucccaaagugcugggauuacaggugugaggcacugugcccagccuauauauauauuuuuauuucaguaguuuuggggaacaggugguguuugguuacauggauaauuucuuuagugguaauuucugagauguuggugcacccaucacccgagcaguguacguuguacucaauauguaguuuuuuaucccucacccaucucccacauuuccgcccgaguccucagaguucauuauaucauuuuuaugccuuugcguccucauagcuuaacucccaguuguaagugagaacauacgauguuugguuuuucauucuugaguuacuucacuuagauuaauggucaccaacgccauccagguugcugcgaaugccauuauuuuguuccuuuuuauggcugaguaguauuccaugguauauauacaccacauuuucucucucucucucugucucugucucucucucgacagaguuuugcucugucgcccaggcuggagugcaguggcgcgcucucagcucacugcaaccucugccucccggguucaagcaauucucuugccucagccuccugaguagcugggauuacaagcgugcgccaccauuccuagcuaauuuuuuacauuuuaguagagaugggguuucaccauguuggcuaggcuggucucaaacuccugaccucgugauccaccugccuuggccucccaaagugcugggauuacaggcaugagccgccacuccuggcccacaccacauuuucuuuauccacuugcugguugauggguauuuaggcugguuccacauuuuugcaauugugaauugugcugcuauaaaauauugugcgcaagggucuuucucauauaauggcuucuuuuccucugguagauguccaguagugggauugcuggaucaaaugguagugauguuucauguuuguuggccauuuguauaucuucuuuugagaauugccuguucauguccuuagcucacuuuuugaugugauuauuuguuuuuuucuggcugauuuguuugaauucuuuguaaauucuggauguuaguucuuugucagaugcauaguuugugaagauuuucucccgcuuuguggguuguuuacugauuauuuguuuugcugugcagaggcuuuuuaguuaagucccaucuauuuaucuuuguuuuuguugcuuuuggauucuuggucaugaacucuuugccuaagccaaugucuagaaggguuuuucugauguuaucuucuagaauuguuaugguuucaggucuuagauuuaaguccuugauccaucuugagcugauuuuuguguaaggugagagugauccaguuucauucuucuacauguggcuugccaauuaucccagaaccauuuguugaaaaggguguccuuuccccacuuguuuuuguuugcuuuguugaagaucaguuggguguaaguauuuggcuuuauaucuggguucucccuucuguuccauuggucuaugugccuauuuuuauaucaguaucaugcuguuuugguaacuguagccuuguaguauauuuugaagucagguaaugugaugcgcccagauuuguucuuuuugcuuagccuugcuuuggcuuuaugggaucuuuuuugguuccauauaaauuuuuggauuguuuuuucgaguucugugaagaaugauggugguauuuuggugggaauugcauugaauuuguagauugcuuuuggcaguauggccauuuucacaauauugauuguaccuauccaugaacauggauguguuuccauuuguuugugucgucugugauuucuuucagcaguguuuuguaguuuuuccuuauagaggucuuucaccuccuugguuagguguauuccuaaguauuuuauuuuauuuuuugcagcuguuguaaaggugguugaguucuugauuuuauucucagcuuaguugcugaugguguuuagcagugcugcugauguguauacauugauuuuguauccugaaacuuuaccggcuucauuuauuggaucuaggagcuuucuggaugagucuuuaggguguucuagguauaugaucauaucacuggugaauaacgacaguuugacuuccccuuuaccgauuuagauguccuuuauuucuuccuuucuuccuuuuuuuuuucuuuuagauggagucucucauucuguugcccaggcuguagugcaguggcacagacuuggcucacugcacccuccgccuccuggguucaagcaauucuucugccucagccucccagguagccgggauuacaggugccugccaccccgcccggcuaauguuuguauuuuuaguagagauaggguuucgccauguuggccaggcuggucucaaacuccugaccucaggugaucugacugccucggccucccuaagugcuaagacuacaggugugagccacugugccuggccuagacgcccuuuauuucuuucucuugucugauugcucuggcuaggacuuccaguacuauguugaauagaaguggugaaagugggcauccuugucuuguuccaguucucaaggggaaugcuuucaacuuuucccuguucaguauaagguugguugugcguuuuucauacuuuguugcucuuuuaacguuuuaauuuuuuuccccuacuuuuacauccuuugauaacaucuccacuuaguuauuuaacaagcauuuucugagcacauauagcaggcaguguaccaagcucuggagagacagugagauguacauggacccugcuuucaugguacucagagucuagcgcuuuuucuaugaaguaaauguuuacaaauaggaaauguuuaugcuuugugaaccacauauaguuucuauuguauauuguuuauuuuccaauccuuuaaaauguaaaagccauucuuaguuugugggccaugcaaaaacaggcacccauagaccaucauuuacugauuccuguucuaguugaagauacuuuuuuuuuuuuuuuuuuuuuuugagauggagucuugcuguguugccuaggcuggagugcaguggcgugacugccucagccucccaaguagcugggacuacaggcucccgccaccacacuuggcuaauuuuuuguauuuuucguagagaugggguuucaccauguuagucaggaugaucucgaucuccugaccucaugaucugcccaccuuggccucccagagugcucggauuacaggugugagccaccacacccagcgaagauacuuuaauugaauaauuauauaaaugaaugugaagugauaaacugagguaggugcuguggagguaaagacuauaguucuuggaaaacauguaacaggagaaucugacuucagcuggggugguguggguguuugugaucagggccagcaguccagggagagcuuuucugaacugaucaauagaaguuaauuggguuaagaaaguguucuaaugugccaaagccaugagagaagaggagcauggccuguuugaagaauuccagcauguggcuagaauugaugagauguggcuggggagauaggaagacuggggaccaaguuguguauggccuuauagaccaugcuaaggguuuuggcuuuuauucuuggaguaguggcaacucauggaagguuuuaagcagggaugaggagguggugguggugauugaaaguaucucucugaggccaggcgugguggcucacgccuguaaucccagcaguuugggaggccgaggugggcggaucaccugaggucgggaguucgagaccagccuggccaacauggugaaacccuguuucuacuaaaaauacaaaaauuagccaggcaugguggcaggcaccuguaaucccagcuacuugggaggcugaggugggagaauugcucuaacccgggagauggagguugcagugagccgagaucgcgccacugcacuccagccugggugacagagcgagacuccaucucaaauaagaaagaaagaaagaaaauauaucucuggcugccuguggauaauggauuagaaaggaacagauuggaagcagaaacucuauguagauggcugcuaaaguaaucuaggagaacauucauaguagcuuggacuaggguuguggcaguagaacugaugagaacgauacagguuugagacagauuuagugucagaguggcagaugcugaggauagauuagcaucgaguagaacacauguccagggugacuccuggauuccugaacacuggaagacagguuuggaggugugggaagaaaauaccauggcuguggccuugagcauucaguagaagcaccauuaguaacuaucccccugauccggcaucaguggaaguggccgggcaucucaguguagccuugaugguucaguggguggaggcuuuaguuggcuuuuuuuugagguggagucucgcucuguggcccaggcuggagugcaguggcgcggucucggcucacugcaaccuccaccucccggguucaaaugauuuuccugccucagccuccugaguagcugggauuacaggcgccuaucaccacacccggcuaauuuuuguauuuuuaguagagacgggguuucaccauguuggccaggcuggucuugaacuccugaccucaagugauccacccaccuuggccuuccaaagugcugggauuacaggugugagcuaccaagcccagcccuuuuuuuguucuuuuuuuuuuaagacaugguuucauuuugucaccugggcuagaauauaguggugugaucauggcugacugcagccuugaccucuggugcucacaucaguaccccccaccgcacccaccaauagcugggacuacaggcguguaccaccaccccccgcuaauuaaaacauuuuuuuuuguacagauggguucuugcuauauuguccaggcuggucucgaacuucugggcucaagcaguccucccaccuuggccucccaaaguguugggauuacaggcaggugcuaccgugccuggccuggcaucuuuuacuagggggaagagucuucaguguuuagauggcaguugaagcugaggaugaggugaucaaaaugagcccuuuuacggacuggauuuuaaagcacaccacacuuaauggucagguagaggaagaugaacugacuaaggagacugagacaggccaacagaaagaagaagauaaccgggauugcgggcugggggggccaagcgaagacuacuugagggacgagggaggaguuauuuccgugugugccuccugaggugggacaagacgcagacugagaauuguugaucagauuagcggcacgggugguaagaccauagugagagugguuuugcuggagcaguggacacugaagccagacuggcacgggauaagaagcgaaugggagaagggaaauggaaggagagaagaugggaaaucuuuucgagaugcugggcucuaacgaugagggagagaaauugggugauuacugggauuuggcaagugaaguaugggcucaagaaaagacuuuuuugguggcucaccccuguaaucccagcacuuugggaggccaaggcaggcagauaacgaggucaggaauucaagaccagucuggccaacauggugaaaccccaucucuacuaaaaauacaaaaauuaacugggcaugguggcaugugccuguaaucccagcuaggagggaggcugaggcaggagaaucgcuugaaccaggaccugggaggcggagguugcagugagccaagaucacaccacugcacuccagccugggcuacagaaggaaacuccaucucaaaauaaauaaauaaaauaaaaaagacaagauuuuuuuaagaugggagagacuugagcuguauaaaugucagugggaagagucaugugguggggacugguuagaaauucaagggagauaaagcgagugacaguguaagguucugagaggaagggaggaagauaguauugaaagcacagcggagggacugucuuuggguaggaagagggcaggagaggguggguaggaugaagaugaaauuucgaaguuugggagugggaagcgaaggcuguuuuauuagguuggugcaaaaguaauugcuguuuuuauaguuacuuguaauuaucucugggcuucaguuuuuucugugaaguuaugggcaagguuaaacagaggugacaguggugggagaaguagcgauuuggaaauuggaggagaaaacuuuaguagcagcguuaaccagagaaaugugguaggauuacuggacagggaugagggccugugucguugguaggccugccuguuuuugcuucauaaguauuuucuuuuuuugacacauggccucgucucgucuagcaggagauauaugcuggauguuuuuccuuagauacauauuaauuuucuaaggaaguccuuuuaaauucaaauuguuuuuucuccauggguuccaggguggguuugagccaguuagcaacaaccucgaagagauggcacagucuuguuaugguugaggcuuauuuuucagucugaaaagugcucuucucccuuucuagcagggaacauuaguaugauaucaucggaaaaucuuuccagggcugcggugagccaagauugcgcuacugcacuccagccuggaugacagagugagacccugucucaaaaaaaaaaaaaaaaaaaaaaaaaaaggcugggcacuguggcucacgccuguaauccuagcacuuuggagucugaaguggguggaucacuugacucccagaguucaagaccagccuggccaauguggcaaaaccccaucucuacuaaaaauacaaaaauuagccaagcaugaugguccaugccuguaaucccagcuacucaggaggcugaggcaugagaaucacuugaacccaggagucagagguugcagugagcugagauugccccagugcauuccacccugggggacagagcaagacucugucucaaaaaaaaaaaaaaaaagaaaagaaaacucagcugggcgugauggcucacaccuguaaucccagcacuuugggaggccaaggcgggcagaucacgaggucggagaucgagaccauccuggcuaacauagugaaaccccgucucuacuaaaaauacaaaaaauuagucaggcgugguggcgggcgcuuguagucucagcuacucgggaggcugaggcaggagaauggcgugaacccgggaggcggagcuugcagugagccgagaucgcgccacugcacuccagccugggugacagagcaagacuccgucucaaaaaaaaaaaaaaaaagaaaacucuucaguuaaucaggucuuuaagguauagcuuuguuacucuuuuuuucccccacacaaauuccuaggaccccagauacccguaauaguaaaauguaaacacaguauccgugucuccacacccucuuuucugccagguaguggcuuggauggucagacugacauuaaccguggcauuccucagaaggcuuguauuuucuccugcugcucuuuggugacaaucaaggugaggcuggaagcacgagacauuauuuuuuucuuuagacccaggacccgccugccacaauggagcuggccguggcuguccugagggaccuccuccgauaugcagcccagcugccugcacuguuccgggacaucuccaugaaccaccucccuggccuucucaccucccugcugggccucaggccagaggugagaugucucccuggacccuuccccauggccccccgcaguccucaccuucacacacuguuuaauuguuugauggaagugacuggggaauaggauugaagaagugagaagagggaggggccaagaaaaagugauuucuggagaagggcccuuguggggugcugggggagauggaauauggugacauggugcucgcagccucucguuucucccuuuguuuuuccuacagugugagcagucagcauuggaaggaaugaaggcuuguaugaccuauuucccucgggcuugugguucucucaaaguaaguauuuaugcacucuucuccccaccaguguaagcguugagagcucuuaccucagauuccuguccugagauuccuaagcaccuaucuucugauuauccuuuaaaguuaccuaucuccacaaguacacuucuaccacuuuguagcacuuaccucauuuaacccucguuuuuccaaagaaguuggaaucaagaacuugcuaagaucagcaggcacuggaaccuguaucuguuugaugccuaagccagacucugaaccaugggcuccuuccuuuuucugccuugccuuuucuguaucucuuaaaaugcccuacccacuuuucuaccaccuugucuuuuuuuugagacagggucuuacucuguuguccaggcuggggugcaguggcacacacuuggcucacuguagccuugaccuccugggcucaagcaauucucccaccucagccucccaaguagcugggacuaaggcgugugccaccacgcccagcuaauuauuaaauuuuuuguaggggggucucgccauguuacccaggcuggucuugaacuccugaccucaagugauccuccugccucagcuucucaaagugcugggauuauaagugugagccacugugccuggcccccuaucuuacuuuauucauuuuuuuuuuaaauuuuuaacguucaaccaauucacaucauaucuuauuuuauuaauuuuguuugagauggagucucacucuguugccaggcuggagugcaguggcgugaucuuggcucacugcaaccucugccucccggguucaagcaauuguccugccucagccucccgaguagcugggacugcaggugcauaccacuacgcccagcuaauuuuuguauuuuuaguagagaugggguuucaucauguuggccaggauggucucgaucucuugacuuugugauccgcccgccuugaccucccaaaaugcugggauuacaggcauuagcuacugcgccuggccauuuuauuuuuuuuugagagagucucugucgcccagacuggagugcaguggugugauaucggcucacugcaagcuccaccucccagguuccaagugauucucaugccuuagccuccgaguagcugggauuacagauguaugcaaguagcugggauuacugacauaugccaccacgcccagcuaauuuuuauauuuguuguagagacgagguaucacuauguuggccaggcuggucuugaacuccuggccccacgugauccucccgccucggccucccaaaguguugggauuacaggcaugagccaccugugcacccagccuuuacuuuauucuugaaggucuuguaauuuucucugggaaugcuuucugacauaucacuucccuaggacaauugcccuaacacuucuuucuguguauauuccuguuuaaacucccucugucgcuuccugaccccuuccucccaguugucaugacacauacaaggugacuacaaaagagccuuaguaggucagacaggcaggucaggguguaugugggucagaugauggaggaggucaggagaagaauuacaguguuguuuuuagggagauacaauaacaaacaugaaugguuuacaaauucugccuaagcagucacaguuaaagggccauucguaauuggcacauuuguuguuugcaguauaauuggaugccaacuauaccuaagaacaaguagguauuccccuguagauuaaauguucucuuauuuuguuauauucaccauugguuugacaaacgaucggacaccugcuuacucagauggaaacacaaaucucuagagagcuggaauuuguggcaaauuaguaauuuuuuguuuaacugguggaguuaacuguauuugccauuaguauuguuaguuaagggggaguuugcuauucagguugucuugaaagugagauuaugaggcugggcgugguggcucaugccuguaaucccagcacuuugagaggccaaggcgggcagauugcaugagcucaggaguuugagaccagccugggcaacacagugaaaccucgccucuacuaaaauacaaaaaauuagccaggcguggcggugugugccuguagucccaguuacuugggaggccgaggcaggagaauugcuuggacccaggaggcggagguugccaugagccgagaucgcaccacuguacuccagccugggugacagagugagacucugucuccaaaaaaagaaagaaaaugagauuaaugugguucugugaccaaagcaagaaaguaaguucuuggagggaaagggaacuggucuuuagugggugcccacugugccauucacucuccugagugucuaagauguguugugucauuuuaucauuguaauuauucuguggaauuuguaucacugcauuuuacagaggagaaaaccagcugagagggacuuaagugacguaaccaaagguuauauuaucugguaauuguaaaaccagggcagguagcagcucuagucaauuguuaguggcuguguagcucgcuggccugggaaggacugugagucagaguuccaucggccugagcgcugugaucagggagugaugccugcagugucguuaguaacugguuacucgcaguaucugaaaagugccugagcagaugcuaguucugagugagcgagggguuguguccuugcugguuccuucuuuucaugugaaugccucuaaucacagcuaauagaaucuuuggguaggcagggcaggacauuuugucaagaagguauuuggagugacucaucgauuuuauuaaagauuagcagagguuauuuacugagguuuuacuaaguuuaguaaaaacugguuaucuugucaaauguucuguaaguuaaccucucaaaugacacaggccagcaguuugucccugaacaaagguuugguuuuacugcaaaaguguauuuugauucagcucuguuagguauuaucuuuaucuaccugcaucccccaugaaaguggaggggaaauugaguguuacuuaacaggauagaagugugaauaguaagaguuaaggagacuagaaugcuaaguguucuucugcuguugcuuuuuuauuuucagugugaguagucaggagaauuuaucuguaauucucaaccuuuugucagacaguugaacuuaaggccugcauuuugaguacccuuuccaaacuaacaaauguuccuguguccuuccagggagugucuuaccuuuauuucccuaagaaucaagugccaucugccaggaguuugagaucagccuggccaacauggugaaacccuaccucuaccaaaaauacaaaaaaauuagcugggugugguggugugugccugugguuccagcuacuuagaacauugaggcaggagauccccugaagcugggaggcagagggugcagugagcugagaucguggcacugcacucuagccuggguaacagagugagacccugucucaaaaaaaaaaaaggucaucuggagaacuucccucuguugaggguguugaggguuuuggcuuugucgguugccagcacuucagauaagaaucugucaugcagaggcuccaggggcaauuugcacuuggaaaaucucgcagacuaguacuuaggaaaacugauaacugccguuuugaagugucuguguuuucuguuacauuccccggauacucucaggguaauuguagacuccaagcucaggauuacuacucccaaguaaugugaaucaagcauucugaguccaugaggucaauuccugcagagacuugaacucacuuccucguccuugccacauugaugagcaguuccucggaaugggugggaagacugaccuacucuugagagagccccaggacaugcugugugugugcgcguuuugagugaacuguuccaagcgagucauugcuuugguuugcuuugugggucagccaggguaaccugugguuagagccgugucgcuucaccguacacugcuuuauugcagucacauaagcagacuucuguuggcuucaguccagcuuuuugagccguuuuuggagauagggucucgcucugugacccaggagugcaguguuaagauuguagcucacuguaaccuugaacuccugggcucaagugauccucccacgucagucucccaaguagcuaggacuacaggugugcaccacuaggaugucucggggaaagcgugagccugcucuuuccccuucucuguauguugccaguguuggcuccagauucuuguuuuuccauaugcuugucuuguuauccuuacuaauucuuuuuuuuuucugagacagagucuugcucugucacccaggcuagagugcaguggcgugaucucggcucacugcaaccuccgccuccuggguucaagcaauucuccugccucagccucccaaguagcugggauuacaggugcccaccacugugcccagcuaauuuuuguacuuuuaguagagaugggguuucaccauguuggccaggcuggucuugaacuccugaccucgugaucugcucaccucagccucccaaagugcugggauuacagguaugagccaccgugccuggccuuuuuuuuuuucuuuuugagacagggucucacucucaucacccaggcuagaguacacugacuggcaugaucucgguucugggcuugggugguccucccaccucagccucccaaguagcugggacuacaggcaugcgccaccacacccggcuaaguuuuuguauuuuuaguagagauaggguuucuccauguugcccagacuggucucaaacuccuuggcucaagugauccgccugccuugaccucccaaagugccuggauuacaggcgugagcuacugcacccagccugugcuuuuuuauugacauguuaaguaauaagaucuagaagcaggucuuacaacgacuauaauugcaaauuagugaugcaugugaaugauauuucaggauguguuacaauuauaaugugacaugaaaaugauucuauuagugacagucacagguacugcugauacuacuguggcuauuugucugcauuuauaagugaaggaaacacuacauuuuacaaauaggcuagugggaguaauuuuuuuccccauccaugaucacaggcccccuaugauuguauauccaacuaaauugugguucucagguuaaacacuccugcccuagcaccuucacacagcaggcagagaaagugccgaaugacagauugcuacuccgagacuugcugccuuacuucugcucuagcagccuucuuuuuugaccuuguccugcccucauaccucugguuagugucuuaacuuccagcuuggacccucguuuuugugugugagcugguagagaguuggaguguggagacuguuuuuuaguacuauguccuuuuggcuugagggaaaaauuuugcaaaaacugucaaggaggaagcccagcugucucugggacagggccaggcccuuuucgcucccaagcaggaagccgaggaccagagcuggcguugaggagucuuuuaccaugaaagcauguccgugcccgguguugaugccccauagagggcuuugcuucuugugucuacaggaaaaagagaccugggcuuagagucugcugcugggaacggaugggauguacaucucuggcucucagagcuggcucacuggccucuuccuuuuuuccuccacauccagggcaagcuggccucauuuuuucugucuaggguggaugccuugagcccucagcuccaacagguaaagggcagggagggagagggagagcccggggaucugagccuggauugucucuugcugcuccuccucuagcuuuucuguccugccuucauaugcccaucuguguccuucggccucauugucccaucucagguuucccucagagcucucucugaucuccaucucuuuugggugucaguggggcuggggguucuguggcugggcuggauucccaucugaccagguuucuguccuuucucccgcaguuggccugugaguguuauucccggcugcccucuuuaggggcuggcuuuucccaaggccugaagcacaccgagagcugggagcaggagcuacacagucugcuggccucacugcacacccugcugggggcccuguacgagggagcagagacugguagggaccagggcugcuaguuaguggaacaauagugaggaagcguggcaggaaggaacaggaggggagcccagagacauggggcaguugguuuuuggggaaaauggguuagaauacaggcaggucguccaccagaaaugacagaggaggggauggaagaaagacaguguacaggguaguugugcuucugccagcuccugugcagaaugaaggcccugggguggagaugcugcuguccucagaagauggugaugcccauguccuucuccagcuucggcagagguuuucgggacuggcccgcugccuagggcucaugcucagguguguguggguauuggagggagcggaggcguggagcaggagggauugaugagggagugucgccuucaucaggagaaaggagaugaaggugggugugggaguuaugccagggagccugcucugaaggucucccugcucugauucucuuuagcucugaguuuggagcucccguguccgucccugugcaggaaauccuggauuucaucugccggacccucagcgucaguagcaagaauauuguaagugggauuugucaucucuucagagcccuugcucaggauaccaggcaaccaggaaaguacuggggaccugagucuccccaaacagugucauccuggagucgucccagagagcuuccuacuuuuguccaaauaacaucacuuccuaugugucgugacacaggagcacagugucagaguguagcaaaugcuuccuugggggagggugaauuuggggaucagcugagucauugcugagaggcccagccauccuucuuaccuuccauccagggucuauuuuagaggauagggguuugauuuuguugggagagcugagaucagggguuggguuucuuaccuauguguacauauguaaauggucauucccuguuucugucucucucuggcucucacuuucuuccuccacucuuuaucucugccccuuuuuucuccagagcuugcauggagaugguccccugcggcugcugcugcugcccucuauccaccuugaggccuuggaccugcugucugcacucauccucgcgugagugggauugggcuggcuguggugaagggauagggcgugccagaaacgagggucaccauuccuucucugccccagguguggaagccggcucuugcgcuuugggauccugaucggccgccugcuuccccagguccucaauuccuggagcaucgguagagauucccucucuccaggccaggagaggccuuacaggugaccauccaggaaggcaggaagggaauaaagaggagaggggggugagggggugcaggugggcuggggcuucuggcauguugaccccccauucauaacugccaucuuugcucaugacacagcacgguucggaccaagguguaugcgauauuagagcugugggugcagguuuguggggccucggcgggaaugcuucagggaggagccucuggagaggcccugcucacccaccugcucagcgacaucuccccgccagcugaugcccuuaaggugaggaggccucagcuccgccuuaggacucauccugugcccuuugaccaagugugccugcucaggaaacacugucugcuguggcugucuugccuuguuguuugccuguggaugugauuuauguuuucucugccuccagcugcguagcccgcgggggagcccugaugggaguuugcagacugggaagccuagcgcccccaagaagcuaaagcuggaugugggggaagcuauggccccgccaagccaccggaaaggggauagcaaugccaacagcgacgugugugcggcugcacucagaggugggugaggccugugcccuggaccacuggggcucaaacgggaccccauccuuuccccuagugggacuccccuaccuacuauacccuuaggugaaacuuuuguggggagagugccuagaccagccuucguccacugcgauaagugaucccccaaacagcaggugaaggggaaggugccugugaaaugcagagccaggcggaagcccgcagagaggccaggaggaggcacccaagcagccgcccuguugccagggcugcaggcggccucggguccugcgguuagaccgggagcucugguagccgacacagccccuccaaggccuucgcuuccuccggcguucagcacguccuugguguauccacuuucuaucaggcagaguuccagcaugcggggaaggcuccucccugugaagcugacauucuuccaagggcaggcugccugggggagcucccugcucucaccguaaccacugaccuguccacagguugcuagucggauacugugcaguuaauggaugccuuuccucugggucccauauauuucacugccugccaccccaucccaugggaaggggagaaccgauuguucccaaauauauaaaugcaaaauuauaaaauuuauaauuuuuuacuuacauugucucaauuaaauaccgucaguggcccuauacaguagagguacuuuuaugauccccauuuucuaguugagaaguuaaaugacuuggccaagauaggcaguggcagaguugaugcccauuuugggcuguaugcuucagaagcccuugccgucagucuguugggagccuacccuuuacacaccauucuucuuccccaggccucagccggaccauccucaugugugggccucucaucaaggaggagacucacaggguuaguggagccucgucuccguggagauaggggaaggggccccugcucuguacacauugggggguguggcccagagguggguccauuccgaccugggaguaggcucuggagaaggguuggguggucuuggggauguuuccaggugugcucuguccuuuucagagacugcaugaccugguccucccccuggucauggguguacagcagggugagguccuaggcagcuccccguacacgagcucccgcugccgccgugaacucuacugccugcugcuggcgcugcugcuggccccgucuccucgcugcccaccuccucuugccugugcccugcaagccuucucccucggccagcgagaagauagccuugagguaacugugaugggccaagccccucuuugguuccuggagucucuuguuuccaagagacucccaguauuucuggugcucacacuugcccuuucuucuuuccucaggucuccucuuucugcucagaagcacuggugaccugugcugcucugacccacccccggguuccuccccugcagcccaugggccccaccugccccacaccugcuccaguucccccuccugaggccccaucgcccuucagggccccaccguuccauccuccgggccccaugcccucagugggcuccaugcccucagcaggccccaugccuucagcaggccccaugcccucagcaggcccugugcccucggcacgcccuggaccucccaccacagccaaccaccuaggccuuucugucccaggccuagugucugucccuccccggcuucuuccuggcccugagaaccaccgggcaggcucaaaugaggaccccauccuugccccuagugggacucccccaccuacuauacccccagaugaaacuuuuggggggagagugcccagaccagccuuuguccacuaugacaaggaggaggcaucugauguggagaucuccuuggaaagugacucugaugacagcguggugaucgugcccgaggggcuucccccccugccacccccaccacccucaggugccacaccacccccuauagcccccacugggccaccaacagccuccccuccugugccagcgaaggaggagccugaagaacuuccugcagccccagggccucucccgccacccccaccuccgccgccgccuguuccugguccugugacgcucccuccaccccaguuggucccugaagggacuccuggugggggaggacccccagcccuggaagaggauuugacaguuauuaauaucaacagcagugaugaagaggaggaggaagaggaagaagaggaagaagaagaagaggaagaagaggaagaggaggaagacuuugaggaagaggaagaggaugaagaggaauauuuugaagaggaagaagaggaggaagaagaguuugaggaagaauuugaggaagaagaaggugaguuagaggaagaagaagaagaggaggaugaggaggaggaagaagaacuggaagagguggaagaccuggaguuuggcacagcaggaggggagguagaagaaggugcaccuccacccccaacccugccuccagcucugccucccccugagucucccccaaaggugcagccagaacccgaaccugaacccgggcugcuuuuggaaguggaggagccagggacggaggaggagcguggggcugacacagcucccacccuggccccugaagcgcuccccucccagggagagguggagagggaaggggaaagcccugcggcagggcccccuccccaggagcuuguugaagaagagcccucugcucccccaacccuguuggaagaggagacugaggaugggagugacaaggugcagcccccaccagagacaccugcagaagaagagauggagacagagacagaggccgaagcucuccaggaaaaggugagaggccaggcagggaagguuccuugggcgagaagguggggcuggcgggagaagggguggcagcugcuucucuuaggagagguuugcccagccugaaccauucuucuguguaugugugugugacuauucugaaucuuguaucuuugugccuaaaaggagcaggaugacacagcugccaugcuggccgacuucaucgauugucccccugaugaugagaagccaccaccucccacagagccugacuccuagccaucuucugcaccccacucuuuguuuccaauaaaguuauguccuua

SEQ ID NO: 21274 - RNA, 3496 nt, Homo sapiens
agcggccugcgggccuuggcagcgccgccccugcccacacugaccccguguggcggggccgcuccgcgcccccgggccgcucuguaaugguagggcagccucagccccgagaugacgucgggucuccgcggccccggguuauuguaggaaccauccggccccgcguaaucguaggaacuauccggccccgcguaaucguagggucugcgcgggcccggcccccaccagacgggacuccccgcccccaauuggcggccgaagagucuccucgccccagagucaucuucgggacgcccagggcccgggugauuuugggcucgccgcggccccgggugauuguuucaucuccguggcccgcgguggucguagcgucuccgagaccgcggacucccguaggguccccguggccccgaguuguagucgggacaccccggccgcgggugaucgucgggucuccacgcgcccgggucgcugacgcggauccggccucggcgccuucucagggcgcccugcaaggccgcaggcaggaugaacauucuggcacccgugcggagggaucgcguccuggcggagcugccccagguaggcgccggggccacgucgggcuucagucuacagcccggggugugggcgaggaggaggcggcaccagaccaguuagaggacugggcccagcccugccacccagcuaggccuggugcuucuggguggucccugcacuccaccccuacccgggccgcuuggcugcgggacaagggccaggaguaggaagcuccauucucuuccauccuucccacuaagugccugaggaaggaggccgcuuugcacgggcacaaagacuuccacccccgcgucaccugcgccugccaggagcaccggacaggcaccguggggugaguuagggacacccacaacaaagagaggaggucccaggaaacucuguagucauagcgaggguaaacaaccacccccuuggggcuucauuucagccccuaccagcuauaugguuauuucccccucuuuaagccccuguauccccuccuuuucucccaacaagguuguugugaguucuaugagaugggguuggguagaaggguggcagcuggauuucugaguagagacuaaggugucugaaaugggaagguggucaccugcucagauccccacauagcauccauggagccccagggcaggggucuggcugugcuuacagggaugagucuuauuguggguuuuaaagguaauacugauaacaguuggcaccauuaauuaagcauuugcugugugccaggcaguguuggguacuaucaucuuuauugaauggaaaaguccaucacuuaagauauauccugauuucagacauuaaaaugcgggggggagggugucuuagaauauaggacauuuaucucauuuuaaccuucacaacgacccaguaaaauauauacuaacuuuacuuaaauguuuaaacugaggcuuagagaggcuaaauaacguguccaaagucacacagcuaaucagugugagagcugggauucaaauucaugucucucugcuucuggagcacaaaacacuccuccuccccagcacaccuguccacgcagcugccugggaugccuggugucuauaauacccucagccugggugcagcuaccuuucuggaccuagucgggagcauuggaacucccuagggugaaagagcucgugcccacuccccuugcccacucuuguguccagcagauuuaagaucuccaaggucauuguggugggggaccugucgguggggaagacuugccucauuaauagguaagggggugcuggagcugagcugggcaggguggggccaagccuagccaggugggcuggcuccagaucacagcaucugguacccucucagguucugcaaagacaccuuugauaagaauuacaaggccaccauuggaguggacuucgagauggaacgauuugaggugcugggcauucccuucaguuugcagcugugagugcuuccacaccccuuccagcuaucccuucuccccagcacccacaccccccaagauacauaccugugcuucacucuuccuuccuuccaguugggauaccgcugggcaggagagguucaaaugcauugcaucaaccuacuauagaggagcucaagguaaggggcugggugaagugggguaggugggucucagagugcacauggcuucucauauggagcuggaaggauuggggaaaugagcaguagugucuucccugucaaccuggggcuguuucugccacucuuccagccaucaucauugucuucaaccugaaugauguggcaucucuggaacauaccaaguaagugagcauccugcaauauaaugggaggcuccgggaagagaggguucagaacagagggguggucaggaagaagaagaaugcauguaggaccagagaggggguaauugggccuaugaaugucagugggaggggcccugcagacucacucaucccuuacuuuccaccucccauggcaggcaguggcuggccgaugcccugaaggagaaugacccuuccagugugcuucucuuccuuguagguuccaagaaggaucugagugugagugugccaguggggggacuucccagcuuggugagggaaugccccccucugacucuggccuucccucagaccccugcucaguaugcgcugauggagaaagacgcccuccagguggcccaggagaugaaggcugaguacugggcagucucaucucucacuggugaguuggaggcuuuagggcucugcugugacacucuugccuggcucuccucucacugcuacaccuccagcugugcccuguguccccagacccagcacugccccugagcaccuaucugcucucugugucaggugagaauguccgagaauucuucuuccguguggcagcacugaccuuugaggccaaugugcuggcugagcuggagaaaucgggggcucgacgcauuggggauguuguccgugagugcuugccugguugaggguggcagagggcacagugagccuccaaucccugcuucacauauuuuccacccuucuuuaggcaucaacagugaugacagcaaccucuaccuaacugccagcaagaagaagcccacauguugcccaugagggcugaggagacuguucagagacugcccagcccuagggcacugugccacccucauuccuccagagcuugaccccuggacauuugcacugacuuuauccagaccaaagagcugccucuugguggcaguauucccacagagggguagcugggaucaugcuagucacuuccugcccccaggcaccgugccaaagacuggaugcccccuacuccucaggggacuguccagggcgcccagugguagugagggagagugucucuguucuuuugcucagccugcugggcccuuuguguuugaggaugcuuaaugauuccagccucucacugugccuuaugcauuaaaauu

SEQ ID NO: 21275 - RNA, 4115 nt, Homo sapiens
ucuggcccggcguguagcgggcgcacuacggggacgcugggccgggcaccgggcuguguggagaagugagcgcgcucgucugacccccgugcccgccaccccgagccacuaacggcgaucucccaaggccugcccgaggccucuguccucuguccucagccccgcagcggcaacgucuugcacucggcgagcucgccgcucccgacccucccgcgcccccgcccugccgcgcugcuccccgcccagccgcgggucugugguccaagccgccccgaagcagcccguaaguaucucggggcgccgggcggggucggcgaggagacgggagccccgggcccaggcggcggaggaggggcugcagcggcgucgagcccugggcccucgggagcucggggacggcggggucgcggcccugggcgccgagggggcagcgccaggacccgaggggagcggcuccgaggggccgccggcgcgucgggcucguccugggcaguuggccggggacgggcggcccggggcgagcugacgggaauugggggguuggggugcccggaggagcgacgagcucgcgguggaacgcugggguucgaggggccgguggccgcgaggcugaaaauggugccgaggaaccggugcucccccaggcucuggccggcucccaggagcccggggcgggggccacggggcggggagcagcgggucggguuacggcgggggaggggagcggcugacccggcgccccgaccugcucggugcugggugcccagccgggagagguugcucuuccauuucccgggccuuccuccuccuucuccgaggaggcucguacucucuuccuccuccaccuccaccuccucuugcuguugcugcugcuguagcgcuugggcuccgagggcugugagcagaaaucuaaugagaucuaacuggcuguuuauguaauucuucacacuccugccugucuuaaggcguugcuuuguaacuaccuuccaccgagccugaauuucgcucggcugcaccuucaagcaauugggcuuaaucagcugccucugccggcacucaggcuuuugacuuggaaaguguuuguaguuugggggcagccagagauucuuuuucccuuugucaccacgaauauggaaaauagaacagacgaauuaagaccaacuugauuuuuaaacguacuuuuaaaucaacuucagugugcaaauagaucccuuucgcaaauaucuucuguuugcccuugaucuuuucuuauccccacccagugcugauccagcaaacguuuaaaggucgaccuuaccauacuugccucuccggcuguuaccgugagagggagggagggagagagggacagacggagguuuuuuaaaaucagacuaaaacucagaaacccuggccuuaaacagaauaaucaauaguuuuaauuugugucuuugcuuuuguuauacuugcugccgaauagguauuuucagauuuagaaaaauacacauugaaaacaaaaggcccagagaagcuggauuuuauuauauuguaugcucuuaguauacuuaaggccgaaacuauauagaauaauuugguucauaauuauuuacuaggaugaaguucauuuaguacucagugucuuuaauuuuagcaucauguacuauggaaauuaaaaugaucuuccuaacguaaccaaauuuuuaaaugucagugacagagcagauuuaaacaguauauauccaaaguaaacuaaaacauggauucacuucuaaguuggugaauaacaauaaaaauuacuaccuaaaaguggcaucuauauauauggggguggggggaggaugcugaguacaauaaauauucuugugagaacugaggagagaagaaugcauguucuagagauuuuucuucuuagaacucuauucagaaacagguuuuuaaaagcauuauuucauuuguaaaucuacauuuuccugugucauuuuaaacuuuaauaaacgauuuucuauuuuauguuuauuuugugcuaguaacaguuuucaggcuuucuguccuaguagacauuuucuuuuucuuuuuauccuuagcagacuaacacaggaucuuagacauuuugaaaggugaaauuacuuuggaggggggaaggucaugggacuuauauuacauuuaucuuauuuggauauguuugcuuuuguuuuaaggaacaagaucacucaaggugaaggauaaucuacuaauaccagcacuuugaaugaaaauuuguuucucugccacaaacugaacaucuuuuuuuuuuuuuuuuuuuuuuggugggggaguugaaaccuaauuuuguggcguagcagcuaugcagcuugaaauccaaguagcacuaaauuuuauuauuucguauuuguacaauaagcuucccaggagacgugucaacauuuuuggugaagaacuugaaagacuucuuaagaagaaauaugaagggcacugguauccugaaaagccauacaaaggaucgggguuuagauguauacacauaggggagaaaguggacccagugauugaacaagcauccaaagagagugguuuggacauugaugauguucguggcaaucugccacaggaucuuaguguuuggaucgacccauuugagguuucuuaccaaauuggugaaaagggaccagugaaggugcuuuacguggaugauaauaaugaaaauggaugugaguuggauaaggagaucaaaaacagcuuuaacccagaggcccagguuuuuaugcccauaagugacccagccucaucaguguccagcucuccaucgccuccuuuuggucacucugcugcuguaagcccuaccuucaugccccgguccacucagccuuuaaccuuuaccacugccacuuuugcugccaccaaguucggcucuaccaaaaugaagaauaguggccguagcaacaagguugcacguacuucucccaucaaccucggcuugaaugugaaugaccucuugaagcagaaagccaucucuuccucaaugcacucucuguaugggcuuggcuuggguagccagcagcagccacagcaacagcagcagccagcccagccgccaccgccaccaccaccaccacagcagcaacaacagcagaaaaccucugcucuuucuccuaaugccaaggaauuuauuuuuccuaauaugcagggucaagguaguaguaccaauggaauguucccaggugacagcccccuuaaccucaguccucuccaguacaguaaugccuuugauguguuugcagccuauggaggccucaaugagaaaucuuuuguagauggcuugaauuuuagcuuaaauaacaugcaguauucuaaccagcaauuccagccuguuauggcuaacuaaaaaaaagaaaauguaucguacaaguuaaaaugcacgggcccaagggggauuuuuuuuuucaccuccuugagaauuuuuuuuuuuaagcuuauaguaaggauacauucaagcuugguuaaaaaaauaauaauaaaacaugcaucauuuuucauuugccaaccaagcacaaaguuauuuuauacugacuguauauuuuaaaguauacucucagauauggccucuuacaguauuuaagauauagcaaggacauggcugauuuuuuuuuauaaaaauuggcacuaauaaguggguuuauuggucuuuucuaauuguauaauuuaauuuaguacaaaguuuguaaaauaucagaggauauauauauauuguuucuacgacaugguauugcauuuauaucuuuuuacuacagugaucugugacagcagcagcuucauguuguauuuuuuuuacugaaauuguaaaauauccaucuuaaagacaucaacuauucuaaaaauuguguacaggauauuccuuuagugguggaauuaaaauguacgaauacuugcuuuuucaaaaaaauguauuuucuguuaaaaguuuaaagauuuuugcuauauauuauggaagaaaaauguaaucguaaauauuaauuuuguaccuauauugugcaauacuugaaaaaaacgguauaaaaguauuuugagucagugucuuacauguuaagagggacugaaauaguuuauauuaaguuuguauuaaaauucuuuaaaauuaa

SEQ ID NO: 21276 - RNA, 10837 nt, Homo sapiens
cugagccggaaggucugggugucauuuauugacagcaguuuauacacauuuguuuccuucccagugcaggcauagagcccgugagaagggcagucucugaaugagggggccaggaacguaggucggacacgucuuuggcaggcauguucagccccagcaggaugcaauccuucaaguuggaauuccacuggguaucugagagggaccaaggugggggguagagaggaagucuucaacaggacucacaucucgguccaggccuccucucucacuauacaaguccauccaaguuuuaggacccuggggggcaacagucaggcccacccaccucaacaggggcagauucuucaaucugugcccaguucacacacaccuguuuccgcuggucacacaguuaaagagaaucagacuuaugguaacagacagaccacuuccucucugccccuccccggcaccucucuucagcagcaucugcacaggaaccgcugggaagacggaggccugccuucucaguucagccgcacaugcccucauccgcaaaccuuccaucagugacaggacggaggccacacguggaucuaggcagacaccugugcuccccaguccaucacauacugccccgccugcgugcugccaaaugcuggugcccaggccggaacuccagcaggccccgaauugggaccuaaagcugguuugcauaggcacuuggcaauuuuugguagggagguggauaaaaaaguagauggaugugagaagaaugaaagaguuucauuugauagacuaauuagagaucugaagugauuuuaccuuuauuuccuucacuuuaagccaaucaugaaauuucacagugauuucuggggugggagcagaaggaaggcuguguuaagaaucaucggggcuguggcccagucagcccgcggaggugcaggcagggugggcccucacuggggcagcuggaggagcacggacugccccgcuggcagguaggugauguuccgagagcgugagagcugguacgcgauguccucugcagcuuccagcuugcgcagcucgaucaggccauccccugcaguggccagugaguuggcaaucagcucagcugccuuggagucgcccucagcagagaugauggccgccuuuuucuguugcucagccuaaaagaauggagguggagacaaagaucaaaccucagggcaccgcaugucaggcuacaaccaaaggcccuucaccagaaagccaccuucccaggcuccugaaggaacucggggaguuuacuuccuccugauggcuagcgggggaagcggggggaagcagagcacauugcccaccaguccuccccuauccuuucaugcucacuccuugucacgggagggauacaucucuguuggcugcaggaauauuugucuuauuucaaaguccucauuaauauuaauugcaaucuaguuuaacaacccuacucugagccaggagaagccaaggccaaggaaaacagaagcaaaagaaagguggaaucaauccucaaggcucaucuuuuccuccagccuuaagucuaaaggacuucaucaaagccaggacagggccgggugugguggcucaugccuguaauccuggcacuuugggaggcggaggcaggaggaucacuugagcccaggaggccaaggcugcagugagcuaugaucaugccauugcacuccagccugggccacagagcugucacaaacaaacaaacaaacaaacaaacaaacaaaaaaccucgggauggcuaaggaagagcagcaugcacuuuugacuguuccuagagcugccugugaguuaggcugguuccugaccagaauccaggcacccagagugagaucuccuaggcuugcccuaccaauaucaauaggaagacagcucucugcaacgugugaccuucaggagugugaggaagaagacaguauuaagccucccugaaauuacauacaauuuugaaaugacugggcccugcgucuauuugcucaacaaacauuuacuguauaccuacuaucaccaggcacuguacuagacuuauuauaaucucugaaguuauggcagauacaaagcaacacaagucucugcccacacaguguuuucauucuccaaaauuaaaucuaucccucuuuucccauuuuauuucuugcuguccccaucuccccaccaauuagggauacugguggugggaagaaggggacaacaauaaaugaacaugucuuugcaaauaccagaaagaccaggcugcuacgcaaauacacugugucccaucacauucuuugacacaucuggauggauuuagcacuagaaaaaaaucuagugacgaaagcacaucuggugcaacguuugaucuuuuuugcugucagcuuucacuauguaacuaugguuaaaaaugacuucucagugaagcugaaaauacuccaggagaaacauuuuuauuuguaagagaguguuuuugaucucagagaaguggaagaaaaauuacccuucagugauuuaggaacauaacuccacauauccuugacuagccccugaagacucuggaaccaauugcagaaguacaauuccuucaagccccuucugauuaucccggaagaagggaugacagaugaugaauuuccaggccacccagcaaauggggaagcugagugccggagaaaggggagagagaggcuccugccaucuggucgaaggcucaccuuuuccaccacaaaucuggcccucucugcuuccugcugagccaccuguuuggcuuccaccgcuucugugaacuccuucccgaaggucagaugugucuaaggggagagagugagcacaagaugaggcagugugauugcuucgacagcacugcugggagggcuccauggccgcuggaagaagaggccagcaauggcucuagcagcuggaggcauccgugaggccagaacacucuuccaccuccguaucuguauccaaacugaguuuacacccagacucucuggcugcccaaacugcuccuguauauuacucugucacucucaguacagugaccucauguagcaaauggcaccgggggcuuuugauggggcccacaggcaccagaagguaucuacucaaucgaccaccuccccagaggaggagaacuguggguucuaagacccccgccacugacuagugcucuuccaagggccuuugaugccuuguucaaagcccaaggaaggccagauggaaaacagggucccugagagugagggaggcagcugguucccagggauccaagagccugaugcucucuguuuauggauuaaccaguccgcgucuucccacagcagcuccaccacugaacaggaagaggacgagggacgguggaacgcaaaucaugguauucccaaugugaaugguucuguuaaacgguuuaaaagaaagagaaagcagguaaagucauuggucggcaugaggguuuagaagucugaugauccauagaccuucccuaaucaugucaggucugacgggacugucccuaaagauagcacaaacaaugggaagggaccucagaauuccuaaugcccagccuagagcaauuuacuuauucauccuaauuuuuauugaaaaagaaucaagagaagagcauugguuuugccaucaaauucuaguuguuucauuuccuccacucucccaaccucugcuuuuuaaaaaagcagcuccaaacuucuccugaagaguaaauccuggucucauucucuuccagaauuuuuaaccuccuaacucuaacugcagcuguuguacuucgccugauccauuucuaguuucuuagucaaaguuuggguaagaaaaucugauccugagacaugaaaaaugaaauguauaauuaaggaauaaaauuuauuucuacaagggccagcugagggcagcaaauuccccaugaaaccuaauuuucuucucacaccuuagauaggguuucuuguggucagcccacauuuccccagaauggaguaugugguuaaagucuaguaaaaugccaacuuuucccuuagguuuuuacucagcguuuucucacagccaagguguucagguuaacgguaauuacgagggaagggcccacagaauggcugcagccuggccucuugccagcagagggagccccaagcccccaggacuuccagcaggcggagcaagguggagcagugcccagggguuagcacuggguguugucaaguggcuguuuaaacagcugcacagaugccgggggaggcagugccuuucccuagcaaugcacgggagaacugaacaggaaacacuuuaccucacugcccgaacaaaucacuccaaaugguuuuucccagagaaucuagaaacacgaccccuuccccucacccuccucaaccugaaacgcuauccugccugcauugcuuucugaguuaugacauccaaugucauauaaacacacaagcuauagugucucaagaggauagcuuacgccucagagaugucccuugcccccuauaccaggccugggggaauccaaccguucguuuacacucuaucaccuuucacugggguucccagagcuuacuucacugagcuucggacuguaaaguguuaggaagcucccaggagucaggcugggaggucugugcuagggagaaggacuacccgagcuguucucuggucucuaccaggcaguuucugccugugucaaacaggguuaacaaggcaucacucucuggguaacaguuuggagaagguaaaacauuuagugguuagagacuaucuggauacaaccagaggucauaagaaaaauguguguggcagggggaagguaaaagaacccucaacugaaaaacccacggagacugccucaccucagcauguuuccguguuuucaagucucacaucuagcaaagcagaagggaggaccuaauagcgucuacccagaaauggagccaggcaccuaaacgagaacugcagccccuuccccuccucggucucccgaaggaucuuaccaaggacacgucauccaggaugagcccaaagguggcggcucgcucuguaaggucgucgcucaccugccuggagaccagcucucucugggugauuaguucuccagcaucaaagcgagccugguuucaaagggaggagcagaagggcaggucagguuaaugaggaagcagaaaaggaaccaggaaacuagcagccacaucccaaccaacccacugccaagcgcuuccugccaccuggcacccucccaggguggugcucugggcucgaggcuaaaggccccuguucacucaccaccacugacuugaggaucucaguugugauggacggcagcacacgcucaucauaguccucuccgaugcuggugaagaugcgaggaagcuggcuggcgacaggccggaagaggaugcgcagugugauguugacauucuguaaaucuuaggguaggggacaaacacuggaguuaaaaauaaaaaccacuguaggaaaacaaguguuuuuuuuuuguuuuuuuuuuuuuuugagacagguuuuugcucuuguugccuaggcuggaguacaaugggacaaucucggcucacuacaaccucugccucccagauucaagcaauucuccugccucagccuccugaguagcugggauuacaggcacgcgccgccacacccagcuguuuuguauuuuuaguagagacagggugucaccauguuaggcuggucucaaacuccugaccucaggugaucuaccugccucagccucccaaagugcugggauuacaggugugagccaccgcaccuggccacaaguggucuuuuauaugaccucuccuacuccaauuugcuacaauuuuuauuuauguauuuugagacagggucacauguugcccaggcugaagugcagugguaagaucacagcucacuguagccgcuuugaccuccugggcucaguugauccucccaccuacaccuuccaaguagcugggacuacacaggcacagaccaccacgcccagcuaaucucuguacuuuuuguagagcugggguuucgccauauuucccaggcuggucucaaacuccugggcucaagugauccaacugccucagccucccaaaaugcuagaauuacaggugugagccauuacgccuggcaauuuuuauuuuuuauuuuuagagacaaggucuugcuauguggcccaggcuagacucaagcuccugagcuuaagcauuucuccugccucagccucuugaguagcugacacgcaccacugugccuggcuccaaauuugcuacaauuuauaagcaaaucugcugauuauaagaucccagagggcaaggugcagguaugccugguuuccuuggcagagaacccaauagagcaucauaaagaguuuauaauuucuuaagaggcuucagugauagcagcuuuuugguauccccugaaugcccucagauauacauaauucagauuauaugucuaacaggugccaugcaaaguuugcaacacugaacauuuuaagacaauagacagggcaaugcuaagaauuguagggugaggccuuuacaugcucuggugauuguggccaagucaggagucagccuuggagagguuaguucgggucugguggaaacgguguuagacuaucaguccaaagaucugggcuauuuacuaaugauguggccucucuaagccuuagccaaccugagcuuauuucccugucuaugagaauggggacaauuucauuugcuuucugggccuugcggaaauguuggggaaaauugaaggagaaaacagacguaaaagcacucugucaaauguguaacacauauaagggguuaacagacugauccuauguucugcuucucauuacuuggaccauuuaaaggauccagggagagaauuauacuuuccccuggacaauucaggccugccuggagccaaagcacugucacggcuugcuuacagaugucaacaauauggaccaagcgcccaugagacagcccugaacugggcaccaagagaggugggcaauguauuaauaccuacaacucccugaucucuggaagcuccuaucaauaguuuuagaaauagguacauaauguauccugaaaacaacugcaaaacaguacggaaagaaauuccaaagagaugggaagauuagaagcaggcuuuuuuuuuuuuuuuuuuugagacagagucucacucuguugcccaggcugcagugaaguggcacaaucuuagcucacugcaaccuccgccccccaggcucaagcaauucuccugccucagccucucaaguagcugggauuacaggcaccccccaccaccggcuaauuuuuguauuuuuaggagagaugggguuucaccacauuggccaggcuggucuugaacuccugaccucaggugauccaccugccucagccucccaaagugcugggauuacaggcaugaaccaccgcacccagccauaaguggguauuucuaagauuccauaucaagcucuccagggcaaguagucuagucauuccuaugauguacaguucaaacucuuuuggauccugguaucccacagaugcuccugugacacagaagaacagagcaccucuuccacacucccuacuuuaccugaaccauaggcaagacucaccuuugcuaccagugaugacuggcacauuacguggucgagaacggcagucaaagauaauugguuucuguacccacgggaugagaaaaugagucccuuccccuaccacaauguccugcacuccacggaaucggucaaagaugacagcucugugcccagcauccacuaggaagaaaggacaaugacaugucauaaaaauccucucauccuuuaaacaaaaggaucaugucuuugaaagagcccuggugcuuucuguucacuuauuaagucuccccucuucucucugucuuccccaacuccuggucucuagagacuucuaacuagcugcaaaacuaagcagucacuuccuguuccacauguccccaaggauugguaauaggaccuguuccuuagcauccuuucuccuugagggaacuggcuguugauuuucugaaugaccauucuaucccugaacucccaccaacauauuuccaggaaucaucuaccaaaacuucuaaaacucagugaggucuucccaguuaccacauauccaucgggcuccaauuuaaccuagugcucccagaaguagcacccucauuaugggaauccuacauuucgaagagccuacucuuucuuccuaauagcucuguuucgcuaaaguuuuaagggguuauagagcugucuuggcacagagagaaauuuaugauggcaauuucugucuaguugcagauguggccaaaaggaucacaguacugcuaagaugugucauauaagccaagcaggcuuuucuaaucagcugccucucugaacuuuaucauugguccaaauaucuucacucugaaaguaaagcuccucuugucagccagccacacaccggaugggucaaucuauugcugcuuugcagcaugugaaagugucagaaugucagaauuaaaggagguccuacagauaaagucaggucaaauccauugcuugaccaaugaggaagcuuccacaguaaaguggaagaaaagccagcuuaaccucccuccuacacuguuaaaagcugggcaaugcaucucaaagauacuuucucugaaacuacccgaauucagcacagcaaaaguuccuguucaggacaaggucacccaaacagaucugcagccuuugcuguuauuccacaugcaagcagaggagaacaaaugagaucuccauuucagauagccagggaaauccagacacugugcggcagcauuuggguggugcggcuucacuucaccuugacagaagccacuggacacauccaacuaggaagugggcugggaagcucuuuuugaauacaggcucugagagaaccuaugacugaaaggucaggggcucugauaacaaugcaguccugugguaugaaauggcaggaggugagcccucuuggccacaaacacauucacugacggcagcuaccaucaagagugucacaugggcuaugcagaccaacagaaaacuccuaggaaagugcagugacccacugucccuccaugccucaccauuauauaaggcagaguucaccacgccuccugcaacagcuaaggccaggccaaacuugccaauggacucaaacacuuuggcagccauguuuccuucugcuggacccucucacaccuaaggggauaaaaacaaaauacaaucaaacuugaugccaaauccucagagaaggcccucucugacacacaacagucacuuuucaaccuggcuauuuauuuccccauuccugaaagugcuaaaucauccauugaaggauaccuaauaaauaaugcuuuauagcuuggaaaguguacuaucaauucuucugcuuuuuuuuuuuuucaguuucuuuucuuuccuuuuuuuuuuuuuggagacagggucuugcucugucacccaggcuggagugcaguggugcaaucucagcucacugaagccucgaccucccaggcucaagcgaucuucucaccucaaccucccaaguagcugggaccacagaagugugccaccaugcccggcuaauuuuguucauuuuuugcagagauggggucuugcuacguugccccagguggucucaaacuccugggcucaagugaucccccugccucggccucccaaguguugggauuacaggcaugagccaucaugccuggcugauuucucuuuuuuucucaaccauuuaaaguaaggugucugggacacuugguucaauaaugaaaacaaugcaugggcuugaaauccacagagaacuuagcaccacacuaaaccacccucucauuuccuggacaaguaggcccccaaaaagaggcugugagguuagauuggugcaauuaugguuugaaaaaaauaacuuaaaaaaugugcuacauguugaugccaacaaaaaaaguaaccguaacagcuaacacuuauaucagguagccuaauaaaagcaauuuauuuacuucucacaauuacccuaugaagcauauuacuacagaggaaacagaggcacacagagagguuacaugagaagccgagauugcaguuauuaagugguagaaccagaauuagaacccagaggucuaaugcuagcagacacagcuuaccuccucaccauacugcuugucaacaucguguauuaagaacgacaugcuucuuauggaagcaggagcuggaugacauccuggggccaagauaacugaagaacccauuugggagaaaggcucuaacuagcugcacagggacagugagcucuggaauaacugggaggguggggcugaggcggggugggcauaagcacaguugaccuaacuagaaaucacgccagcauguaacuuucuaacgcuccgccccaccgucguugcccgcuccagucucaaauccucccucccuacuucccagaccucaacuccugagacuacccugaucucguccagugcauuuaaaucuuccuucucugaggcugggacacccggcccuuuacauuuguaauagcuucuggauuauuccucacccugccuccauggacaccucccuuacucugagcaaccccuggcucgucccgggcucagccccuucuccccucccucacaagucggacucacgcacgcacucuccucgcccaaagugcacaucauggagcagaggaggacugcagagaugcccagaaacgagccuuugccgcccccuccauucucaccugcuuccacucugaccuccacaugaauuccccaaccacacauacugcgcaug

SEQ ID NO: 21277 - RNA, 29133 nt, Homo sapiens
uugaggaaguauaagaaugaaguugugaagcugagauuccccuccauugggaccggagaaaccaggggagccccccgggcagccgcgcgccccuucccacggggcccuuuacugcgccgcgcgcccggcccccaccccucgcagcaccccgcgccccgcgcccucccagccggguccagccggagccauggggccggagccgcagugagcaccauggagcuggcggccuugugccgcugggggcuccuccucgcccucuugccccccggagccgcgagcacccaaggugggucugguguggggaggggacggagcagcggcgggacccugcccuguggaugccccgccgaggucccgcggccggcggggccagaggggcccggacgagcucuccuaucccgaaguuguggacagucgagacgcucagggcagccgggcccuggggcccucgggcgggagggggcaguuacacggcagcggcucgagauggcccauccaagagacuggcgcuuuccaggcuccgaggggcuccgggaacuugucaaagaaguucucugaaauuguucagaaaguuuucccgcaaaggguguauugcguagagcgcgcgcgcgcguuuccccccuucuugagcccccucaagcuuucucaaagccuuuccaguuggcagccuccgccuccggacuggccugggcuggauuccuuggggggguccucugcccugccccuccuccagccccuccccgcuccccuucagacgauuuugguuugguugcuccugcuucuggcggggucgggugugugugugugugguggaguggaggguggcauagcaaccugucccaaccagagccggggaggaaaggguggcccggaggguggccucuugcuggggucuggguugggggcgggggagacguuugcuuugaacagauucuuggggccagcuuagggacugugcucugugacuuuuggagcgcguggaccauggagggguggggguggguuucuugggguguaaagugggagaguucccagagaaggaagcuaagaaauaaggccagaugggagccuagggagggcugcguuguucugcugccuuuuccuuggugcugugcguggggaagggugagugggggcaguguguauccugacccaucuguccaccugugugcauuaaucauaaaagcuaacauauagccugggccagguauacucugccaggaacuguuugugguguuuugcaugcauucuccuuuaauccuagaacaccccuauaguggaaguucugccagcauucuggacugaguagcaguccagagguugaguagcagcuaguaagugguggggucaagaugggaccccaggcagugcgacccccaaccaugcauucgaaaucgcuauauggaugagugcaccuggagcaaugagggacacugcucccugagucacugggcugcaggggagacaaaaugaaaguguucugggagucguggguggucuccauaggucagagggucuggggagggagugggugucaucguggcuguguguugcccgaggggcccucugugagugagugcauggccguguuaucucugcaggucuacgccaggguguuccucaguuguguggucuuuguauuugugugucugggcuuuguguugccaaacagcagucucucugcugacuuggggacacaggcugaacucuguccucugcaggaacucccuuaaggugcugggccagaucugccauaaacagagggagguagccuucuauggccacgccuucuugcugaggaagaagguuccucucuuccagggaguacauccuugcccucccuguuucccagacaagcaucuucaccucucaucuucugaugagaagggugaggccauacugagcugucaggcugagcugcugcccuuccucaccuugggcugggaguugaucagggaauggcaguugcugcagagcuggauuugagggcuggguucucuggauggggccuccucauguccucaccccucaaccugcacuauugauuguguugugcaggaguuaguuaaaaagucauugcacagccugggcaacaaggcaaaacucuguacaaaaaauacaaaaauuaguuggaugugauuacacgugccuguagucccagcuacuccggaggcugaggcaggaggaucaccugagcccaggaaguugaggcuugcagugagcugugauugcaaaugcucuccagccugggugacagugugagacuccguuucagaaaaaaaguauaccacccagcugccuccagcacccagauuuuacccaaggggugaggucuggggcaggaaugugggggaaggggaggccuagggggagccccagaggggucaggauuuuucugaaauccuuucuuagagguauggguuuuacaaauugcagcaaauacauccuuuuaaucuugcagaacuccuucauauuuuaauuccaguaugauucuuccaacagccuccucucuuuacuauacuuggggaaaguacucauuuuauuugucaagaaaaaaacaauugaaaagauagggaucaaauguaaaaagaaaaaauacguggcauuccaaagucaaacacaaagcauguuuaauuuucucgugguuugggauuacccauauuccugcuguaugaaccugucuugucuuaacuuuuaagaaauguacgguguacuuccuauaugcuagguuuuuauccaugcuuucauuuaaucucugugacaguccugugaaguaggugcacagaugagaaaauggaaguucagagaaaugaagcaacuuauccaaggcucccagcuacccaguaauguccagggaauuuuuggacucugaagaggaggcauuaagaggugguuagagucuuauuccagccaacaauaauggguugaacaaagccuuaggggcaggcagguggccagaugggaggagaagcgcuccucuuguucaggcgaaugaccuuuccauccacuucucuaggcuguagaaaguggagcugagcugggggcccugagguucccucuugacuucagaguccucucccuuccuguccagccaaugccugucuuccuuuugggcccuaccagcaugacagggggcugcgggcaggaggggacagaggccacguugacacacagggcugugggugagagagacagcugaagugucagcgugaggggccaguguggggcugcggcugggagggcugggguggggcccaggguaguugugccuguccuugggugauggaaugaucuggaaagagauuccuucccugcccuccaccugugagaagccccucuagagugacaucuccaucuuauguuuggccacccauccucccccugggaagagagccgaggugggguaagggauguguacucuuucaaggagugggagaauuauucuagcgaauguuuguguugucccaguucuguuuacaaagccucgucauguuuacagauggcugcgcaauucauuaccucauuuaacucucauguaccuccucugagggaguaagagcuguuacagccaaguuuaggucaguaaauauucaccaaguugcagguacugcagggcauagagaugaauccgauuuagcuucugcccuggaggucugggaacuugcucaagaucacucagugagcagcugagcuaggguucucaacuaaagacccugggcccaggcccuggucugaugucaggccugauacaccagguguuuguggucggggaaucccagugucacuugaaugggcugugacauuaugggucugggagagcugagcuuuggggacacaggucauuuuacuguaguauucauggaaaccaagggaaguauuggcuuuucugcugugagcaagaggagcagcuggggcugcaagcugguggggaggagagaacccaccugagagaaaccucaggacuggggucaaguccugaccaccagaguccagagagacaugaaggacugugaccagcucugagcagagagauggauuccaugaccucaacuggucccuuuuguucggagacucgugacuggacuucauucauccacucauucauucauucacucagcagacacuuaucuagcgcucccuguggcugguccugccucauacugucuuugcucuggagaauuggagguugggguuccugaggggcaggguccuggagacaaggacacuccuggguagaauuaggaccuaccccccaggaaaucaacggggaccaggugccguggcucacaccuguaaucccagcacuuugggaggccgagacgggcggaucacaaggucagcaguucaggaccagccuggccaacauggugaaacccgccucaacuaaaaauacaaaaauuagccagguguggugucaggcacccguaaucccagcuacugaggaggcugaggcaggagaauugcuugaacccgggaggcagagguugcagugagccgagauugcgccacugcacuccagccuggcgacagggcgagacuccaucucaaaaaaagaaaaccaaugggacagggcagauauggggacaaugguaaggagaugggagagugggagggaggugucaggaagaccuucuugacuucauguaggcugguggggguguuagccagcaagccuccaguucccugggaaccguucucaggguaccaauuuuaccaccugucugcaaacacuuuaagauucuuaaucagacucaaauuggccacaaaucagguaaacaaacucacuagugggguggggcuaccacccguucugacccuccagcccaacccagcccagccacccugcccuccguagagccugugguguuuaucgguggcauugggagaauuaguguguauuuauguuggcguggggugugggguggauuugugugugugcaguuaggccuaguggaaggaaugugggaucugaaggcaggccagccugaguuccaguccugccuguugcucacaagcuuuaugaggcgagagcuaaccccugccagccucaguugucuucuuugcaagauggagguugcagccccagucucuggagcauguuaugcagauccaccgagagugccugccaggcacacaguaggugcucagcucaguuacuguggcggcccccacuccccauuguuguuguuuuccuauugccuggcggccacagcugguaucccuugaaaagggcuacaggggguggagucggacccugccccagcccuguggagacccugggcuugggccagggccuggggucugggccugcagacagcugugucuauaaagcagcugaagggcugaggccgggggagguccuggcagcagggcguuauuuugggccuggccugccacccccagcuccuguuucucuugggagucuguugggggaggaaguguggggaagaggagggggugcaagugggugaggcauggaguggggaggccucccucagggacauggacccuugaguucuauuucuguuccucccuccuguuccucccucuuuguccuuaucugccuagagaggugggaauagaggccauucugaguaucacuaggagaccaccaguuuguggccacuggccacuggcccaggcagggaaccugggggcuugcccuaccagccucucccagcaaucugaaggcaggggguaccucguauuacccccuaggauuugaccuuaggcuccaacuugcugggagagcagugccucuggugucagaccccaagccagcccuugugcugucccugaaucugcauguagccugugggaggcggagcagugaccggcaggaauucugggcagcucaggcaccugugggccugagggugcccucugcccccacccuuccgaucuccugggcaagacacgccaggugauucaucucaccagagcagaaaaacaaguucaacugggcacuuuaaucuccccucacuggcaggccuggugugagcugcuaccccggcgccccucaccaggggugcuuuaccuccucuaguauuccugaccuuagugggcauuucuggucucagggauaccaggcugggguccaagugggccagguguggcaguucagcccuaugccccauggcugauggcucgcgcugggcagguaugcagggcugacguagugccuuuguggcagcaguuucguggcacacauucugccagcugguucuggagucuugcccugaggagguggccagggugagggugccagcgcaggaaccuuuggcgcaugcuucacccuggccugggaucugcagccuggguccagaugcccacaacuggaaucugacgcuccuuuucucuucaugggggacucccagaggucucugcaaugaccagagccccgguugucccaugccucagcugcaacuccagcugacccuccuuccccacucucuggguggcauuacggggguguggaucccuugccaagagguuggcaugugggugugcuggaauggcauagggagaaugcaccgaguuuguuugcuugggagaggggcaggggguauccagaagauucaugauucgucaucgccucucuugggggauuuuuaccccuuugcccugaguugugccuuugggacaaaggaagccuuucuuugccagccaacacccuguacuggcgggcgagcuccccagggcuggcacgcuggggcagccucugaaugcacagggugggccuagucagaagaagccuuuccccugaaaucccucuacuucccaagcacgcaagcuuucuccugcuguuaaaccugcagugugcaagggacaugggcggagggguccuucagucaggcuucucccugucugagguggcaugacuuggagugaguuuggaugggguggccaggucugagaaggucccccgccaguguccucugacccaucugcucucuccugccagugugcaccggcacagacaugaagcugcggcucccugccagucccgagacccaccuggacaugcuccgccaccucuaccagggcugccagguggugcagggaaaccuggaacucaccuaccugcccaccaaugccagccuguccuuccugcaggugaggcccgugggcaacccagccaggcccugccuccagcugggcugagcccucuguuuacagguggguggcagaagaaggugcccugcccuucuguuuccucucuuguugugguuucucaaccaggaaguccuuucuaacaucuaacccccauucauuuuacugcagaaucaguugacucucucuauaacguggcuggccgaggucaugucuggaugggaugcgucuguguuuccgcuaaaucuugugcucucuugccagcaugaucauguccccuguccaccugcuccagccacuaucccucucccacuuacagcagaagaaagggcuggugagaaagguggauuacaggcccacuucugccacugacgagcccuaugaauguggccuacacccccuuagcuucacugggucucaguuucccuaucuguauauugggagcaguugugaagcucagaagagaaaugucugugaaaagguuaugaacaggagggagaguggaaaccaaccugcuggaucguguccacagacccuggaauggggccacaugcuugguuugucaaauugcagacgccggccgggugcgauggcucaugccuguaaucccagcacuuugggaggccgaggcggacagaucacuugaggucgggaguucgagaccagccugaccaacauggagaaaccccgucucuacugaaaauacaaaauuagccaggcaugguggcacaugccuauaaucccagcuacuugggaaggcugaggcaggagaaucacuugaaccugggagacggagguuguggugagccuagaucgugccauuguacuccagccugggcaacaagagugaaacuccgucucaaaaaaaaaaaauuugcagacgccaucccauccaggccuuugcuuucacugaugaagaaacugagauacagagagggcagggcaccuguucggaguuuaugaaaugcccccccaccauuaucuuucuugaucauauaagaaucuggugaggcaagguagggcgugaucuuuaucucuauuuuaucguuuuauuuaagcgggaacaggacugcucaguggcugggggccuugcccaagaucuccaaguacuggggaaccccagggaggcccugggggguggcaguguuccuauuucagccccacucugcuucccccucccaggauauccaggaggugcagggcuacgugcucaucgcucacaaccaagugaggcaggucccacugcagaggcugcggauugugcgaggcacccagcucuuugaggacaacuaugcccuggccgugcuagacaauggagacccgcugaacaauaccaccccugucacaggggccuccccaggaggccugcgggagcugcagcuucgaagccucacagguggccuucaccgucauugaaaccuucucuugguuauucagagcugaccagggccacugcuaaccagggggaggcuuugugugcauuagaaauggugucccuucugggcagacgcaggcagagcccgggaagacgcccucagaagauuggaaaaagauuccccuucuuccugggaaguuguagcuugcgucagcacauauaauucaaucgugagaaugcaggcuggguuuuugcccccacuuggcugagugaaguguacagugaacaaccuauguaacuauuugcuggcccuggagccgacucugccccagagucugggugccaggugcuuugcccgcauggcccauuucagucacgcugcaguccugucaggaaaaaaucaguguuauucucauucuacauaugagaaaacugaggcuugcagauauaagggccaaaaguuacacagcuagugagugauggggcugaguuucagacuccacagucucuuaaccaccaagcagcaugcccagaguagaggugagaaggaaggagagagcugcgguccacaugagcaucuggaccuagcauggacaacucacuccucccuggcucucgcuuuguucuuguugcggguguggugguggugggacucaaagacgguaaagauagcuuucucuccucccuggggaaucuggggguuguuuaaaaggccugcuccucuuuuagaaggcaggagggccccaagggaagcagaaggugacagaaggggaaaggguccucugaucauugcucaccccacagagaucuugaaaggaggggucuugauccagcggaacccccagcucugcuaccaggacacgauuuuguggaaggacaucuuccacaagaacaaccagcuggcucucacacugauagacaccaaccgcucucgggccuguaagccaugccccucccugcugccucuucucucagacagccugaccccagccgcaaacucccaacuuacaacccagugccugcccgccacugccccagccgccuacaccacccauuuccucccucucugucccuccugccaucucccugugccucuucaucucugggguucucugucuugucucccucugcuuauagguugugccucugguuugggggccucucagccugucugggucccucccuugcugugcaguuggccucguggccucugcugcuguuugugccucucucuguuacuaacccguccucucgcuguuagacaucucucucacugccugucucugguucuguccucaggccaccccuguucuccgauguguaagggcucccgcugcuggggagagaguucugaggauugucagagccgugagucucagggaggccuggagucagggaaggggagggcuggggccggguggaaugcaggugucauacaggugacaugggaggggugggauaacaggcuugggaugucuccccugggccagguagucucccuagaaggugaugcugaugagggucuggugcccagggcgccacucagcccucauccugcccuuugcccaacagugacgcgcacugucugugccgguggcugugcccgcugcaaggggccacugcccacugacugcugccaugagcagugugcugccggcugcacgggccccaagcacucugacugccugguaugugccucugcuuugugcccaaugugcucuaccccccaggaugcaaggggugggcacccugccugguacugcccuauugccccuggcacaccagggcaaaacagcacagugaaagccagccaccuguccccccaggccugccuccacuucaaccacaguggcaucugugagcugcacugcccagcccuggucaccuacaacacagacacguuugaguccaugcccaaucccgagggccgguauacauucggcgccagcugugugacugccugucccugugagugccagggagaaacacaguuuucucauuuugguggggagguuuguuucuguaaaugggagcauauggggagcacugucugcaucuugcuuugagagcuggucaugacaguuccugccgagcugccuuguucuuucaacagcuguggagcagguggcaguaaggagaggcagcuaagagcccagacuugggagccagacugccuggguuugaaacccagcucuaucaauuaguaggcacgugacccucuugcugugccucaguuuccucaucaguaaaaugggggcaagaauagucccaacugcauaagaugguuauaacauuugaaagaguuaauauuuguaaagcucuuagaacggugccugguauguacuaagugcuccuaaauguuagcuuuuauucuauagccuggugaggucaguuuuaccuuucguuuuguuuuugagaccgaauuuaguuagcucuaucgcaguggcgcgaucucggcucacugcaaccuccgccucccagguucgugcuauucucgugucucagccuccugaguagcugggauuacaggcgcccaccaccaugccucgcuaaauuuuguauuuuuaguagagacaggguuucaccacguuggccagacuggucucgaacuccugacuucaggcgauccaccugccucggccucugaaagugcugggauuacaggcgugagccacugcacccggacuuuuuuuuuuuuggcagagucucgcuccauugcccaggcuggagugcaguggugcaauuuuggcucacugcaaccucugccuuccgcauucaagcaauucuugugccucagacucuugaguagguggaacuacaggcaugcaccaccauggcuggguaauuuuuguauuuuuaguagagacggaguuucacuauguuggccaagcuggucucgaacuccugaccucaagugauccacccgccuuggucucccaaagugcugggauuacaggcaugagccaucgugccuggccuagcucaguuuuauuuaacagaucaccuauuuacugaugggcguuuauggacugggcucagaccuggggaaccucuuuccuccucucacaggaacaggagugggccuucagauccuggcugacuguguuagggagaggacaaaauguagagccagaccauuuggguucaaauccucgcuccuccacucacuagcacaaugaccuugaauaauuuacagaacucucugcuuuggucucccuuuuugcaaaaugggaaucucacagugcugaucccgucugguuguugugagggguaaauggaugucaggugcugaugcgugguagggcauuuaaguauugguugauauuauucuucuugugccugggcacgguaaugcugcucaugguggugcacgaagggccaggguauguggcuacauguuccugaucuccuuagacaacuaccuuucuacggacgugggauccugcacccucgucugcccccugcacaaccaagaggugacagcagaggauggaacacagcggugugagaagugcagcaagcccugugcccgagguacccacucacugcccccgaggccagcugcaguuccugucccucugcgcaugcagccuggcccagcccacccuguccuauccuuccucagacccucuugggaccuagucucugccuucuacucucuaccccuggccccccucagcccuacaagugucccuauauccccugucaguguggggaggggcccggacccugaugcucauguggcuguugaccugucccgguaugaaggcugagacggccccuuccccacccacccccaccuccucagugugcuauggucugggcauggagcacuugcgagaggugagggcaguuaccagugccaauauccaggaguuugcuggcugcaagaagaucuuugggagccuggcauuucugccggagagcuuugauggguaagagugggcacgaugaccugagacagugucagggcagacagaguccugaggauccagauguggcagcaucucuuggggauggcaggagacagaaguggggggaucaagaaugcaaagaaagcagaugggagaccagaggagcagggccuuuggugggugggggugauuauuuuuguaaaugacaugcuauccgugaacaaggacuuguauggaggucagaccaucuagauaaaguaaaauucccuuugaguucauagcagcuuuauucaaaauauccccaaauuggaaauaacucaaaugugcaucacuaggugaaggaauaaacaaguggcaguguauccauuuggugaaguucuacuuagcaaccaaaggaaaugaacuaccgauacaacauaaaugaaucucagaaacauuacauugagcaaaagaagccagagacaagauuccauacugucugauccccuuuaugugaggcucugaaccgaaaaaaccacucuguggugggagagaucagaacggugguugccccaggguggggggcuucaaaagggaggcacacaaggacauuucugggguaauagaaaugcucuguauagugauugggguaguggauacaugagcgaauccauuugucaaaacucaucaaacugugugauaagagucugugcauuuuauuuauuucauuuuauuuuuugagauagagucucacucugucagcaggcuggagugcagugguacgaucuuggcucacugcaaccucugccuccuggauucaagcaauucuccugccucagucuccugaguagcugggacuacaggugugugccaccaugcccagcuaauuuuuguauuuuuaauagagaugggguuucaccauguuggcaaggauggucucgaucucuugacgucgugauccgcccaccucagccucccaaagugcugggauuacaggcaugagccaccacacccggugcauuuuauuguauauaaguuauacuucaauaagaaaugaauuggggccaggcacgguggcucacgccuguaaucccagcacuuugggaggccgaggcaggcagaucacuugaggucaggaguucaagaccagccuggccaacauggugaaaccccaucucuacuaaaaaauauaaaaaauuagccaggcuuccuggcaugcgccuaucaucccagcuacuugggaggcugaggcaggagaauugcaugaacucgggagguggagguuguagugagcugagauuucgcuauugcacuccagccugggcgacagagugagacccugucucaaaaagaaaaaaaaaaaaaagggucaggcgccguggugcacaccuguaaucccagcacuuugggaggcugaagcaggaagauugcuugagcccaggaauucaagaacagcgugggcaacauagugagaucccaucucuacaaaaaaacacaaaaaauuagccgggcauggugguacgcaccuguagucucagcuacuagggagacugaggugggagaaucaccugagccugggagguggagguugcaguggguugaaaucaugucacuguacuccagccugggugacagaaugagacccugucucaaaaaaaaaaaaaaaaaaaaaauucccuuucacacuuccuuuaccuccacuccccuuuccagagggggccaugguuaacaguguguguguucaccuagaccguuuaugcaucuguagacacacacacagugaagugugguuuucgucguuuugguggggagguugguuucuguaaaugggaacauauagggagcacugucugcaccuugcuuugagagccggucaugacaguucccauugaacugccuuguucuuucaauagcugcagagcagguggcggcaaggagaggcagcuaagagcccagacuugggagccagacugccuggguuugaaacccggcucuaccacuuacuaggcaugugacccuugugcugugccucaguuucuucaucuguaaagugggggcaagaacagucccaacuucauaagaugguuauaccaccaugccuggccagaugauuauaaaguuugaaugaguuaauauuuguaaagcucuuagaacagugccuggcagauacuaggugcuccuaaauguugguuuuuauuauguggcuggguggcucgggguuuuauuuaacagcuccccuauuuacuaauagacauuuagaucauguuccauuuucacucuuacaaacaguuccacuuuguguguggcucugggaacaugggccagugucucccuaggccacauuccuagaaauaagauuucuuuucuuuuuuuuuuuuuuuugagacagagucucgcuuuaucgccaggcuggugugcaguagugugaucucggcucacugcaaccucugccucccggguucaagugauucuccugccucagccucucgaguaacugggacuauaggcgcgcggcaccacacccagcuaauuuuuguauuuguaguagagaugggguuucaccauguuggccaggauggucuccaucucuugacuucgugauccgcccgccucggccucccaaagugcugggauuacaggcgugagccacugagcccaggcagaaauaagauuucuagaucaaaggauauaaauacuguuuugauagauguugccgaacuaaggccugggcuuugaagcccaggaugggaacagcugggcucgaugggcaaaggguuugagugaaggcauucaugguggggaguggcuggcauggccagugcugggagugauguccacccuguuccuggcccugcugacuccucuccugaccccuccagggacccagccuccaacacugccccgcuccagccagagcagcuccaaguguuugagacucuggaagagaucacaggugggcucugucucugcauccuguucugcaggggcugggaguccuuguccuguccccacuccuuuaaucucacccucugccugcagguuaccuauacaucucagcauggccggacagccugccugaccucagcgucuuccagaaccugcaaguaauccggggacgaauucugcacaagugagcacugagaaagagggggccugauggggaggagucccagggaggagucccugugggaagcuuugggccugagggaguacuccuguagcaguaaccuuuccaugaaagucugcagagugugcuggggauggaggaagaugagaauagccuuugcugaccgggaagggguccgugguaaggugcccaccuuucucccauaguggcgccuacucgcugacccugcaagggcugggcaucagcuggcuggggcugcgcucacugagggaacugggcaguggacuggcccucauccaccauaacacccaccucugcuucgugcacacggugcccugggaccagcucuuucggaacccgcaccaagcucugcuccacacugccaaccggccagaggacgagugugguaagacagggagcccagugugcgcacuccccaucugccagcacacagcagugcccagggggcccuggcagcagcguucuuggacuugugcagacugcccgucucugugcacccuucuugacucagcacagcucuggcuggcuuggccucuuggcauggcuucucuagcuggguccuaccugccuuggcauccuucccucccccucuguuucugaaaucucagaacucuuccucucccuacaucggccccaccuguccccaccccuccagcccacagccaugcccacagccaguucccugguucacuuggaccuggggccuccccuaaaaguccccugcggucccuuccuccucacugcagugggcgagggccuggccugccaccagcugugcgcccgagggcacugcugggguccagggcccacccagugugucaacugcagccaguuccuucggggccaggagugcguggaggaaugccgaguacugcagggguaugaggggcggaggagaggguggcuggaggggugcauggggcuccucucagacccccucaccacugucccuucucucaggcuccccagggaguaugugaaugccaggcacuguuugccgugccacccugagugucagccccagaauggcucagugaccuguuuuggaccggugagcugcuggcgggcucagagcuggguggaggggggcagcgagggggauugccagggacuuggcaggauggcgagaugcaguagggugugcuaucugguaaaauaucccuggagagggcucagcgcucagaccugaacagcaacagaguggcagaaaaggggccugggggacacuggggcccuucagacuaugaaaagguucuaaggaggucuguguugguggcugugacuguggcugugcuaggguggugagcccugugggcucaggcgucagacuaccuggauucagacccagcuccugcuuccaaccuugguuuuuuauuccuaaaauggguauuguaauaauaccuaccuugcugggguguggcaagaaugaaauuaaacagggcuuggcacagugaagcacgggaaaggcuuucuacagagcagugacuguuguuacucgcuguuacaccuuagguaaugcguuuuccucucugggugccucccauuuucuggcucaagucccugcccaggaucaagcuuggaggagggccccgagggaggggccacagagacugggugaagagcaaggguguuugucccaggagcauggcgaaaauugcugcuggguggccuugggaagcacaaaggggacccaacuaagggccugauccuacugcccugggggugucagugccagccccccacaaaucuuuucugccccccccaggaggcugaccaguguguggccugugcccacuauaaggacccucccuucugcguggcccgcugccccagcggugugaaaccugaccucuccuacaugcccaucuggaaguuuccagaugaggagggcgcaugccagccuugccccaucaacugcacccacucgugaguccaacggucuuuucugcagaaaggaggacuuuccuuucaggggucuuucuggggcucuuacuauaaaaggggaccaacucucccuuugucauaucuuguuucugaugacaaaaauaacacauuguuaaaauuguaaaauuaaaacaugaaauauaaauuaaugcccuagcaguucuauccccacuguuaauaauuugaaauauuuuuccucuaguuauuuuugucugugcacauucuaauauguauauauaaguuaacauauauuaauauuauucuccaguuauuuuuaucugugcacauuuuaacacacacacacacacacacacacacacacauauguauuuuuagacggaguuucacucugucgcccaggcuggagugcaguaguacaaucuuggcucacugcagccuccaccuccuggguuuaagcaauucuccugcuuccgccuccugaguagcugggauuacgggaacgugcuaccuugccuggcuaauuuuuguauuuuuaguacauaggauuucaccauguuggccaggcuggucucgaaccccugaccucaggugaucugccagccucggucccccaaaguguugggauuacagcggugagccaccaugcccagucauauauuucuuuuuaacaaauagaaucauagaucauacauauuguuugcaaauugcuuuuucucacuuuccagaaccuugaaauguuuuuccauguucuaacauggugaucuaccuuauucuuuuaauuuuucuuauuuaguugucuuuacacaugaaacacaugaauacauccuugugauaaacauuuucaguaacauaaaaguauaaauguuacaaagccaacgugcccuuucacucaacucccuguccacccagucucuccugucugcugggagaaccaccgcauugacuuguguguucacccuuccaggcucuuuucugcacacuuauauagacauacuacauuuauauuaggucgagucaaauaagauugcuguuuguguaaaccaaaaagugucaagagccugggcgcagugacucacaccuguaaucccagcacuuugggaggcugaggcaggcagaucacuugagaucaggaguucgagaccaaucuggccaacauagcgagaccccgucucuacuaaaaauacaaaaacuagccagguguggugaugcuguucugcacuuugcuuuccccccgacuugagguauccuuucuugugaguacagacggaucuaccaccuuuauuuuuuuuuuaauuacucaaccuguaacauggauguaauuucacuuuguuuuugagggauauugagcuuguuucccuguuuuugcaguuuauugcaauugagcuccacacacaagugagcccucuuuuguaugcccccuagugggaauacagugcuggcaauguuuaucacaaggauauauucaugcauuucaauuuaaagacaacuaaaugagaaaaauuaaaagaauauggauccaggcugggcaugguggcucacgccuguaaucccagcacuuugggaggccgaggcaggcagaucaccugaggucaggaguucaagaccagccuggccaacauggcaaaaccccgucucuacuaaaaauacaaaaauuagccaggcgugguggugggcgccuguaaucccagcuauuugagagguugagacaggagaauugcuugaaccugggcagcggagguugcagugagacgagauugcaccagugcacuccaaccugggcaacacagugcaacuccuucucaagaaaaaaaagaaaaaaaaaaagaauauggguccagauccauauggauccuagauccagaucacgguguuagaacauggaaaaacauugcaagauucugcuaagugaaaaaagcauuugcaaacaguauguacagucuauauucagaggaggaacugcugggucauagaugauauuucauagguauugccaaaccguucucuggagaagugguauggguuuacccugggauucuucuauggagggaauaguugagcucccgggcuugcucuucugggugccccuccccgcuuccuauccaccacaaggagcugcaggggagcggggcaugccgguuccuuggcuggagaaggagucuccuugugaggugguagaaggagcacugacggccuugagcccaguuucugccuuugucaaauggggauaaugacccagccacaccccucccaggguuguugugaggcuggaaaggugguucccaagagggugguucccagaauuguugaugagacuguuucuccugcagcuguguggaccuggaugacaagggcugccccgccgagcagagagccagguuggccuggaccccaggauguacccuucauugcccuucacucccccacuggaugcuggguggucacugcuguagggaggggacccccugacauaugucccuucccacccacucuuccacuguggaaccuccugucauuuuccacuucaccaagugacagaggaccugcucagaugcugaggggaggggacugcaaggaaagauggcuaggaaacccagucccuccacacccuagaguaacuugaugccuugugagggacacaggcaaaguucaauuccuuggaagucaagggagacugagaagaguacagcugcagcacugagggagugaugaauucuuaacuggggauggugggaggcuucgagugggagguggcauuugagcuaggcuuugagagaggagcagguauugcacuugcauuuagguagaaagcauuggggugcaaggugacacuggagggggaggcaucaggaaauccaggaugucuucaaaguucuggugucgggggcuguugaguaagcacaggaauaagggggucaaguuagagucaggguggggucugaccuggaugccauaggaccugauccccaagccacagggugggacuugacugggcaguggggaccuuuggaaaggacuuuggggagaaaaacagacuggagucugucuuaggcgaucaucgguccgugaaaugagcauguguuacaggcuugguauguaccagacccugugcuaagcaaggggguauggagaggagagggugacaagaauauuggaucaacacccgggagcuccaucuaucccaggaugcacuaucuuuuuuuuauuuuuuugagacggagucucacucugccugcaggcuggagugcaguggcuccaucucgguucacugcaaccucugccuccuggguucaagcgcuucuugugccucagccucccaaguagcugggauuacaggcacaugccaccacacccagcuaauuuuuguauuuuuaguagagacgggguuucaccauguuggccaggauggucucgaucucuugaccucaagauccgcccaccuuggccucccaaagugcugggauuacagacaugagccaccgugcccagccagauacgcuaucuuuuuauugagugauugagacagggucuugcucucuuguccagucuugaauguggugguguaaucacaggcucacugcagccuugaccuccugggcucaaguuacccuucugcaguagcugggacuauaggagcgugccaccacgccuggguaauuuaaaaaauuuuuuuuguauagacagggucucacuauguugcccgagcuggucucaaacucgugggcucaagugauccuccaguuuuggccucccaaaauguugggaucacaggagugagccaccacuccuggcgaugagccaagucuuuuuuuuuuuuuuuuuuuuuugauauggagucuugcucuguugcccaggcuggagugcaaugacacgaucuuggcucacugcaaccucugccucccagguucaagcaguucaagcaauccuccugucucagccccccaguagcugggauuacaggcaugcgcuaccacguccggcuaauuuuuguauuuuuaguagagaugagguuuugccauguuggccaggcuggucuugaacugcugaccucaggugauccaccugccucggccucccaaagugcugggauuacaggugugagccaucgugccuggcggagccgagucuuaaaagaugacccuguggagaaauggugguccaggcugaagggacagccuaugcaaacacugggagguguggaaaaucaugaccuguggguggaaauuuuggcuagaacaucaaaaucaucagguguacauuccuguacccaugcagcagucagaaucucuggggguggggccccaaaauuguaugcauacagacugugugcugauuugugauauuacuuaggauuuuuugacuuuacaaugguggaaaagcaauaauauacauucaguauaaaccguacuuugaauacccauacagccauucuguuuuucacuuuuauuuuuauuuauuuauuuauuuauuauuuauuuugagaugucauuuugcuguuguuacccaggcuggagugcaauggcgcagucuuggcucaccgcaaccuccaccucucagguucaaacgauucuccugcuucagccuccagaguggcugggauuacaggcaggcaccaccacacccggcuaauuuuguauuuuuaguagagacgggguuucuccauguuagucaggcuggucucgaacucgagagcucaggugaucugcccaucucagccucaagccaccaugcccagcccuacuuucaguauucaauaaauuacauagccaggcaccguggcucacaccuguaaucccagcacuuuaggaggccaaggugggaggauccuuugaggccagaagcucgagaccagccugggcaacauagugagaccccauuucuacaaaaaauaaaaaaacuagcugagugugguggcgugugucuguagucccagcuacuugggcagcugagguggaaagacugcuugagcccagaggucagggcugcagugggccaugaucucaccacugcacucagccugggcaacacagcaaggcccugucucaaaaauaaauaaauaaauaacacaaacuuauuuaacaguuuacuauaaaauaggcuuugugucagaugauucugcccaacuguaagcugcuggcaguguaaauguucugagcacguguaagccaggcuaggugucuuaaaugcauuuucaguuucaacuuagaauugguuuaucaggacguagccccuugguguugaggggcauguguauuaacagucuccuuagugacuuuuuuuuuuuugagauggagucuugcacuggccguagugcaguggcacaaucucagcucacugcaaccucuugucucccggguucaagcgauucuccugccucagucucccaaguagcugggauuacaggcacccacaccacgcccagcuaauuuuuguguguguguauuuuuaguagagacggggguuucacuauguuggccaggcuggucucgaacuccugaccuugugaucugcccaccucagacucucaaagugcuaggauuccaggcaugagccaccgcgcccagaguccuuagugauuuuuacaccaugaauuguugaagcccuaagccagagccaagggcaagaguauagagaaucuggagaugcggagaggguucugauugccuacaaggaguuuggacuuuauuguggaggcagcggggagccaaggcagguuuuagaguaggagaggguccaagccugugggucacccuuccgacuucccuuuccgaaugccaaacaccuucaugucccccgugggcccccuuugucccucccaccccaaacuagcccucaaucccugacccuggcuuccgcccccagcccucugacguccaucaucucugcggugguuggcauucugcuggucguggucuuggggguggucuuugggauccucaucaagcgacggcagcagaagauccggaaguacacgaugcggagacugcugcaggaaacggaggugaggcggggugaaguccucccagcccgcguggggucugcaccggcccccggcacugacccaccacccccucaccccagcugguggagccgcugacaccuagcggagcgaugcccaaccaggcgcagaugcggauccugaaagagacggagcugaggaaggugaaggugcuuggaucuggcgcuuuuggcacagucuacaaggucagggccagguccuggggugggcggccccagaggaugggggcggugccuggagggguguggucggcaguucugaugggaggggcaagagcuggaggcaguguuugggggagggcaguuacagcggagaagggagcggggccaagcccuaggguggugaaggauguuuggaggacaaguaaugaucuccuggaaggcagguaggauccagcccacgcucuucucacucauauccuccucuuucugcccagggcaucuggaucccugauggggagaaugugaaaauuccaguggccaucaaaguguugagggaaaacacaucccccaaagccaacaaagaaaucuuagacguaagccccuccacccucuccugcuaggaggacaggaaggaccccauggcugcaggucugggcucuggucucucuucauugggguuuggggagauaugacucccgcaaaccuagacuauuuuuuuggagacggagucuugcucugucacccaggcuggagugcaguggcguuaucucggcucacugcaaccuccaccuccuggacucaagcgauuuucaugccucaggcuccugaguagcugggauuacaagcgcccgcuaauuuuuuuuuuuuuuuugagacagagucucgcucugucacccaggcuagagugaaauggugcggucucagcucagccucccagguuaaagcgauucuucucccucagucuccugaguagcugggauuacaggcgcgagccaccacgcccggcuaauuuuuguauuuuuaguagagaugggauuucaccauguuggccagguuggugucaaacuccugaccucaugauccgcccgccucggccucccaaagugcugggauuacaggugugagccaccgugcccggccuaaucuuuguauuuuuaguagagacaggguuucaccauguuguccaggcugguacuuugagccuucacaggcugugggccauggcugugguuugugaugguugggaggcugugugguguuuggggguguguggucucccauacccucucagcguacccuuguccccaggaagcauacgugauggcuggugugggcuccccauaugucucccgccuucugggcaucugccugacauccacggugcagcuggugacacagcuuaugcccuauggcugccucuuagaccauguccgggaaaaccgcggacgccugggcucccaggaccugcugaacugguguaugcagauugccaagguaugcaccugggcucuuugcaggucucuccggagcaaaccccuauguccacaaggggcuaggauggggacucuugcugggcauguggccaggcccaggcccucccagaaggucuacaugggugcuucccauuccaggggaugagcuaccuggaggaugugcggcucguacacagggacuuggccgcucggaacgugcuggucaagagucccaaccaugucaaaauuacagacuucgggcuggcucggcugcuggacauugacgagacagaguaccaugcagaugggggcaagguuaggugaaggaccaaggagcagaggaggcuggguggaguggugucuagcccaugggagaacucugaguggccaccuccccacaacacacaguuggaggacuuccucuucugcccucccaggugcccaucaaguggauggcgcuggaguccauucuccgccggcgguucacccaccagagugauguguggaguuauggugugugaugggggguguugggaggggugggugaggagccauggcuggagggaggaugagagcugggauggggagaauuacggggccaccucagcaugugaagggagggaaggggcugccugugccccaccuugcagggucugugcacuucccaggauuagggaaagaccggguagggucugucuccuggcaucacaucucccccugcuaccugccaugaugcuagacuccugagcagaaccucuggcucaguacacuaaagcucccucuggcccucccacuccugacccugucucugccuuaggugugacugugugggagcugaugacuuuuggggccaaaccuuacgaugggaucccagcccgggagaucccugaccugcuggaaaagggggagcggcugccccagccccccaucugcaccauugaugucuacaugaucauggucaaaugugcguggcugagcugugcuggcugccuggaggagggugggagguccuggguggaggagcccacaaggggcaugaaaggggaccaggauguauguagacccaggagcccuaguauguuaggagccucaaaaccuucuuguaucccuuuuacagucaaaguccaaagccacucuugaggaacacucuuguacaaaauuaagcugggcacaguggcucaugccuguaaucccaguacuuuuggaggcugaggugggaggaucccuugaagccaggaguucaagaccagccugggcaacauagugagauccuaucucuacaaaaaauaaaaaaauuaucugggugugguggugugugccaguagucccagcuacucaggagaggcugaggcaggaagaucacuugagccuaguuuaagguugcaguaagcuaugauugcaccacugaaauccagccugggugacagagcgaaaccucaucucaaaaaaauaaaaaagcaaacaaaaagaaaaaaaaaauuaaaagggaaacuagaagagaugccaaagguucuggcugaagaccccagagucuggugcuacuucucuaccaccugagggcuuugggcugucccuugggacugucuagaccagacuggagggggagugggaggggagaggcagcaagcacacagggccugggacuagcaugcugaccucccuccugccccagguuggaugauugacucugaaugucggccaagauuccgggaguuggugucugaauucucccgcauggccagggacccccagcgcuuuguggucauccagguacugggccucugugccccaucccugccuguggcuaagagcacccuccugcagagggugggaaggagagaugaguccaguaugccaggccccucacggaaggcugcaugcugggcuggggaggggccaccauccugccucuccuuccuccacagaaugaggacuugggcccagccagucccuuggacagcaccuucuaccgcucacugcuggaggacgaugacaugggggaccugguggaugcugaggaguaucugguaccccagcagggcuucuucuguccagacccugccccgggcgcugggggcaugguccaccacaggcaccgcagcucaucuaccagggucagugcccucggucacacuguguggcugucugcuuaccucccccaaccccgguggacuagggucccuuucucugauguucccucaacugucaccucucaaggaaaccccauuaucccuacaaaaaauucuuacugccuuccaaccccugugaccccauucucuccacggugacugugucauaccccaaaggugaccucuguuuuucuccugugacccugucaccuuccauggaguccccaucccagauccgugagugacccccaucaugacuuucuuucuuguccccagaguggcgguggggaccugacacuagggcuggagcccucugaagaggaggcccccaggucuccacuggcacccuccgaaggggcuggcuccgauguauuugauggugaccugggaaugggggcagccaaggggcugcaaagccuccccacacaugaccccagcccucuacagcgguacagugaggaccccacaguaccccugcccucugagacugauggcuacguugccccccugaccugcagcccccagccugguauggaguccagucuaagcagagagacugaugggcaggggaggugggaccuucagcccaggguccacugugggggcagagggaguggcagagacaccgggguuccuuccccuaaugggucaccuucucuugaccuuucagaauaugugaaccagccagauguucggccccagcccccuucgccccgagagggcccucugccugcugcccgaccugcuggugccacucuggaaaggcccaagacucucuccccagggaagaauggggucgucaaagacguuuuugccuuugggggugccguggagaaccccgaguacuugacaccccagggaggagcugccccucagccccacccuccuccugccuucagcccagccuucgacaaccucuauuacugggaccaggacccaccagagcggggggcuccacccagcaccuucaaagggacaccuacggcagagaacccagaguaccugggucuggacgugccagugugaaccagaaggccaaguccgcagaagcccugauguguccucagggagcagggaaggccugacuucugcuggcaucaagaggugggagggcccuccgaccacuuccaggggaaccugccaugccaggaaccuguccuaaggaaccuuccuuccugcuugaguucccagauggcuggaagggguccagccucguuggaagaggaacagcacuggggagucuuuguggauucugaggcccugcccaaugagacucuaggguccaguggaugccacagcccagcuuggcccuuuccuuccagauccuggguacugaaagccuuagggaagcuggccugagaggggaagcggcccuaagggagugucuaagaacaaaagcgacccauucagagacugucccugaaaccuaguacugccccccaugaggaaggaacagcaauggugucaguauccaggcuuuguacagagugcuuuucuguuuaguuuuuacuuuuuuuguuuuguuuuuuuaaagaugaaauaaagacccagggggagaauggguguuguauggggaggcaagugugggggguccuucuccacacccacuuuguccauuugcaaauauauuuuggaaaacagcuaggcaccggccuaugucuggggguggcucugugccaucccuuccugcucaccuuacacucaauuccucuuuuccuggagggaguggcugggaaucuucagaaagcuuggaugaggagccagacauccaguucuccagcuucaggguugggggagaucgggaagcuggauucagaucugagagcccuuugacgaccagaucauucuuauuuagaacgaacuaauuccuaaggccacucaccagaaugggguuauuuccuccuugugagugaggagagugguggguagggugggggaaagacgaggcagggucuacugugggacucauuuuccuugccuuggcuaugccagaggagcucacugaccuaaggaguagcuguccagaaagcccacccagccagcacagccacccuggcggugcaaaggcugggcugaccggacuucugugccccccacauucccagacuggacguauaaaaacacacacuaguuagcauua

SEQ ID NO: 21278 - RNA, 29133 nt, Homo sapiens
uaaugcuaacuaguguguguuuuuauacguccagucugggaauguggggggcacagaaguccggucagcccagccuuugcaccgccaggguggcugugcuggcugggugggcuuucuggacagcuacuccuuaggucagugagcuccucuggcauagccaaggcaaggaaaaugagucccacaguagacccugccucgucuuucccccacccuacccaccacucuccucacucacaaggaggaaauaaccccauucuggugaguggccuuaggaauuaguucguucuaaauaagaaugaucuggucgucaaagggcucucagaucugaauccagcuucccgaucucccccaacccugaagcuggagaacuggaugucuggcuccucauccaagcuuucugaagauucccagccacucccuccaggaaaagaggaauugaguguaaggugagcaggaagggauggcacagagccacccccagacauaggccggugccuagcuguuuuccaaaauauauuugcaaauggacaaaguggguguggagaaggaccccccacacuugccuccccauacaacacccauucucccccugggucuuuauuucaucuuuaaaaaaacaaaacaaaaaaaguaaaaacuaaacagaaaagcacucuguacaaagccuggauacugacaccauugcuguuccuuccucauggggggcaguacuagguuucagggacagucucugaaugggucgcuuuuguucuuagacacucccuuagggccgcuuccccucucaggccagcuucccuaaggcuuucaguacccaggaucuggaaggaaagggccaagcugggcuguggcauccacuggacccuagagucucauugggcagggccucagaauccacaaagacuccccagugcuguuccucuuccaacgaggcuggaccccuuccagccaucugggaacucaagcaggaaggaagguuccuuaggacagguuccuggcauggcagguuccccuggaaguggucggagggcccucccaccucuugaugccagcagaagucaggccuucccugcucccugaggacacaucagggcuucugcggacuuggccuucugguucacacuggcacguccagacccagguacucuggguucucugccguaggugucccuuugaaggugcuggguggagccccccgcucugguggguccuggucccaguaauagagguugucgaaggcugggcugaaggcaggaggaggguggggcugaggggcagcuccucccuggggugucaaguacucgggguucuccacggcacccccaaaggcaaaaacgucuuugacgaccccauucuucccuggggagagagucuugggccuuuccagaguggcaccagcaggucgggcagcaggcagagggcccucucggggcgaagggggcuggggccgaacaucuggcugguucacauauucugaaaggucaagagaaggugacccauuaggggaaggaaccccggugucucugccacucccucugcccccacaguggacccugggcugaaggucccaccuccccugcccaucagucucucugcuuagacuggacuccauaccaggcugggggcugcaggucaggggggcaacguagccaucagucucagagggcagggguacugugggguccucacuguaccgcuguagagggcuggggucauguguggggaggcuuugcagccccuuggcugcccccauucccaggucaccaucaaauacaucggagccagccccuucggagggugccaguggagaccugggggccuccucuucagagggcuccagcccuagugucagguccccaccgccacucuggggacaagaaagaaagucaugaugggggucacucacggaucugggauggggacuccauggaaggugacagggucacaggagaaaaacagaggucaccuuugggguaugacacagucaccguggagagaauggggucacagggguuggaaggcaguaagaauuuuuuguagggauaaugggguuuccuugagaggugacaguugagggaacaucagagaaagggacccuaguccaccgggguugggggagguaagcagacagccacacagugugaccgagggcacugacccugguagaugagcugcggugccugugguggaccaugcccccagcgcccggggcagggucuggacagaagaagcccugcugggguaccagauacuccucagcauccaccaggucccccaugucaucguccuccagcagugagcgguagaaggugcuguccaagggacuggcugggcccaaguccucauucuguggaggaaggagaggcaggaugguggccccuccccagcccagcaugcagccuuccgugaggggccuggcauacuggacucaucucuccuucccacccucugcaggagggugcucuuagccacaggcagggauggggcacagaggcccaguaccuggaugaccacaaagcgcugggggucccuggccaugcgggagaauucagacaccaacucccggaaucuuggccgacauucagagucaaucauccaaccuggggcaggagggaggucagcaugcuagucccaggcccugugugcuugcugccucuccccucccacucccccuccagucuggucuagacagucccaagggacagcccaaagcccucaggugguagagaaguagcaccagacucuggggucuucagccagaaccuuuggcaucucuucuaguuucccuuuuaauuuuuuuuuucuuuuuguuugcuuuuuuauuuuuuugagaugagguuucgcucugucacccaggcuggauuucaguggugcaaucauagcuuacugcaaccuuaaacuaggcucaagugaucuuccugccucagccucuccugaguagcugggacuacuggcacacaccaccacacccagauaauuuuuuuauuuuuuguagagauaggaucucacuauguugcccaggcuggucuugaacuccuggcuucaagggauccucccaccucagccuccaaaaguacugggauuacaggcaugagccacugugcccagcuuaauuuuguacaagaguguuccucaagaguggcuuuggacuuugacuguaaaagggauacaagaagguuuugaggcuccuaacauacuagggcuccugggucuacauacauccugguccccuuucaugccccuugugggcuccuccacccaggaccucccacccuccuccaggcagccagcacagcucagccacgcacauuugaccaugaucauguagacaucaauggugcagauggggggcuggggcagccgcucccccuuuuccagcaggucagggaucucccgggcugggaucccaucguaagguuuggccccaaaagucaucagcucccacacagucacaccuaaggcagagacagggucaggagugggagggccagagggagcuuuaguguacugagccagagguucugcucaggagucuagcaucauggcagguagcagggggagaugugaugccaggagacagacccuacccggucuuucccuaauccugggaagugcacagacccugcaagguggggcacaggcagccccuucccucccuucacaugcugagguggccccguaauucuccccaucccagcucucauccucccuccagccauggcuccucacccaccccucccaacaccccccaucacacaccauaacuccacacaucacucuggugggugaaccgccggcggagaauggacuccagcgccauccacuugaugggcaccugggagggcagaagaggaaguccuccaacuguguguuguggggagguggccacucagaguucucccaugggcuagacaccacuccacccagccuccucugcuccuugguccuucaccuaaccuugcccccaucugcaugguacucugucucgucaauguccagcagccgagccagcccgaagucuguaauuuugacaugguugggacucuugaccagcacguuccgagcggccaagucccuguguacgagccgcacauccuccagguagcucauccccuggaaugggaagcacccauguagaccuucugggagggccugggccuggccacaugcccagcaagaguccccauccuagccccuuguggacauagggguuugcuccggagagaccugcaaagagcccaggugcauaccuuggcaaucugcauacaccaguucagcagguccugggagcccaggcguccgcgguuuucccggacauggucuaagaggcagccauagggcauaagcugugucaccagcugcaccguggaugucaggcagaugcccagaaggcgggagacauauggggagcccacaccagccaucacguaugcuuccuggggacaaggguacgcugagaggguaugggagaccacacacccccaaacaccacacagccucccaaccaucacaaaccacagccauggcccacagccugugaaggcucaaaguaccagccuggacaacauggugaaacccugucucuacuaaaaauacaaagauuaggccgggcacgguggcucacaccuguaaucccagcacuuugggaggccgaggcgggcggaucaugaggucaggaguuugacaccaaccuggccaacauggugaaaucccaucucuacuaaaaauacaaaaauuagccgggcgugguggcucgcgccuguaaucccagcuacucaggagacugagggagaagaaucgcuuuaaccugggaggcugagcugagaccgcaccauuucacucuagccugggugacagagcgagacucugucucaaaaaaaaaaaaaaaauuagcgggcgcuuguaaucccagcuacucaggagccugaggcaugaaaaucgcuugaguccaggagguggagguugcagugagccgagauaacgccacugcacuccagccugggugacagagcaagacuccgucuccaaaaaaauagucuagguuugcgggagucauaucuccccaaaccccaaugaagagagaccagagcccagaccugcagccaugggguccuuccuguccuccuagcaggagaggguggaggggcuuacgucuaagauuucuuuguuggcuuugggggauguguuuucccucaacacuuugauggccacuggaauuuucacauucuccccaucagggauccagaugcccugggcagaaagaggaggauaugagugagaagagcgugggcuggauccuaccugccuuccaggagaucauuacuuguccuccaaacauccuucaccacccuagggcuuggccccgcucccuucuccgcuguaacugcccucccccaaacacugccuccagcucuugccccucccaucagaacugccgaccacaccccuccaggcaccgcccccauccucuggggccgcccaccccaggaccuggcccugaccuuguagacugugccaaaagcgccagauccaagcaccuucaccuuccucagcuccgucucuuucaggauccgcaucugcgccugguugggcaucgcuccgcuaggugucagcggcuccaccagcuggggugaggggguggugggucagugccgggggccggugcagaccccacgcgggcugggaggacuucaccccgccucaccuccguuuccugcagcagucuccgcaucguguacuuccggaucuucugcugccgucgcuugaugaggaucccaaagaccacccccaagaccacgaccagcagaaugccaaccaccgcagagaugauggacgucagagggcugggggcggaagccagggucagggauugagggcuaguuuggggugggagggacaaagggggcccacgggggacaugaagguguuuggcauucggaaagggaagucggaagggugacccacaggcuuggacccucuccuacucuaaaaccugccuuggcuccccgcugccuccacaauaaaguccaaacuccuuguaggcaaucagaacccucuccgcaucuccagauucucuauacucuugcccuuggcucuggcuuagggcuucaacaauucaugguguaaaaaucacuaaggacucugggcgcgguggcucaugccuggaauccuagcacuuugagagucugaggugggcagaucacaaggucaggaguucgagaccagccuggccaacauagugaaacccccgucucuacuaaaaauacacacacacaaaaauuagcugggcguggugugggugccuguaaucccagcuacuugggagacugaggcaggagaaucgcuugaacccgggagacaagagguugcagugagcugagauugugccacugcacuacggccagugcaagacuccaucucaaaaaaaaaaaagucacuaaggagacuguuaauacacaugccccucaacaccaaggggcuacguccugauaaaccaauucuaaguugaaacugaaaaugcauuuaagacaccuagccuggcuuacacgugcucagaacauuuacacugccagcagcuuacaguugggcagaaucaucugacacaaagccuauuuuauaguaaacuguuaaauaaguuuguguuauuuauuuauuuauuuuugagacagggccuugcuguguugcccaggcugagugcaguggugagaucauggcccacugcagcccugaccucugggcucaagcagucuuuccaccucagcugcccaaguagcugggacuacagacacacgccaccacacucagcuaguuuuuuuauuuuuuguagaaauggggucucacuauguugcccaggcuggucucgagcuucuggccucaaaggauccucccaccuuggccuccuaaagugcugggauuacaggugugagccacggugccuggcuauguaauuuauugaauacugaaaguagggcugggcaugguggcuugaggcugagaugggcagaucaccugagcucucgaguucgagaccagccugacuaacauggagaaaccccgucucuacuaaaaauacaaaauuagccgggugugguggugccugccuguaaucccagccacucuggaggcugaagcaggagaaucguuugaaccugagagguggagguugcggugagccaagacugcgccauugcacuccagccuggguaacaacagcaaaaugacaucucaaaauaaauaauaaauaaauaaauaaauaaaaauaaaagugaaaaacagaauggcuguauggguauucaaaguacgguuuauacugaauguauauuauugcuuuuccaccauuguaaagucaaaaaauccuaaguaauaucacaaaucagcacacagucuguaugcauacaauuuuggggccccacccccagagauucugacugcugcauggguacaggaauguacaccugaugauuuugauguucuagccaaaauuuccacccacaggucaugauuuuccacaccucccaguguuugcauaggcugucccuucagccuggaccaccauuucuccacagggucaucuuuuaagacucggcuccgccaggcacgauggcucacaccuguaaucccagcacuuugggaggccgaggcagguggaucaccugaggucagcaguucaagaccagccuggccaacauggcaaaaccucaucucuacuaaaaauacaaaaauuagccggacgugguagcgcaugccuguaaucccagcuacuggggggcugagacaggaggauugcuugaacugcuugaaccugggaggcagagguugcagugagccaagaucgugucauugcacuccagccugggcaacagagcaagacuccauaucaaaaaaaaaaaaaaaaaaaaaagacuuggcucaucgccaggagugguggcucacuccugugaucccaacauuuugggaggccaaaacuggaggaucacuugagcccacgaguuugagaccagcucgggcaacauagugagacccugucuauacaaaaaaaauuuuuuaaauuacccaggcgugguggcacgcuccuauagucccagcuacugcagaaggguaacuugagcccaggaggucaaggcugcagugagccugugauuacaccaccacauucaagacuggacaagagagcaagacccugucucaaucacucaauaaaaagauagcguaucuggcugggcacgguggcucaugucuguaaucccagcacuuugggaggccaaggugggcggaucuugaggucaagagaucgagaccauccuggccaacauggugaaaccccgucucuacuaaaaauacaaaaauuagcugggugugguggcaugugccuguaaucccagcuacuugggaggcugaggcacaagaagcgcuugaacccaggaggcagagguugcagugaaccgagauggagccacugcacuccagccugcaggcagagugagacuccgucucaaaaaaauaaaaaaaagauagugcauccugggauagauggagcucccggguguugauccaauauucuugucacccucuccucuccauacccccuugcuuagcacagggucugguacauaccaagccuguaacacaugcucauuucacggaccgaugaucgccuaagacagacuccagucuguuuuucuccccaaaguccuuuccaaagguccccacugcccagucaagucccacccuguggcuuggggaucagguccuauggcauccaggucagaccccacccugacucuaacuugacccccuuauuccugugcuuacucaacagcccccgacaccagaacuuugaagacauccuggauuuccugaugccucccccuccagugucaccuugcaccccaaugcuuucuaccuaaaugcaagugcaauaccugcuccucucucaaagccuagcucaaaugccaccucccacucgaagccucccaccauccccaguuaagaauucaucacucccucagugcugcagcuguacucuucucagucucccuugacuuccaaggaauugaacuuugccugugucccucacaaggcaucaaguuacucuaggguguggagggacuggguuuccuagccaucuuuccuugcaguccccuccccucagcaucugagcagguccucugucacuuggugaaguggaaaaugacaggagguuccacaguggaagagugggugggaagggacauaugucaggggguccccucccuacagcagugaccacccagcauccagugggggagugaagggcaaugaaggguacauccugggguccaggccaaccuggcucucugcucggcggggcagcccuugucauccagguccacacagcugcaggagaaacagucucaucaacaauucugggaaccacccucuugggaaccaccuuuccagccucacaacaacccugggagggguguggcugggucauuauccccauuugacaaaggcagaaacugggcucaaggccgucagugcuccuucuaccaccucacaaggagacuccuucuccagccaaggaaccggcaugccccgcuccccugcagcuccuugugguggauaggaagcggggaggggcacccagaagagcaagcccgggagcucaacuauucccuccauagaagaaucccaggguaaacccauaccacuucuccagagaacgguuuggcaauaccuaugaaauaucaucuaugacccagcaguuccuccucugaauauagacuguacauacuguuugcaaaugcuuuuuucacuuagcagaaucuugcaauguuuuuccauguucuaacaccgugaucuggaucuaggauccauauggaucuggacccauauucuuuuuuuuuuucuuuuuuuucuugagaaggaguugcacuguguugcccagguuggagugcacuggugcaaucucgucucacugcaaccuccgcugcccagguucaagcaauucuccugucucaaccucucaaauagcugggauuacaggcgcccaccaccacgccuggcuaauuuuuguauuuuuaguagagacgggguuuugccauguuggccaggcuggucuugaacuccugaccucaggugaucugccugccucggccucccaaagugcugggauuacaggcgugagccaccaugcccagccuggauccauauucuuuuaauuuuucucauuuaguugucuuuaaauugaaaugcaugaauauauccuugugauaaacauugccagcacuguauucccacuagggggcauacaaaagagggcucacuuguguguggagcucaauugcaauaaacugcaaaaacagggaaacaagcucaauaucccucaaaaacaaagugaaauuacauccauguuacagguugaguaauuaaaaaaaaaauaaaggugguagauccgucuguacucacaagaaaggauaccucaagucggggggaaagcaaagugcagaacagcaucaccacaccuggcuaguuuuuguauuuuuaguagagacggggucucgcuauguuggccagauuggucucgaacuccugaucucaagugaucugccugccucagccucccaaagugcugggauuacaggugugagucacugcgcccaggcucuugacacuuuuugguuuacacaaacagcaaucuuauuugacucgaccuaauauaaauguaguaugucuauauaagugugcagaaaagagccuggaagggugaacacacaagucaaugcggugguucucccagcagacaggagagacuggguggacagggaguugagugaaagggcacguuggcuuuguaacauuuauacuuuuauguuacugaaaauguuuaucacaaggauguauucauguguuucauguguaaagacaacuaaauaagaaaaauuaaaagaauaagguagaucaccauguuagaacauggaaaaacauuucaagguucuggaaagugagaaaaagcaauuugcaaacaauauguaugaucuaugauucuauuuguuaaaaagaaauauaugacugggcaugguggcucaccgcuguaaucccaacacuuugggggaccgaggcuggcagaucaccugaggucagggguucgagaccagccuggccaacauggugaaauccuauguacuaaaaauacaaaaauuagccaggcaagguagcacguucccguaaucccagcuacucaggaggcggaagcaggagaauugcuuaaacccaggagguggaggcugcagugagccaagauuguacuacugcacuccagccugggcgacagagugaaacuccgucuaaaaauacauauguguguguguguguguguguguguguguguuaaaaugugcacagauaaaaauaacuggagaauaauauuaauauauguuaacuuauauauacauauuagaaugugcacagacaaaaauaacuagaggaaaaauauuucaaauuauuaacaguggggauagaacugcuagggcauuaauuuauauuucauguuuuaauuuuacaauuuuaacaauguguuauuuuugucaucagaaacaagauaugacaaagggagaguugguccccuuuuauaguaagagccccagaaagaccccugaaaggaaaguccuccuuucugcagaaaagaccguuggacucacgagugggugcaguugauggggcaaggcuggcaugcgcccuccucaucuggaaacuuccagaugggcauguaggagaggucagguuucacaccgcuggggcagcgggccacgcagaagggaggguccuuauagugggcacaggccacacacuggucagccuccuggggggggcagaaaagauuuguggggggcuggcacugacacccccagggcaguaggaucaggcccuuaguuggguccccuuugugcuucccaaggccacccagcagcaauuuucgccaugcuccugggacaaacacccuugcucuucacccagucucuguggccccucccucggggcccuccuccaagcuugauccugggcagggacuugagccagaaaaugggaggcacccagagaggaaaacgcauuaccuaagguguaacagcgaguaacaacagucacugcucuguagaaagccuuucccgugcuucacugugccaagcccuguuuaauuucauucuugccacaccccagcaagguagguauuauuacaauacccauuuuaggaauaaaaaaccaagguuggaagcaggagcugggucugaauccagguagucugacgccugagcccacagggcucaccacccuagcacagccacagucacagccaccaacacagaccuccuuagaaccuuuucauagucugaagggccccagugucccccaggccccuuuucugccacucuguugcuguucaggucugagcgcugagcccucuccagggauauuuuaccagauagcacacccuacugcaucucgccauccugccaagucccuggcaaucccccucgcugccccccuccacccagcucugagcccgccagcagcucaccgguccaaaacaggucacugagccauucuggggcugacacucaggguggcacggcaaacagugccuggcauucacauacucccuggggagccugagagaagggacaguggugagggggucugagaggagccccaugcaccccuccagccacccucuccuccgccccucauaccccugcaguacucggcauuccuccacgcacuccuggccccgaaggaacuggcugcaguugacacacugggugggcccuggaccccagcagugcccucgggcgcacagcugguggcaggccaggcccucgcccacugcagugaggaggaagggaccgcaggggacuuuuaggggaggccccagguccaagugaaccagggaacuggcugugggcauggcugugggcuggagggguggggacagguggggccgauguagggagaggaagaguucugagauuucagaaacagagggggagggaaggaugccaaggcagguaggacccagcuagagaagccaugccaagaggccaagccagccagagcugugcugagucaagaagggugcacagagacgggcagucugcacaaguccaagaacgcugcugccagggcccccugggcacugcugugugcuggcagauggggagugcgcacacugggcucccugucuuaccacacucguccucuggccgguuggcaguguggagcagagcuuggugcggguuccgaaagagcuggucccagggcaccgugugcacgaagcagagguggguguuaugguggaugagggccaguccacugcccaguucccucagugagcgcagccccagccagcugaugcccagcccuugcagggucagcgaguaggcgccacuaugggagaaaggugggcaccuuaccacggaccccuucccggucagcaaaggcuauucucaucuuccuccauccccagcacacucugcagacuuucauggaaagguuacugcuacaggaguacucccucaggcccaaagcuucccacagggacuccucccugggacuccuccccaucaggcccccucuuucucagugcucacuugugcagaauucguccccggauuacuugcagguucuggaagacgcugaggucaggcaggcuguccggccaugcugagauguauagguaaccugcaggcagagggugagauuaaaggaguggggacaggacaaggacucccagccccugcagaacaggaugcagagacagagcccaccugugaucucuuccagagucucaaacacuuggagcugcucuggcuggagcggggcaguguuggaggcugggucccuggaggggucaggagaggagucagcagggccaggaacaggguggacaucacucccagcacuggccaugccagccacuccccaccaugaaugccuucacucaaacccuuugcccaucgagcccagcuguucccauccugggcuucaaagcccaggccuuaguucggcaacaucuaucaaaacaguauuuauauccuuugaucuagaaaucuuauuucugccugggcucaguggcucacgccuguaaucccagcacuuugggaggccgaggcgggcggaucacgaagucaagagauggagaccauccuggccaacauggugaaaccccaucucuacuacaaauacaaaaauuagcuggguguggugccgcgcgccuauagucccaguuacucgagaggcugaggcaggagaaucacuugaacccgggaggcagagguugcagugagccgagaucacacuacugcacaccagccuggcgauaaagcgagacucugucucaaaaaaaaaaaaaaaagaaaagaaaucuuauuucuaggaauguggccuagggagacacuggcccauguucccagagccacacacaaaguggaacuguuuguaagagugaaaauggaacaugaucuaaaugucuauuaguaaauaggggagcuguuaaauaaaaccccgagccacccagccacauaauaaaaaccaacauuuaggagcaccuaguaucugccaggcacuguucuaagagcuuuacaaauauuaacucauucaaacuuuauaaucaucuggccaggcauggugguauaaccaucuuaugaaguugggacuguucuugcccccacuuuacagaugaagaaacugaggcacagcacaagggucacaugccuaguaagugguagagccggguuucaaacccaggcagucuggcucccaagucugggcucuuagcugccucuccuugccgccaccugcucugcagcuauugaaagaacaaggcaguucaaugggaacugucaugaccggcucucaaagcaaggugcagacagugcucccuauauguucccauuuacagaaaccaaccuccccaccaaaacgacgaaaaccacacuucacugugugugugucuacagaugcauaaacggucuaggugaacacacacacuguuaaccauggcccccucuggaaaggggaguggagguaaaggaagugugaaagggaauuuuuuuuuuuuuuuuuuuuuugagacagggucucauucugucacccaggcuggaguacagugacaugauuucaacccacugcaaccuccaccucccaggcucaggugauucucccaccucagucucccuaguagcugagacuacaggugcguaccaccaugcccggcuaauuuuuuguguuuuuuuguagagaugggaucucacuauguugcccacgcuguucuugaauuccugggcucaagcaaucuuccugcuucagccucccaaagugcugggauuacaggugugcaccacggcgccugacccuuuuuuuuuuuuuucuuuuugagacagggucucacucugucgcccaggcuggagugcaauagcgaaaucucagcucacuacaaccuccaccucccgaguucaugcaauucuccugccucagccucccaaguagcugggaugauaggcgcaugccaggaagccuggcuaauuuuuuauauuuuuuaguagagaugggguuucaccauguuggccaggcuggucuugaacuccugaccucaagugaucugccugccucggccucccaaagugcugggauuacaggcgugagccaccgugccuggccccaauucauuucuuauugaaguauaacuuauauacaauaaaaugcaccgggugugguggcucaugccuguaaucccagcacuuugggaggcugaggugggcggaucacgacgucaagagaucgagaccauccuugccaacauggugaaaccccaucucuauuaaaaauacaaaaauuagcugggcaugguggcacacaccuguagucccagcuacucaggagacugaggcaggagaauugcuugaauccaggaggcagagguugcagugagccaagaucguaccacugcacuccagccugcugacagagugagacucuaucucaaaaaauaaaaugaaauaaauaaaaugcacagacucuuaucacacaguuugaugaguuuugacaaauggauucgcucauguauccacuaccccaaucacuauacagagcauuucuauuaccccagaaauguccuugugugccucccuuuugaagccccccacccuggggcaaccaccguucugaucucucccaccacagagugguuuuuucgguucagagccucacauaaaggggaucagacaguauggaaucuugucucuggcuucuuuugcucaauguaauguuucugagauucauuuauguuguaucgguaguucauuuccuuugguugcuaaguagaacuucaccaaauggauacacugccacuuguuuauuccuucaccuagugaugcacauuugaguuauuuccaauuuggggauauuuugaauaaagcugcuaugaacucaaagggaauuuuacuuuaucuagauggucugaccuccauacaaguccuuguucacggauagcaugucauuuacaaaaauaaucacccccacccaccaaaggcccugcuccucuggucucccaucugcuuucuuugcauucuugauccccccacuucugucuccugccauccccaagagaugcugccacaucuggauccucaggacucugucugcccugacacugucucaggucaucgugcccacucuuacccaucaaagcucuccggcagaaaugccaggcucccaaagaucuucuugcagccagcaaacuccuggauauuggcacugguaacugcccucaccucucgcaagugcuccaugcccagaccauagcacacugaggagguggggguggguggggaaggggccgucucagccuucauaccgggacaggucaacagccacaugagcaucaggguccgggccccuccccacacugacaggggauauagggacacuuguagggcugaggggggccagggguagagaguagaaggcagagacuaggucccaagagggucugaggaaggauaggacagggugggcugggccaggcugcaugcgcagagggacaggaacugcagcuggccucgggggcagugaguggguaccucgggcacagggcuugcugcacuucucacaccgcuguguuccauccucugcugucaccucuugguugugcagggggcagacgagggugcaggaucccacguccguagaaagguaguugucuaaggagaucaggaacauguagccacauacccuggcccuucgugcaccaccaugagcagcauuaccgugcccaggcacaagaagaauaauaucaaccaauacuuaaaugcccuaccacgcaucagcaccugacauccauuuaccccucacaacaaccagacgggaucagcacugugagauucccauuuugcaaaaagggagaccaaagcagagaguucuguaaauuauucaaggucauugugcuagugaguggaggagcgaggauuugaacccaaauggucuggcucuacauuuuguccucucccuaacacagucagccaggaucugaaggcccacuccuguuccugugagaggaggaaagagguuccccaggucugagcccaguccauaaacgcccaucaguaaauaggugaucuguuaaauaaaacugagcuaggccaggcacgauggcucaugccuguaaucccagcacuuugggagaccaaggcggguggaucacuugaggucaggaguucgagaccagcuuggccaacauagugaaacuccgucucuacuaaaaauacaaaaauuacccagccaugguggugcaugccuguaguuccaccuacucaagagucugaggcacaagaauugcuugaaugcggaaggcagagguugcagugagccaaaauugcaccacugcacuccagccugggcaauggagcgagacucugccaaaaaaaaaaaaguccgggugcaguggcucacgccuguaaucccagcacuuucagaggccgaggcagguggaucgccugaagucaggaguucgagaccagucuggccaacguggugaaacccugucucuacuaaaaauacaaaauuuagcgaggcaugguggugggcgccuguaaucccagcuacucaggaggcugagacacgagaauagcacgaaccugggaggcggagguugcagugagccgagaucgcgccacugcgauagagcuaacuaaauucggucucaaaaacaaaacgaaagguaaaacugaccucaccaggcuauagaauaaaagcuaacauuuaggagcacuuaguacauaccaggcaccguucuaagagcuuuacaaauauuaacucuuucaaauguuauaaccaucuuaugcaguugggacuauucuugcccccauuuuacugaugaggaaacugaggcacagcaagagggucacgugccuacuaauugauagagcuggguuucaaacccaggcagucuggcucccaagucugggcucuuagcugccucuccuuacugccaccugcuccacagcuguugaaagaacaaggcagcucggcaggaacugucaugaccagcucucaaagcaagaugcagacagugcuccccauaugcucccauuuacagaaacaaaccuccccaccaaaaugagaaaacuguguuucucccuggcacucacagggacaggcagucacacagcuggcgccgaauguauaccggcccucgggauugggcauggacucaaacgugucuguguuguaggugaccagggcugggcagugcagcucacagaugccacugugguugaaguggaggcaggccuggggggacagguggcuggcuuucacugugcuguuuugcccuggugugccaggggcaauagggcaguaccaggcagggugcccaccccuugcauccugggggguagagcacauugggcacaaagcagaggcacauaccaggcagucagagugcuuggggcccgugcagccggcagcacacugcucauggcagcagucagugggcaguggccccuugcagcgggcacagccaccggcacagacagugcgcgucacuguugggcaaagggcaggaugagggcugaguggcgcccugggcaccagacccucaucagcaucaccuucuagggagacuaccuggcccaggggagacaucccaagccuguuaucccaccccucccaugucaccuguaugacaccugcauuccacccggccccagcccuccccuucccugacuccaggccucccugagacucacggcucugacaauccucagaacucucuccccagcagcgggagcccuuacacaucggagaacagggguggccugaggacagaaccagagacaggcagugagagagaugucuaacagcgagaggacggguuaguaacagagagaggcacaaacagcagcagaggccacgaggccaacugcacagcaagggagggacccagacaggcugagaggcccccaaaccagaggcacaaccuauaagcagagggagacaagacagagaaccccagagaugaagaggcacagggagauggcaggagggacagagagggaggaaaugggugguguaggcggcuggggcaguggcgggcaggcacuggguuguaaguugggaguuugcggcuggggucaggcugucugagagaagaggcagcagggaggggcauggcuuacaggcccgagagcgguuggugucuaucagugugagagccagcugguuguucuuguggaagauguccuuccacaaaaucguguccugguagcagagcuggggguuccgcuggaucaagaccccuccuuucaagaucucuguggggugagcaaugaucagaggacccuuuccccuucugucaccuucugcuucccuuggggcccuccugccuucuaaaagaggagcaggccuuuuaaacaacccccagauuccccagggaggagagaaagcuaucuuuaccgucuuugagucccaccaccaccacacccgcaacaagaacaaagcgagagccagggaggagugaguuguccaugcuagguccagaugcucauguggaccgcagcucucuccuuccuucucaccucuacucugggcaugcugcuuggugguuaagagacuguggagucugaaacucagccccaucacucacuagcuguguaacuuuuggcccuuauaucugcaagccucaguuuucucauauguagaaugagaauaacacugauuuuuuccugacaggacugcagcgugacugaaaugggccaugcgggcaaagcaccuggcacccagacucuggggcagagucggcuccagggccagcaaauaguuacauagguuguucacuguacacuucacucagccaagugggggcaaaaacccagccugcauucucacgauugaauuauaugugcugacgcaagcuacaacuucccaggaagaaggggaaucuuuuuccaaucuucugagggcgucuucccgggcucugccugcgucugcccagaagggacaccauuucuaaugcacacaaagccucccccugguuagcaguggcccuggucagcucugaauaaccaagagaagguuucaaugacggugaaggccaccugugaggcuucgaagcugcagcucccgcaggccuccuggggaggccccugugacaggggugguauuguucagcgggucuccauugucuagcacggccagggcauaguuguccucaaagagcugggugccucgcacaauccgcagccucugcagugggaccugccucacuugguugugagcgaugagcacguagcccugcaccuccuggauauccugggagggggaagcagaguggggcugaaauaggaacacugccaccccccagggccucccugggguuccccaguacuuggagaucuugggcaaggcccccagccacugagcaguccuguucccgcuuaaauaaaacgauaaaauagagauaaagaucacgcccuaccuugccucaccagauucuuauaugaucaagaaagauaauggugggggggcauuucauaaacuccgaacaggugcccugcccucucuguaucucaguuucuucaucagugaaagcaaaggccuggaugggauggcgucugcaaauuuuuuuuuuuugagacggaguuucacucuuguugcccaggcuggaguacaauggcacgaucuaggcucaccacaaccuccgucucccagguucaagugauucuccugccucagccuucccaaguagcugggauuauaggcaugugccaccaugccuggcuaauuuuguauuuucaguagagacgggguuucuccauguuggucaggcuggucucgaacucccgaccucaagugaucuguccgccucggccucccaaagugcugggauuacaggcaugagccaucgcacccggccggcgucugcaauuugacaaaccaagcauguggccccauuccagggucuguggacacgauccagcagguugguuuccacucucccuccuguucauaaccuuuucacagacauuucucuucugagcuucacaacugcucccaauauacagauagggaaacugagacccagugaagcuaaggggguguaggccacauucauagggcucgucaguggcagaagugggccuguaauccaccuuucucaccagcccuuucuucugcuguaagugggagagggauaguggcuggagcagguggacaggggacaugaucaugcuggcaagagagcacaagauuuagcggaaacacagacgcaucccauccagacaugaccucggccagccacguuauagagagagucaacugauucugcaguaaaaugaauggggguuagauguuagaaaggacuuccugguugagaaaccacaacaagagaggaaacagaagggcagggcaccuucuucugccacccaccuguaaacagagggcucagcccagcuggaggcagggccuggcuggguugcccacgggccucaccugcaggaaggacaggcuggcauuggugggcagguaggugaguuccagguuucccugcaccaccuggcagcccugguagagguggcggagcauguccaggugggucucgggacuggcagggagccgcagcuucaugucugugccggugcacacuggcaggagagagcagaugggucagaggacacuggcgggggaccuucucagaccuggccaccccauccaaacucacuccaagucaugccaccucagacagggagaagccugacugaaggaccccuccgcccaugucccuugcacacugcagguuuaacagcaggagaaagcuugcgugcuugggaaguagagggauuucaggggaaaggcuucuucugacuaggcccacccugugcauucagaggcugccccagcgugccagcccuggggagcucgcccgccaguacaggguguuggcuggcaaagaaaggcuuccuuugucccaaaggcacaacucagggcaaagggguaaaaaucccccaagagaggcgaugacgaaucaugaaucuucuggauacccccugccccucucccaagcaaacaaacucggugcauucucccuaugccauuccagcacacccacaugccaaccucuuggcaagggauccacacccccguaaugccacccagagaguggggaaggagggucagcuggaguugcagcugaggcaugggacaaccggggcucuggucauugcagagaccucugggagucccccaugaagagaaaaggagcgucagauuccaguugugggcaucuggacccaggcugcagaucccaggccagggugaagcaugcgccaaagguuccugcgcuggcacccucacccuggccaccuccucagggcaagacuccagaaccagcuggcagaaugugugccacgaaacugcugccacaaaggcacuacgucagcccugcauaccugcccagcgcgagccaucagccauggggcauagggcugaacugccacaccuggcccacuuggaccccagccugguaucccugagaccagaaaugcccacuaaggucaggaauacuagaggagguaaagcaccccuggugaggggcgccgggguagcagcucacaccaggccugccagugaggggagauuaaagugcccaguugaacuuguuuuucugcucuggugagaugaaucaccuggcgugucuugcccaggagaucggaagggugggggcagagggcacccucaggcccacaggugccugagcugcccagaauuccugccggucacugcuccgccucccacaggcuacaugcagauucagggacagcacaagggcuggcuuggggucugacaccagaggcacugcucucccagcaaguuggagccuaaggucaaauccuaggggguaauacgagguacccccugccuucagauugcugggagaggcugguagggcaagcccccagguucccugccugggccaguggccaguggccacaaacugguggucuccuagugauacucagaauggccucuauucccaccucucuaggcagauaaggacaaagagggaggaacaggagggaggaacagaaauagaacucaaggguccaugucccugagggaggccuccccacuccaugccucacccacuugcacccccuccucuuccccacacuuccucccccaacagacucccaagagaaacaggagcuggggguggcaggccaggcccaaaauaacgcccugcugccaggaccucccccggccucagcccuucagcugcuuuauagacacagcugucugcaggcccagaccccaggcccuggcccaagcccagggucuccacagggcuggggcaggguccgacuccacccccuguagcccuuuucaagggauaccagcuguggccgccaggcaauaggaaaacaacaacaauggggagugggggccgccacaguaacugagcugagcaccuacugugugccuggcaggcacucucgguggaucugcauaacaugcuccagagacuggggcugcaaccuccaucuugcaaagaagacaacugaggcuggcagggguuagcucucgccucauaaagcuugugagcaacaggcaggacuggaacucaggcuggccugccuucagaucccacauuccuuccacuaggccuaacugcacacacacaaauccaccccacaccccacgccaacauaaauacacacuaauucucccaaugccaccgauaaacaccacaggcucuacggagggcaggguggcugggcuggguugggcuggagggucagaacgggugguagccccaccccacuagugaguuuguuuaccugauuuguggccaauuugagucugauuaagaaucuuaaaguguuugcagacaggugguaaaauugguacccugagaacgguucccagggaacuggaggcuugcuggcuaacacccccaccagccuacaugaagucaagaaggucuuccugacaccucccucccacucucccaucuccuuaccauuguccccauaucugcccugucccauugguuuucuuuuuuugagauggagucucgcccugucgccaggcuggagugcaguggcgcaaucucggcucacugcaaccucugccucccggguucaagcaauucuccugccucagccuccucaguagcugggauuacgggugccugacaccacaccuggcuaauuuuuguauuuuuaguugaggcggguuucaccauguuggccaggcugguccugaacugcugaccuugugauccgcccgucucggccucccaaagugcugggauuacaggugugagccacggcaccugguccccguugauuuccugggggguagguccuaauucuacccaggaguguccuugucuccaggacccugccccucaggaaccccaaccuccaauucuccagagcaaagacaguaugaggcaggaccagccacagggagcgcuagauaagugucugcugagugaaugaaugaaugaguggaugaaugaaguccagucacgagucuccgaacaaaagggaccaguugaggucauggaauccaucucucugcucagagcuggucacaguccuucaugucucucuggacucugguggucaggacuugaccccaguccugagguuucucucagguggguucucuccuccccaccagcuugcagccccagcugcuccucuugcucacagcagaaaagccaauacuucccuugguuuccaugaauacuacaguaaaaugaccuguguccccaaagcucagcucucccagacccauaaugucacagcccauucaagugacacugggauuccccgaccacaaacaccugguguaucaggccugacaucagaccagggccugggcccagggucuuuaguugagaacccuagcucagcugcucacugagugaucuugagcaaguucccagaccuccagggcagaagcuaaaucggauucaucucuaugcccugcaguaccugcaacuuggugaauauuuacugaccuaaacuuggcuguaacagcucuuacucccucagaggagguacaugagaguuaaaugagguaaugaauugcgcagccaucuguaaacaugacgaggcuuuguaaacagaacugggacaacacaaacauucgcuagaauaauucucccacuccuugaaagaguacacaucccuuaccccaccucggcucucuucccagggggaggauggguggccaaacauaagauggagaugucacucuagaggggcuucucacagguggagggcagggaaggaaucucuuuccagaucauuccaucacccaaggacaggcacaacuacccugggccccaccccagcccucccagccgcagccccacacuggccccucacgcugacacuucagcugucucucucacccacagcccugugugucaacguggccucuguccccuccugcccgcagcccccugucaugcugguagggcccaaaaggaagacaggcauuggcuggacaggaagggagaggacucugaagucaagagggaaccucagggcccccagcucagcuccacuuucuacagccuagagaaguggauggaaaggucauucgccugaacaagaggagcgcuucuccucccaucuggccaccugccugccccuaaggcuuuguucaacccauuauuguuggcuggaauaagacucuaaccaccucuuaaugccuccucuucagaguccaaaaauucccuggacauuacuggguagcugggagccuuggauaaguugcuucauuucucugaacuuccauuuucucaucugugcaccuacuucacaggacugucacagagauuaaaugaaagcauggauaaaaaccuagcauauaggaaguacaccguacauuucuuaaaaguuaagacaagacagguucauacagcaggaauauggguaaucccaaaccacgagaaaauuaaacaugcuuuguguuugacuuuggaaugccacguauuuuuucuuuuuacauuugaucccuaucuuuucaauuguuuuuuucuugacaaauaaaaugaguacuuuccccaaguauaguaaagagaggaggcuguuggaagaaucauacuggaauuaaaauaugaaggaguucugcaagauuaaaaggauguauuugcugcaauuuguaaaacccauaccucuaagaaaggauuucagaaaaauccugaccccucuggggcucccccuaggccuccccuucccccacauuccugccccagaccucaccccuuggguaaaaucugggugcuggaggcagcugggugguauacuuuuuuucugaaacggagucucacacugucacccaggcuggagagcauuugcaaucacagcucacugcaagccucaacuuccugggcucaggugauccuccugccucagccuccggaguagcugggacuacaggcacguguaaucacauccaacuaauuuuuguauuuuuuguacagaguuuugccuuguugcccaggcugugcaaugacuuuuuaacuaacuccugcacaacacaaucaauagugcagguugaggggugaggacaugaggaggccccauccagagaacccagcccucaaauccagcucugcagcaacugccauucccugaucaacucccagcccaaggugaggaagggcagcagcucagccugacagcucaguauggccucacccuucucaucagaagaugagaggugaagaugcuugucugggaaacagggagggcaaggauguacucccuggaagagaggaaccuucuuccucagcaagaaggcguggccauagaaggcuaccucccucuguuuauggcagaucuggcccagcaccuuaagggaguuccugcagaggacagaguucagccuguguccccaagucagcagagagacugcuguuuggcaacacaaagcccagacacacaaauacaaagaccacacaacugaggaacacccuggcguagaccugcagagauaacacggccaugcacucacucacagagggccccucgggcaacacacagccacgaugacacccacucccuccccagacccucugaccuauggagaccacccacgacucccagaacacuuucauuuugucuccccugcagcccagugacucagggagcagugucccucauugcuccaggugcacucauccauauagcgauuucgaaugcaugguugggggucgcacugccuggggucccaucuugaccccaccacuuacuagcugcuacucaaccucuggacugcuacucaguccagaaugcuggcagaacuuccacuauagggguguucuaggauuaaaggagaaugcaugcaaaacaccacaaacaguuccuggcagaguauaccuggcccaggcuauauguuagcuuuuaugauuaaugcacacagguggacagaugggucaggauacacacugcccccacucacccuuccccacgcacagcaccaaggaaaaggcagcagaacaacgcagcccucccuaggcucccaucuggccuuauuucuuagcuuccuucucugggaacucucccacuuuacaccccaagaaacccacccccaccccuccaugguccacgcgcuccaaaagucacagagcacagucccuaagcuggccccaagaaucuguucaaagcaaacgucucccccgcccccaacccagaccccagcaagaggccacccuccgggccacccuuuccuccccggcucugguugggacagguugcuaugccacccuccacuccaccacacacacacacacccgaccccgccagaagcaggagcaaccaaaccaaaaucgucugaaggggagcggggaggggcuggaggaggggcagggcagaggacccccccaaggaauccagcccaggccaguccggaggcggaggcugccaacuggaaaggcuuugagaaagcuugagggggcucaagaaggggggaaacgcgcgcgcgcgcucuacgcaauacacccuuugcgggaaaacuuucugaacaauuucagagaacuucuuugacaaguucccggagccccucggagccuggaaagcgccagucucuuggaugggccaucucgagccgcugccguguaacugcccccucccgcccgagggccccagggcccggcugcccugagcgucucgacuguccacaacuucgggauaggagagcucguccgggccccucuggccccgccggccgcgggaccucggcggggcauccacagggcagggucccgccgcugcuccguccccuccccacaccagacccaccuugggugcucgcggcuccggggggcaagagggcgaggaggagcccccagcggcacaaggccgccagcuccauggugcucacugcggcuccggccccauggcuccggcuggacccggcugggagggcgcggggcgcggggugcugcgaggggugggggccgggcgcgcggcgcaguaaagggccccgugggaaggggcgcgcggcugcccggggggcuccccugguuucuccggucccaauggaggggaaucucagcuucacaacuucauucuuauacuuccucaa

SEQ ID NO: 21279 - RNA, 27076 nt, Homo sapiens
ccgcgcucacucgcacucacacccgggcgcaggaggcgggcggcccgggccccaccggccccccauggacgcccccagcacggggcgcugagacccccgcgucgcugcccagcccgguccggcgcgccacgccgagguaaggaggagggagcgagggggcauuaauaugcaaaugccuugcgauugauuaugcaaagccgcggggcuccguggccagcucccaggcgggcuaggggcgcccagggggugccugcugccagccucagccuuuccuggcgccccagugacccugucacgagcccgggagcuugcaacugacgcccuggggaagggagguguugcuaggaggucgcugggccccgggguucgcaggcggagauggcguccgagccucccccuggagggcccgcccggccucuguccggccagucugcugcgcauucccgggccgggccccguugccggccgccggagcucccccgcccgccgcgccgcgguuuguuuacggugcgccggaggccugcccccccagcccccaccccuagccucugaggcccgaguggccuuugcaaagcugccuccagcugcggagggcaguaugagugcgguggcgcgggugggcuugcacggguccggggagagggaaguucccccgccucacccgccucccgguugagcauggcugucugguugcaacacugcuaauugcaaaaacgcgguuguugggggggaauguguguguggaagggguguacuugguggugccuagaugauuaggagaguugcuggcuggggaggagagggagaaauggaccuguguguguguaccccaccuuguuucccuccccuugcaacgugucucuggugccccuucuccaucuggggcccucccuuguccagcgugaaagaaaggccuggggggaugacaggggcaauugaaagaaccaccguuccaggggugggggugggggacacagaaggaaagccagugaggugggagccugccccucagugcuggcuuuggcuccaggagggggaggggaugaagggggcuguuguccaaaaugaggggggaagcaaaagugacacgcagacacagagauauguccacacagacagccacaugcacauccagggacacccaggcagacucaaggacaggagcuacuggacacacccacauggggacaagggaagagacaggcugcugcugcaccguggagcucugaggggugggauauacccaugggagaccaagagcauggggaccgauccaugcacauacccacgcacagggucacacguagaugcugucacacacuggggcaaggaggaguugcugucacccacacauaaaaagucacugucacaugcaugcaugcacacagagcaauugcacacagcagcacaauuacaaaagacccugucacucacaggcacacacgugcucgcaugagcccagucacacagacaucauugcuugccgugacagucgcugucacucagucagaugcaaacacaguuacacaccaacacauguauacacaacuuagcaacaaguauuuuccuggacucuuuacuguggagcucugagguucuguaggcaacaaaacccuugcucccaagaauauuaaauuuggcuguaugaaaaaguguuccugcguaaugguguaaagcaugcauucccaaugacauguucuuggucucuaucgcuugagauaccacccuacuagacagugagcucuuggagaccugggagaaucacuuaaagagcucuggaucccacgcagagccuagcacaagggcugcucuguaaauacuuguuaguugauugacuguggaaccugcagacacaggugcacucauuugcacaugguccccugaacucaggugcagaaugaguucacaaggcccagguccccacaguugcagguccacaccaacagucguguccacacaaccccagauacacacaacugcagccugugcagccgagcacacacuuagaugcacacaaucacaaauuuuuccccuucagcuuccuccuccccuuuuuccucuaggcucagccacugugcgggaaugggcuguuuuuuuuuucuuucuuucuuuuagagggacagagaaacaagagcaaagacaguggguucagggggguuccagagggccgagucaugggcucaaagcaguguccagugacuucuagaagcuaggauucucuugacuguuggggaaggggagagcugcucuccucccuacccuaaaagcucaggggugucuaacugccccugcucugagucauuugccugggucuuuccugggaacagucagucacuuccagcugaguuccugcgccccaccuugagucuggcccuuuuucccaccuguacccuccuguccaaacuuggaagcuuuccuuaagaggccaucggcuggcgagugucugugugagugauauguacuuuugacuuggaauuucucucuaacucugucucucuguugcucugucuugcagugucugauucucccucucucucuccuuguuucucugccagucuguaacucucucucacccuguugcuacccccgaucuaccccuguccuugucucagagcuggggacuggcagcaauguucuucauacuuuuccaguuguuaauacccaagcuccgccccucugcccccccugcgcagccucuggggucagcuugagguugggguggggggcggggggcucagcuggcugcucaggacuuccugcacuuccuuagugccgcagcuguggccagcaaguuuuaggggcugggaaugggggaagggggggggggucagccacugcccaugcugaccccucgggccugcaugucuggagacaccaguucugugggcacccucagggugcaggcugcagccagcuagcagcucuuaaacaagccaugaagaggcuccccccacacuggcccaagcuggaaaagaaccgcccccaugggcaguggcgggagcuggcaggacccugcugaguuggguccacugcagggcucacaauggccuuucuccacaccccuggcagcugaggcccaccucagagaugcccaacagcuguguccuuuuugcccagccucagggccugguucugagggcacagcugccuagacuaaguauguacuaagcgaggcccucccacccgugagugcagguuccagccuagaagggguaccucuucuggagagggaauuugaggagggggaacucaggcaggagacaucgagcccgggggcaccaagcacuucucgcuaugcuccccucuagccuuggacuauuuggagguggaggcacuuggcagagaacccacagggcagcuacagaggggaaagacugaggcuuggucucagggaacacauagcuggaugaaagaacaaggcauugggccgggcacaguggcucacacccguaauccuagcacacugggaggcggaggcaggcagaucaccugaggucaggaguucaagaccagucugaccaagauggugaaaccccaucucuacuaaaaauacaaaacuuagcugggugugguggcgggguccuguaaucccagcuacucaggaggcugaggcaggagaaucgcuugaacccaggagguggagguugcagugagcugagauuguaccacugcacuacagacugggugacagagcgagacuccgucucaaaaaaaaaaaaaaaaaaaaagaaaaacaaaaaagaacaaggcauuaucuaucaagcaggugauauaccaucacagcuaagaacagagaugauggugaugaucaugacggccaugauugaccuggacugccuaggucugaaucccagcucugucacuugcuggaugugugacuuugagcaagcgauuuaacuuccccguugccucaucuguaaauuggggaugaucauaucuaccucauuuagcuuuuuugaggaaaaauguuuuuaaaagugccuaguucauaacaaacuguauaugugagcgguugugaugggugaaggaagcugugggccuggggucucccagauuucuuagagaagcuucguggagaauugggucuccuagacaucagugagacuggggccuggggcagugggucuccaauuuccagccuucucaccgucauguaaucuuuuccucccagacaaauuuuugcagccuggaaugaguguaugggaaagagcccaaggcaggccccucugccccacccuccuuugacccucgcccuucagcuuacaaggagcccuuggccccucagccugggacacaccccaccagcuaggggcaccugcauaaaucuuugggcaucacugcaucucuguucagggucugagcucugggggugggagagagagaacaaggaaagccguccccucucuuaugugugggcucaaagaggaggcagugcccuuccucccuccugggagcccagcauuggucaaccaggacccagcucuggcugauaggcaccagauuccccugcccuccauggagugguacuuagugugaaaggugguggcagagagaaacugaagcacugaguaaugaccaguguggugggcacagcacuuugagauccagcaucuguccuggguugccucuuugccuuugugagucuggugaucaggauccccucuccaaaccccuuuuauuuagcccugccccucaaggugaaggaaggacaaugggaggauacccuguaggggugacgggaagccuuuggagugggaaccaaucucaacucuaguucucggcugggcacaguggcucaugccuguaaucucaauauuuugggaggccaaggcgggaggaucacuugaggccaguaguucaugaucagccuggucaacauagugagaccccaucucuaaaaacaacuuuaaaaaguuagccaggugugguggcgcaugccuguguuaccagcuacuugggaggcugaggccggaggaucgcuuaagccuggaaggucgaggcugcggugagcugugauugugccacugcacucuagccugaacaacagagugagaccccccacacacacauccucucaaaacagacagaaaacaaaacaaaaaacccaacucuaguucucauggcugcaaaggugucuaggggacuuuggagaacuguugugucucuuggggagggaggcaagcaugaccguggugggaagaucacuggcugggaguugggaggccuggcuguugacauucacuagucguaugacuuugggccuggguuuucauuaucuagagacaaugguuccugucucacucagguugagggcaaauaacacaaggugggaugaccccuguguucaauccauguugcauccuggcauggugagcaaugccuguggauucuccuuuuuucccagggccuggcacaugccaggguggggcauacacaugcugccuggaaccagagacaguucucagucucucacugaaguaucuggggcugguguguggugggggcacaugugguuccaccuuggugucacuuggcaggccaaagcuggggucauagggaccucccuccgguaugccauugcgugaggugguccagagggagggucagaaguuugcuggguagacaagggaagcaagauggguguuacuggugcccaggaaauacuauccuugcuucgcuguuuugggggugggcauuaaagguugauaccaaagccucagccaugccccucagcaguggccaagagcagaaugauuggaccaagccccuggcccaccuccuccuccuccucuuuuccucuucuaaagaagagaucggcucuuggcucccagagccccagcugccuguuucuuuuucucuuuuaccaggcauggggguggggaaacaggggaaccgaggcuuuggugucuuucggcauuuuuguacacaucagugaguggguguguugugcacgcauccaugugagaguguuuuugugcaugugugggcuggggagggcucugaauaucuccuggaacgguacccagagcccuguggcucugcgcaugcggggugagugugugugucugcacguguccgugugugugccggagacucagcugcauucacgcgcgcgcucucucccucccucucucccucccucucucucucccucccucccuuccucuucccucucccucucucucucccccucccccucucugucucucccuccuucucucccucccucucucucucucacacacacacucucaaucuuucucucuucccucccccuuccucccuccuuccuauucccucccuccucccuuucugucccugucucucugucucugucucugucucucucucucugccucugccaguucugcuugguuaggggcuagcuccagccucuggggugccugggagaacaucccucccuuucuuucccccuccaccauucccuccccuccuaggccaugcucuucagggcuugcaggcaacuucuucuacugccuuagaugagggagugaggagggaggaccccaagccuugugcccauggugccaucugcagcaagugccuuggccccgugacauucaugccuccagcauucagcugccccagcucccagcuccaauuacccgcuggcugcugggggaggguggggagaaugugccgugcccagcuugggggugcuccugcuucugcuuucuuggcuacuuggaucuccugccuccauuccugaggggaauugggcagggggggcgugaaguucugugggcugauaaggaggggcugaguucuccagcaugggugugggcaugaccacccaccaguggucaugggggauggaugugaccugggaggagaccuccagaccugggcacccaccuugaugccuggcuggagcuggcccgggcaggaggagggagaggagagcagcaggugggugaggcuaugggggagccgagugggaagcagucuuugauguuaauacugggcaucuggcccaagucaaggcugcuguuuaugucuuucugucucugaccugcaggggggguuuccuguuauauucuuuuggggcgggguggggaggauccuuuguuuaaguaaccaaucucccccuuaugaggauccccaccccaucucccauucucuagccucuaaggucccacaguggcuaggugaugagucacugccccccagcuccagaaccugucuccugggggcccagugagagcucaccaaggggugccgccuccccuccucccgucucccccaugccugccaggcuggggcccugagucuguguguacuccucugccacaucacaccugccaaauaguaccuuccuucccgccuucacuccuccucuccuuccuggcacuaggauaacagagaguuggguggggcagcccugcucaauccauaccugagaauagaacaggggguaugggaaaggacagggagucccgguccuagagaggccucugccccucagcaugggggcacaugucgcugcugcagcacugccaccaccacagacucccaggggcccuugguguggguggcugccuguggugcccguguuggcauggggggcagugcugcccauagacgccugugcccaugcaugcccauuuaugugucugggccacgguggccgccccggccccucagcaucgcccuuccuggcucccauggugggaggcugggugaucaggaguggguggugggggagggaucuccccccacccuagcagcaggcagaggggaaggggagagggaggugugaaccuacccacagaacuauuaauagcccacaugccaggccaccaagaaccagcugucaccguggaaaccauuccuacgccccccuccccccagccugcauggggugggacuuagacaggguacgaagccccccacccaucuuucuuuguuaccuuucucucuuugucuccccuccuucaugugucucuccucccuuuaucuguccuccuuucuaccucaccccuucuccccaucccccaucucuggcuccccuuucuuccucucccucuacugccuugucaccccuagcucuaccccagcccugucccauuucuuuguucuucccccuccucccuucuucccucuuucccccaccagccuuuuuaccccuccucccaucuuuccacccuuuucucagccgccccgcauguacgugucccuguggcuggcaaggagggcugggcuuucuucagagcacuaaggacaaaguucaggggccccagaaagguggggccaaagcccagagcagauacgcaggaggguuaaugcggguaguauuggggguuagauccuggggacagaaacuccccucuggcagccccaggaguccuuuggggguguccucagauauacaggacugcagagugggacggcucggcagugggaaccuggcggggcgcccguggaugccgcauuggccccgugucccuguccccccauggcagaaguacuuaagcuuaaugaaaugcuucccccuccacgggcacuuugccuacacugccucccagcagcucuuaucucacaaggagggaguggguggccaggccagccgacaggugggucuugcuguccugcuguccagccugggcacagaaccccauagcuccgcccccucggccuccuuggggcagggccucccucgccucugcagaggagguaccaggaaggaguuuggggaguuaagcuggacucuggaggaggggugagaggcugcccuucaggguggguaccccugccccaugccccuuacccgcugaccuuuuucuguccguggcuaacacaggcucaugugguaugugucuccccacaugcugggcccucugccucgccucuguaucaccccaaaggcccaagugugucccuggagagaugccaaggaguccccagggguuccagccucuuucuggguacccagugagggugcccuaggcagcaagggcagcaccuugcuccucugcccacuaccaggggcugacuguagcugggcugcacugcccagcaccagggcaccauucaguucaaaagagggguggggcagagagcgagucugccccuccccccagugggcacgugcaggcccuuggcaguacccagacacauuuggaguuaaggcugggcaggagagagggauggggaaauaaacaugguggcuuagguuggcacugcuccaggucugcaauguagcaacugguaaguggcaggggccugggggaggggacccucaggagcccuggccuggggcaggagcugcccaugccauguggcugccacugguguuccccgccuggcccggcccacagcagccagugcucauuccugcacacacugguccuccucggcugcccccaggaccugcuccccggggcugccccucucucagcaugcccacuccugugcuugccuccuccccucccugggggcgcuugggccuccggcuggcgaguggauuuuuccagcuucuguaaacaagugguggcagugugccaggcgggcaggagacaggcgggggcagcaccacagccagggugugccaagcaccgaggcacagccuggggggcagacggagacacccagacccggagagagagacauucagacacagacagacagacagacaugcaggcagccucgcuggacguggagucagaagaucguccucuauuguccagcccaacccccguagcggcccucgcccccugccccucacugucuggcugagagcauuaggccccagugcccagccccugggcuuccccacccacuccuucuccuccccaaccuccaccccuuagggcuggcuacgccauuauaaauuuauaacaggaauuucuccacaagccaagaaaaacuugaccuacuuucuugauggcucccugggcuaaggcucccugcucaugcccccccaccccagucuccuguccagcccccagugcccaguccuggucugggguggguaucagagguagaacgggccacuuuucugugcaaugcccaugcucuccacacuaccagcuugccugggugcagaggccccguucugcugcuggcccugcccaauccccugacuuaucucccucucucuucccacccuggcugcuuaucagcuccuggggguggggccagggggccuaggggugaggucuccuaugcagcagccacgugacagagguugaggucguauguuggggagcuguacccuuugucccccuccuacccgccacaccugccugugugcacacagacaguaagccacaggucugcagcccagggucagaggugcaaugccguaggaauggugggcccggcuuggcacugcccuggacuccagguagcagaacaaggcuagcauuagggccaggcugugaggcuuaucccacagccaccugcuuacuaguugugugaacuugagugaaugaccaagcuuucugagacucaguuuccucaucugugaaguucucgugcccucuuuggaggguacagauucucucuccaguuaauauguguuaguuuccuuuccuuucccccuugccauccuggucgauagcagcucagcuaaaccaacugagaagucugguccucugccugggaagugggauucgagaccuugcgugggaagcucuggagucccugaggggccagaguuggggaucauaacuuggcuggcagcaugggaggucaguucccuacagcuuucaacaucucucucuauuaaggcacaaagaugggcauucaugcucacugcgugccgcucuaugucccauccuuccuucacagauacccucccugccuaugcugaaaacugcuugucucugguccccucuugccccuauaauacagaugaguuucaggaaagcuuuucuagaggggugguaacaauagcuaguguuuaauaguugcucauuaagggccaggcauuugucugaauaugaagacugagacauauuacuuaguacaugaaugaucucauucucucccuccauuccuucccaugucuggggcuuaggagguggaucuccaaucucgccugcuguaccuguuaucuaagggaucauccugguccccucucuaugccugcccuuccugcccccugcugucuuguuaugggaucccaaagccccaaauguugccaccaaagggauccuacccaccuuccuaccgugacaccuucuuaccccugccucucucuucucuccacagggaucucuggacaggacaagacuccgaagcuacucccccagcacacagcccgggacccacaaacccagcuugcccccagcccucccaccugccacucccuggccccucccaccgcccgccccccuuggggcgcagggcauggugugaaaggccaagugcugaggcggguaucaugggugcugugcccuagggccuggguggcaggggguggguggccugugggugugccgggggggccagugugcccaccccagucucuuggcgugcuggagggcauccuggauggaauugaagugaauggaacagaagccaagcaagguggagugugggucagacccagaggagaacagguaauggguucagcaacuaggucaugccaacuccuaagcagcaggcaugggcaccuggcugagcucuccuuuaggcaccgccuuuaagcaccucugugggauggacgugaggccagcaagccuucugccuaccuuugucuggcagaugaagucauguucagaugugacaggcacuuggauugagagaugcucauuuugaagcggggagcgauacagagcaauuacagggagcacauaaggggcucuucccuagacauugcugggcagucucagaugcccccaacgucccuuccaccauugcugcccuuaccuugagcaugugggauccaaacagccuugccauuuucuuccucucccuaccagcccauuuacuaucugaccacaaguguguuguccacaagcugcgguucacguaauacauuucagggcacaugcaccaguaacuauuggucauagcccaagcuuauauucggaaucuauugggagccccacaagcucuuccuuguucauggucaagggcgggcacugcgauggggcuccucccagaaagugcacgccaaccaugaugguuuugcuuccacaugggugaggugucagcccugcacauacaccaagggaugguuaccugugaucugcauugcccuugaggagcccagagggucucugucuuuucuaucagcuccaaguggcacagagcuuugucccaguuggcacggugcccugggagcuggguacagccugugccuauggccagggagagggugggggugggggugcuccggggagcaguguggcugacuguugccuaggagaucagaucccgagccaggaagccagaggccuggccaggcaaagcccuaaggcccacaacugggucccuggaggguagaggaaguagauggaacucacagcugggcagggcaugggguagcuccccucccccaaagccucaccccaggaaggacucugaggacgaucuggccugucgcuguguggcugucacuugcagccccugugucucccagcuuaggcuucugugggucuggaagagucugugcuuaauguuuggagaaaggcaggaaugccaguucccagucuccuaagacugcaaccccucccccaucaccuuccccucccccaugucuaugcgccaccuuguggcuaucucuaggacuacacucagaggcugugagucuggugguaacugcugaagccgcuagcucaacuggggccuaggugggcugaguuccccugcacccaacccucugggaggcgugagggagaccugaccuuucagccucauaggaaguagaccggaguaauccccacggggcguggagcauaggguugucugugacugugacccuggccaaggucacugugucaguguguugggagcugcauccggcuccaggaggaaggggccugcaacaugccacacgcagggugggugcgggagguuauacaauccuugcaugcauguagagggcuuauguaaccugugugcaccgagguuaugcaacauguauguggagagccuggcaacauauaugugcaguggcugaggguugcuaauaauacgcugcacagaggggcucagucccggcucugacucuagcucauggugucaccaggcacaagcagggucucaguuugcugcucuguuaaauggaggcugugcagaggguguaguguuuucuauugcuguggguuauuuagcauguguguaugaccuggagcucaagcaacacgugcacacuggagggaugagggugguuuuaugaggugccugugcagaguguuguguaacacaugggcauauccuagagguuguauagcacauuuaagaaugcccugaaaauuucacagguauguuggcccuggugcauacucaccauccauggguuuauagugaagguugcaugguuauucaucugugccgguguuauguugcauauguauguguguguucuaaaggcuacauagcuuuaagcauauccugagaauucuuccagcguauucgucauguacugaaagaugaggauguccugcagauuaugggugcuucaggucuucuggcgggugaauguguguguguuggggcucuagaauaugcuugugccacagccaagccccuuaucucucuccccugcaacuuccagauaacuggacccuuuuaagcauugucagcugacccuggggggugggagguagaaugaggacacaaaauggaaagaaucaggccuugggggauugcauaagccucucggaugagaaaggggcuacucgaagacugcucugugauucugcccacuuugccuccauccagugccaggucaccagauggaaagcgaaaaagaaagaacggccaauguucccugaaaaccagcaugucaggugaggcuggcugugcgugccccuucuccacguccccaaccccaccaaacccagccagggcuccucuggaccuggauguggaacaguaauucauguguucccuggggggagccuccuagagggcuugggauggacuugucugggggugagaaagguaaugugggaugugcccagcuuuugaggguggauuaggucaggacggccucuucccucuuccccuaauacccucaucugaggcccuaccagaaucagggccugagcugaaggacugaggggcuguauuauccccagugagcagcugacguuuauuuuucccucuccaccauccucugccuuguagauagaucaagaagaaagcccugaaugggcagucagaagaacugagauucuucauacucuuagggcagagauggacagguucaccucgugucucucuaggauucuaccagggaggcugggcuaggagaggggucagaaacaaaaaguugagggauggggaaaagugugagagccucucugcugggacuccaagccaugccugccuuccuccauccuuuccuuccucccaggguauaucccuaguuaccuggacaaagacgagcagugugucguguguggggacaaggcaacugguuaucacuaccgcuguaucacuugugagggcugcaagguauggaagcuaccuccugccccuccccugccaccugagcccccauauuacucccuaugucaccuaaagcccgccuguuaggucaucacuuuuuuuuuuuuucuuugagacggagucucacucuugucccccaggcuggagugcaguggcgcgaucauggcucacugcaaccuccgccuucagguucaagugauuccccuaccucggccuccugaguagcugggauuacagguaugcaccuccacacccagcuaguuuuuuuguauuuuuaguagagacgggguuucacuauguggccaggcuggucucgaacuccugaccucaggugaccacccgucucagccuccugaagugcugggauuacaggcauaccugccugguuacuuucucuucucuucucuuauucauucauuuacucauucauaacuccuccucugccacucacaggaaaauugccuaacuucuucgagccuuaguuucaguuucuucaucuauaaaaugaggauaaucauucucucuaccuuauagcauuguugggagaauuaaauauguugggagauaguucacuugaaguguuuaaaacagugccauugggugcuguggcucaugccuaaaaucccagcccuuugggagggaggccaaggcgggagcaucccuugaucccaggaguuugagaccagccuagcuaacacagugagacacugucucuacaaaauuaaagaaauuagcuggguguggugccacaugccuguggucccagcuacucaggaggcugaggugggagacugcuugaacccagaaggucagggcugcauugaacggugguggcgccacugcacuccggccugggugacagagcaagauucugucucaaaguaaaauaauaaaauaaaauaaaaaauagugccaugugcauaagaagcauuugauaaaugccagccaucacccauucauucaguguauucuuaggugugagaguguaguacguaccucgccuucaagcugcucacagccugucagagagagagacacaacuugaaacaaacaucaguguuauucaaaaugugguucauggaccaccuguccuacuaguuaaaaugcagauucccagccuucaucuuuuuuuuuuuuuuuuuuuuuugagauggcaucucgcucuguugcccagguuggagugcaauggugugaucucggcucacugcaaccuucgccucccggguucaagcgauucuccugcuucagccuccugaguggcugggacuacaggcaccugccaccacgcccagcuaacuuuuauauuuuuaauagagacaggguuucaccauguugaccaggauggucuugaucucuugaccucgugauccgcccgccuuggccucccaaagugcugggguuacaggugugagccacugcgcccagccugcccaggcuucaucuuaacccugcucacucagagcccuuuuguggagcccaggaaucuuccuuuuaacagaaucccggaguguuucccaugcaccugaaagagcgagagccaguacuggggggguagugggagcugggagcacagaggagaagaggacagcagguucuuccaggcagaggggaugacaaggucauagauuuugggaggccuaauuguuuuguuuuguuuuuuuugagauggagucucgcucuguugcccagccuggagugcaguggugcaaucuuggcucacugcaaccuccaccucucggguucaagcaauucucccugcuucagcauugguagcugggauuacagacaccugccaccaagccuggcuaauuuuuguauuuuuaguagagauaggguuucaccauguuagccaggcuggucucgaacuccugaccucaggugaucugccugccucugcaucccaaagugcuuaagaggccuaauuagauuucacuuugaucauuucagccuggauagccuuuccaggaucaccuccuaaaaaugcaaggccuuccaagaaacagaauuauuuaaaucccagcacuuugggaguccaaggcaggcagaucaccugagguuaccacacccgguggcacuguuuuaaacacuucaagugaauugucucauuuaauucucccaacagugcuauaagguagauaaaaugauuauccccauuuuauagaugaagaaacugagacucagagaaguuaggcaauuuucuugugagugacagaggagggauuaugaaugagcaaaugaacgaaugaguaaggucaggaauuugagaccauccuggccaacaugguaaaagccugucucuacuaaaaauaccaaaauuggccagguguagugauguacgccuguaaucccaccuacuugggaggcugaggcaggagaaucucuugaacuugggagauggagguuacagugagaguggagauuaagucaguguacuccagccugggugacagagcgacagagugauacucugucucaaaauaaaaaaaaaaagaaacagaaugauuuauauguuaaaggccagguauaguagcucacgccuguaauccaaacacuuuaggaggccaaggugggaggauugcuugagcccaggaguuuaagaacagccugggcaacauagugagacccuguccauacaaaaaaauuuuuaaaguagccaggcaugguggugcacacacaccuguggucccagcuacucaggcagcugagguaggacgaucacuugaggcugggaggucgaagcugcugugagcugugauuaagccauugcacuccagccugggcgacagaacaagacccugucuuaaaaacaaaaaacaaacaaaaaaaaaaaacggaaaaaaaguuuaaggcuugaaguuucucucucuuucuugaugucaaccaaaccaagaccaugagggauuuagaguucccuagcagaagcaauacaauccuucuggaagcaauacaaacaguguagcauagagaaaggaucuuuuacucucacggacaucugagucccagggaagcacccugaaaagacagagaugccuuggccccacccuuggauaguuuuauuuuguaguucuggagugaggcccaggaaucuguaucuuugguaggugccuuuggugacuuuuuuuuuuuuuuuuuuuuuucaagacggagucucacucugucacccaggcuggagugcaguggcgcgaucuuggcucacugcaaccucugccucccagguucaagcacuuguccugccucagccuccugaguagcugggauuacaggugccugccaccucaccuggcuaauuuuuuguauuuuuaguagagacaagguuucacgauguuggccacguuggucuugaacuccugaccucgugauccacccaccucagccucccaaagagcugggauuacaggcgugagccaccgcacucggcugccuuuggugauuuuaaugccccuggaaucugagagcucagacguuggugucccauaccugaggcccaguucugacucugcugcccaccggccacaugacuuugggcaaauugcuucaucucaccaagcuucaguuuccuugucugcaaaguggaggcaguaacaguuccuaccucauaggguugucuggaggguucacugugauguuccaugaaagacaaggcuuaucuuuuggguuuuuguuuuuguuuguaauggggucucugucacccagguuggagugcaguggugcgaucauagcucacugcagccuugaccuccuggucucaagcaauccuaagcaauccucccaccucagccuccagaguagcugggauuauaggugcacgccacaaccccuggccaauuuguguauuuuuaguagagaugggguuuugcuauguuggacaggcuggucuugaucuugaacuccuggccucaagugaucugccugccucagccucccagagugcugggauuacaggugugagucauugcaccuggccagcaaggcuuauguuuacuaagugacugacacauuguaaacaugaaaaaauacuaauucuucauauuauugcaaucaucuugaguuuugagguguuuccuuuaaaauaaaggcgaggcugggugcgguggcucacgccuguaaucccagcacuuugggaggccgaggugggcagaucaccugaggucaggaguucgagaccagccuggccaacauggugaaaccccaucucuauaaaaauacaaaaauuagccgggcguaauggugggcaccuguagucccagcuacucgggaggcugaggcaggagaauugcuuguaccugggagguggagguugcaguaagcugagaucacaccacugcacuccagccugggugacagagugaaacuucaucucaaaaagaaaaaaaaaauuaaauuaaaaaaauaaaauaaaggugaaucccaauguagagaauugaaauuuuucucuuccccuacuagaguucauacucagucccuuuccuugacuuuuuugguuccccuguuuuaugaauuccaccugcauggacaacaggcaacauauaugagaaugguuuuugggucaguguuguuuuuaaagucauuuagcaaaauggaaaaugagguuuuacuuggauuuccuuuuuuuuuuuuuuuuuuuuuuuugagacagaguuuugcucuuguugcccagacuagagugcaauggcacaaucuuggcucaccgcaaccucugcuuccuggguucaagcaauucuucugccucagccucccaaguagcugggauuacaggcaugugccaccauucccggcuaauuuuuucuuuuuuuuuucuuuuuugagaugaagucucacucuugucacccaggcuggagugcaaugcgagcuccaccuccuggguucaagcgauucuccugccucagccucccgaguagcugggauuacaggggcaggcccagcuaauuuuuauauuuuuaguagagaugggguuucaccauguuggccaggcuggucuugaacuccugacuucaggcagucugcccgccugggccucccaaagugcugggauuacaggcaugagccaccgcgcccggccaagggguggaccccgccgugguuccaccgcggcucaaaccuaggaccuucugcauguaaagcagaugugauaacugcuacacuauagaaucgcaugcuuuuuuuuuuuuuuuuuuuuuuuuuugagauggagucucauucugucacccaggcuggaaugcaguggcgcgaucuuggcucacugcaaccucuguguccuggguucaagcaauucucugccucagccuccugaguagcugggauuacaggcgcccaccaccacgcccggguaauuuuuuuuuuuuuuauacggagucuugcucugucacccagccuggagugcaguggcgcgaucuuggcucguggcaagcuccaccuccuggguucacgccauucuccugccucagccucccgaguagcugggacuacagcgcccaccaccaugcccggcuauuuuuuuuguauuuuuaguagagacaggguuucaccguguuagccaggauggucucgaucuccugaccuugugauccgccugccucagccucccaaagugcugggauuacaggcauaagccaccgcgcccggccuacgcccaauuuuuauacuuuuaguagagacaggguuucaccauguuggccagggugaucuugaacuccugaccucaugauucauccgccuuggccucccaaaguucugggauuauaggcaugagccacugcacccaaccucaugcccggcuaauuuucuauuuuuaguagagacaggguuucuucauguuggucaggcuggucucgaacucccgaccucaguugaucugcccaccucggccucccaaaguguugggauuacaugcgugcgccaccgcgcccggcgacuuggauuuccaaagcugcuauuccuuaaggccucacauuaucccagguucaaagcugccugcucuagacaucauuccugccucugccacaaacacuacccagacacccccaaccccucagcagccugggggcugagggcauauauuucucagguccuugagccuaguaaucuugggcucauggugucaggaggaugccagguccccucacugaucuugccuuccuugcucuccaccccugaccccuaguaaacugcaugguugguucaggaaggggaagccaugucaugaucacagccugcuccaucucccccaccccagggcuucuuucgccgcacaauccagaagaaccuccaucccaccuauuccugcaaauaugacagcugcugugucauugacaagaucacccgcaaucagugccagcugugccgcuucaagaagugcaucgccgugggcauggccauggacuguaaggggcccagguggagggaauagagccagguggccugggguggggaugaguucugggagggcagcuuccuuccaggguacccucagagcccacagggcagaguggcaauccagucuaggucagaauguucagugucuugguccuugcuguccuccuuccugcgcaaaaggaaacaggaucccugugugggccccaaugccuaccugccuuacaacacucgagggccuuagagagggagucguuugguagaaagagcuccugggcacccacucuagcacacuguucuugacucccagcgaaggcaccccacuucuagaugagacagggcaucuuccauuggcuggggauuggguggcaggauauucgaguaaccaccgucaccauaauccguuagaccagaacaugauauucaucuggaucagcccaaacuguuguugacauggucccggggauuaaucaugauccggguugugcugcccaacugcuaggugauuugggaagucauuuagccuccauggcccucgguuucuccaaccuguacucuaggaagaguaguuuccgggagcauuauggaaaggggauggagggugccaugcguuagaccuugugccucucuguucacagugguucuagaugacucgaagcggguggccaagcguaagcugauugagcagaaccgggagcggcggcggaaggaggagaugauccgaucacugcagcagcgaccagagcccacuccugaagagugggaucugauccacauugccacagaggcccaucgcagcaccaaugcccagggcagccauuggaaacagaggcggaaauuccugguaaggagaaagggggcauggggagagcaguagccagguggcagggagaagagagugagcucggagucuugccuccuccaggaagucuucuuaguguaauccaacccaaaauacauacucuucacacuuuugcuguccagauuuuauacacuuguguuuguguccuugcugucuggacugucuacuccauccaacugggagcucaaugaggacagggccuugccuuccucaucgaauuuccagggagcgggagcgaccuuucuucuuuuuccugcccuuagugacugggaggagaggguaaggauacaguuaugucacaguauuuuugagcaccugcugggugccaggcauuauguuaggcccuggucaagcuaguugcuaaguaaaugaugaguuugggaccaggugcaguggcucaugccuguaaucccagcaauuugugagaccaaggugggaggaucgcuugagcccaggaguuugagaccagucuggguaacauacagagaucccaccucuaugaauaauuuuuuuuuuuuuugauacggagucucacucucacccaggcuagagugcaguggcacgaucucggcucaccgcaaccuccgccuccuggguucaagcgauucucccgccuccgucucccgaguaguugggauuacaggcacuggccaccaugccuggcuaauuuuuguguuuuuaguagagacaggguuucaccauguugaccaggcuggucucgaacuccugaccucaagugauccacccgccucggccucccaaagugcugugauuacaagaugugagccaccaugcccacccucuaugaauaauuuuuuuuuuuuuuugaguuggaguuucgcucuuguuguccaggcuggagugcaguggcacagucuuggcucaccgcaaccucuaccucccggcuucaagcgauucuccugccucagcuucccaaauagcugggauuacaggcgugcgccaccacgcccggcuaauuuuguauuuuuaguagagacgguguuucuccauguuggucaggcuugucugaacucgcaaccucaggugaucugccugccuuggccucccaaagugcugggauuacaggugugagcuacugcucccggccucucuacgaauaauuuuaaaauuagcugggcaugggggugugugccuguggucccagcuacucgggaggcugaggcaggaggauccccuaagccugggaggucgaggcugcaguaagccaugauuacaccgcugcacuccagcccaggcaacagagcaagacccucucucaaaaaauaugaucaguuugggaggagauggacaguuggcuauacguggugaaggaaggcagaaaaccagcaccugguucaugguggagcaugccgggggguggcacagugcacacuguuaagggcacgggcucugauuccaagcagauguguaacagucacgagucagacugcccaaguucaaacccugguccuaccacuugcuggucauaugacuuuaaccuuauuauuuagcugccccaugccucaguuuccacaucugugaaauggugauuauuauaauuauuccuuuuaggauuauggucaggaugaaauaagacauguaaaacauguagccugaugccugaucauauauuaaguauucagucauuauagcugcuacuacuguuacuaccguuguuauuauuagcugacuuggagcucugguucuggucuauucucugcucaagaugaaggaaaagcuuugggccugggacucaggcacgggcggccccucuuccccaagcugccuuggagcucccccuggugggcagggagccucagugagaggcugaaaggggucugcggccccagcugacccccgucuuucucucuagcccgaugacauuggccagucacccauugucuccaugccggacggagacaagguggaccuggaagccuucagcgaguuuaccaagaucaucaccccggccaucacccgugugguggacuuugccaaaaaacugcccauguucuccgaggugaguggcagaaguggggagagaugugaugcugugcuggagggaaaccugcucccccggucacccaguacaggcucaucugagguucucuggacaaggagcaauuccuguaggucaacauacacagauaacauacacagacacacacacacacaugcauacacauacacccagcacacaggcacacaugcagacacauacacggacacacacacacaccuagcauacagauacguacacagacacacauacacacacacauacacccagcacacagacacacacacaccuaguacacaaacacacacacagauacauagaaacacacacagacauauacacccagcacacagacacacacacacacacagacacacacccagcacacaggcacacacacacacacaccuagcacacagccacacagauacauagacacacacacacagauacagacacacacacacacacagacauauacaccuagcacacagacacacagauacauagacacacaccuagcacacagacacacacacacagacacacccagcacacaggcacacacacacacacacaccuagcagacacacacauagauacauacagacacacacacaaacacacaggcacacacacacagcauacagacacacgccaaggucuggcugcucuaagaaaucagccggcuccaagugcuccccuccacagccccucauccuucaagucuaugcggccacccaacuccaggcagccugaaaguucucauuuuccagagcacuagugcuggagacaggcugcccuacuagccaugugaccugggguaaguuaccuccauccccugugccucaguguucccaucuggagugggcuggggauaaugaugggugcuaacucacaggcauaauuuuuuuuucuuuuuugagacagauuuucguucugucacccaggcuggagugcagugacgcgaucugggcucacugcaaccuccgccuccugaguucaagcaauucuccugccuuagccuccugaguagcugggacuacaggcaugugccaccacgcccaacuaauuuuguauuuuuaguagagauggguuucaccauguauguuggccaggcuggucucgaacuccugaccucaagugauccacccgccuuggccucccauagugcuggcauuauagucgugagccacugcgccgggccucacaggcauaacugugaggcuuaaauggaauagggcaugcacauggcccaauacaaggucagccguucagaguccaugggggccuugcgggccucacggcucccguaggacacucuaggggagacucaaggacgcggggagggguaugcugagugcuccuguggcccugccgcuccacagcugccuugcgaagaccagaucauccuccugaaggggugcugcauggagaucaugucccugcgggcggcuguccgcuacgacccugagagcgacacccugacgcugaguggggagauggcugucaagcgggagcagcucaagaauggcggccugggcguagucuccgacgccaucuuugaacugggcaagucacucucugccuuuaaccuggaugacacggaaguggcucugcugcaggcugugcugcuaaugucaacagguaccugcugauuagucgggagggcucagaagcuuccaggggucccagagauuggcuggacccugggccuguugcucaacucccuccugaaucuucuucugggcuaccucucugucaccugggccauccccuauccccuguuccuugcucugucacacacuucucacucguuccccaggcccaucccuugccuccccaucccugcucugugccuuuuccugucuuugucuccuuccuucucgcugcccugucccucugucacucacauuccccuuuguuccccacuccccacuuuguucucagccaccuuccauccccucaucccuccucugucucccagucccaucucuuaccccucaguccccucccuaaccccaucugcaccccgccucucugaccaccaaccucaguccuccccacuccaaggcuccucucucucccccagcccccggccugucccucuguccuccuugcauugcccccuccccccaguaccccccugccccucuccacuucccagcugccucccucucccugugcuucuccuguccacgucucucagggggagcuucuccccuccccucccccagccucucugccucuaucuccccucuaguccuuucuucccacguccccacaccucacccuccccaucuccaggccuucggccagccccucgccccucacgccccucuucccucacagaccgcucgggccugcuguguguggacaagaucgagaagagucaggaggcguaccugcuggcguucgagcacuacgucaaccaccgcaaacacaacauuccgcacuucuggcccaagcugcugaugaaggugacugaccuccgcaugaucggggccugccacgccagccgcuuccuccacaugaaagucgagugccccaccgaacucuuccccccacucuuccucgaggucuuugaggaucaggaagucuaaagccucaggcggccagagggugugcggagcugguggggaggagccuggagagaaggggcagagcugggggcugagggagacccccccacaccccuucucuccuuccucucguccuuggauagauucagcucccacacacacacccgcacugcccaggucccuccucagaccuccagcccugggacagggcaaacaacugaacuugcuauggaaaggacagugugggaggcugggggagcuguguccugcaguucccaggaccccauccucucagaagguaggggaagggcgggaggauugagaagggacaagccaccuugaccguaggggaaggaggaaugugggcugggggaagaugcccucaacucacccccuacacacacaugagagagagcccccacccaguuccuuggccuaggucuccccuccaggcugagggccucucuacuuccccagaugccugggugcaaagaacggcuuggcuuggcuccuccucuggagguuaaaauuuauagucauucuaacugcacuuuggaaaccaagcaaggggagaagacaaaugaagaaaaacuagac

SEQ ID NO: 21280 - RNA, 18549 nt, Homo sapiens
aggagaacuaaugggagaagugggggccuuuauuaaggucuggcagaugugguggagguggaaguacaaacccaggccugggccuaggaaagggcagaagaaaggcaaagggucccuuggagcaggaacccaucccucucugcuuauacccagcaccccucaucccagguuccuuucuucaaccuccgccugccucugggaacacagagcaccaagaacugacaaaccgggacccuccagggccacagcguggggcagaguccaggcuucugucuccccgcagugggagaucuggggagcucagugaaccuccucacccuccugccaguaugaaguugggaagcgccuucucugucccccagaacagaacaaacucuuguucucugugguuggggaaaagguguggggggcuuggaccuaggaagaagcugagcugaauuccuccagggcccaggugaaacccccaggggaguuucugagacucuagacuugccauuucuccacuuuuccuucccaaugacuccggugagcagcucagagucugggcuagggcaacugguaggacaguggggaucugccccagagacaucuguggguuucagaugaagguuuccccaacaccagauucauuuauauguacacagggcagcacccaccugcggcagggggaacagccgcugggggcuaguaagaguagccacccuuggggccaaauggcugggcggggccagccagcucugggagguaggcggggcucucauccaagugggacaaagggacuguguccuccucacugacaggccggucaaacucagccuugagagcuggacgcugauuguccgggaaggccaaagagaagagggccucgggcucacacacaaacuuguacacguaacgcucaccagccaccuauggggagagagaaggucuggucagccuggcuagccgcccagccuuuguaugggguaaggugggggaguggggaauguggcccuucuaccaguacaggcagaugcucggggcauuucucucccaugcugguuccugagaagcugacucucccuucacaguucuuacuccuuuuucaucucaacuucuccaugcuugggcuucucaguuacaguguugcacuuuuuugggggaggagaaccuugggauucuccacaauuucuugucucucugacugauucauuaucugauccuacaaaguugcugagaacugcccugcugacccucuccccagucagcuucucacagccacugccccccaccaccuugucccuagacccacagcccccaccuucugcaugaugccuuucucauaauaguaucggagcgagcggcucagcuugucguaauucauggcuggccgguucuucuggaugccccagagccuggcgaccugggaacaaaacaguuuugggguagagaugcuaccuuggcagaggaaaaaauggggguaaggucagaaagagcacuugagauucuuggugcaaagugccaagcuagcucugcaacaaagcaucagcccacagacuuaggcuuggcaagaauucagguuagguaaagcaagaaucaugauggaggcacgugccaccauuucccagguucucccaccuccaggcuguaaacuuuggaaaggagggcugggaacauccgagaggcccaccuccucaggcucaaugagcuugaacuccauuccccggcccguccaggcaaugaaaugggcauuuguugggucauccagcaaggccaccagaaauugccacagcugcagggcaccccggcgcugguagggcggccccucucgaaaugcaccgaccccuuccugcuugaugucuccuggggaacacgaaaauaggaggugugggguuugugucuuuuggucccccaagcaaccgccucccacccgagggauuucucgaaggggucuccccagguacuuuucuaugggucccacccucuugcaacaaugaaacgugaugugacuccugcagggacacagcgugauaagaccuugacccucccaucaacagucacuucucugaccuucaaauuucucagggacaacgcagacaucaucugggaauggucgcagagguuucucauagccauagccuuguggaggaaauuggggguugcucagaucuggggguucaccgaugagaccccagagaguccagagggacuccuggccagggagacccucccccauggcagcgcucccucccccaacauggagggcuuggcaggggaaggggggcugccuuacccauggccccgucaccuggagagggcccagagaagcccucuguguggagguacauugaugcgcacccggugacaucugugggggaagaaggggugaugugagaaguggcuugggguggagcucgagggcaggggaggaggaaguccuauccacauucaagaauuucuuccuuccagccugcuuccuggugacuguucuuugcccagguugccugccaaccacaaaaucccagggaaaguucacccagagggagugugaugcuggaaccccuccucaacuugagggcugcggcugaggccauggaaggcagcagcgggggcugggcaagcuguucugaagggcccaagcugccagggagcagcuguuuccugcgaguucagggggaggagggagggugagaugaacguccggggaaagaguucgguguccacgccuaagacucccucagaauggacaaaaauguccggucagcaggucagguucccagcccugugcacgcgcgcgugugugugugugugugugugugugugacagaaacagagcgugcgccugcaugcaccuggggaagaggcagugggcacugggccuuguuuuuucaggucuaacagagcacauuccacuucguuucauuccauuccauaggauaggaaccuucccacuccacaucgggaaggcggcugugugaagccacccguucaaguuccaaccccuucccgcccuccccccacugcacucccaccuaugaaugagaagauggugaaacaugacaccuccgggaggaggcgggagggugggcucauucaugccuccauuuugugaauggaauuccugacuccauucaggaguagcuggggggaggggcaggaguucaagggcauguaacacaauccccuccggucuacagccuuugaaggucagcggcaagagugccucccuccuccucuccccagcucacugccaagccuggcucaggcuuaugcccuggauuugaggacaggagcaccauccgguucuuaguuggacagccugggggguugugguucaucccccugcccuugaacgguugugggcaccacaaaaagggaaauucuaaaguucuagcuagcucugggccuacucuaauaaacucagaucuagggcuacuaauguaacaaaagccaggaggaaagaagaaaaggcaggguuuucuggacccuuccugggacuggcccuccuucggcccuugaggcuuugaacuauagcuauuuaugaacacaggugagugcaucucacuccagucaacagccagguggaacuagaauuuaaagaagucccuacuuccucugcccuugccucuggccagggcauacaucaauugggaggcucaaauauguaagccacauauuaaccugugcuucuaccagcuugaucaacauggugaaaccccgucucuacuaaaaauacaaaaacuagcugggcauggugaugggcaccuguaaccccagcuauucgggaggcugaagcaugagaaucgcuugaacccaguggcacuccagccugggcgagagagcaagacuccaucucaaaacaaacaaacagagcaagacucugucucaaaacaaacaaaacaaaacaaaacaagaaaacccugcccuccuauugagaacuagcaagaaccaugagccuggcuaguuucaaauucauguuucucuucauucaaaucccuuuguauuuuuaagccucuguggggauagggaccagacacauccuauucaucuuuguauuucccaacucugcacacucguguuccugucacaguaguuuggucuuaauagguaauuaaaaccucaaacaccuguuaaauagaaauaaaugccuuaacuucccuauuaagucacaagcuaccugagggcaggaucuacaucccccuuuauuuuaauuuuacuuuuuuauaaauagacacgaggucucacuuuguugccuaagcuggccuugaacuaauuccugggcucaaacgauccuccugccauggccuccuaaagugcugggauuacagaugacucaccaugccccgggggccccccuuaucuuuuaaucugaauauagguuugcucauugaaaaguaauaauuuguccgggugagguggcucaugucuauaaucacagcacuuugggaggccgaggcgauggaucauaugaagucaggaguucgagaccauccuggccagcauggcgaaaccccaucucuacuaaaaauacaaaaauuagccgggcacgguggcuggugccuguaaucccagguacucgggaggcugaggcacaagaaucgcuugaacccgguaggcagagguugcagugagcagagaucgugccacugcacucuagccugggccagagcaggaccccauuucaaaaaaaaaaagaaaaagaaagaaaaauaacauucuuuugaaauuaugaagaaaaaaaguggguggguggguuggauguaugaaaugguaaacagcaauguaaaaaaacucgggagacauucugggcuuaacugaacacuugaucacaugccacccugccccaccccagucucuuaccugagucguaggcgaaguccgucuguuccuguuugaucaccacccccgccccuggguaccugugcccauugaccccacccugguccacggcuggcuggcccgccuguucauacaggggaucaugguauucuugcuuaaagcucugcuggggauagggugggcagggcuccgacagcugguguugguagggggcugggagggguucccggcccccucccugagaugugaaggaguggcaaauguccaggggcugcuggaagacggagcuggaugugguuggauggagaaggaagagaagagaacuuuaaauuaauccuuccucgagccuguuacuccuaggcuuuuagagugggcuccggaaugggggguaggggguuggggugucaguauuucucccuuucuauuccacugcccccugccucuaccaccccacagcucaagucuuuauggagaacacucaggaauugaaaaaacaccugggcccaugagcaguggguuucccugucuccuuaccuauguuccccgagguacccauggccaggguggggcugggaggugccagaggaucucaggaaauuccguugcucugcccggggaaagggcuguaggggcgacuguccaagggcaccaggggcaggggacuugauggcgauuugucugggggggucauaggcacuggaguugagaaggagacaggggugagggggcagagaagcuggaaagcaucuuugaacccuucauuccuaggaaagcgaggucacagggauuacaggagaaggaaggauagagggggcugagaagggaacggcaggagccacagacucagcccuagccaauucuuuucuuuuucagagacagucucccucuguugcccaggcuagucuugaaccccugggauucauacaggggggauuuguugcucagagcaaugguuuaggugggacagugggccucuugguggaaacagaaucugcucuggccucaguauauauuccugaggcccucugcugcguuuuccgucuauucagaggaaauccuuagcuguauugcuuccuuacaagugcuagaaaauccuuucuguugucuaacuugcaucucagcugcugccucugcucaugggugcccccugccucccuccucuggaacccuucuccuacccuucaccagguccaggcuggggcucaccuggaguaaaggcacugcucgccauggugguaggggaguggcggcuuccugcugcaggacagggccgggucugugcggggacucuggggcuccuucuugauccuggugguggggcuguggaaagcuacuguggggguggaggggacagagcaaggccagagccugucacacaagaggcaggcagggcuucugauaccuucugagcuuugaggaccagcugggugacugguacagccuccuucccucucuggguaucaauuuucugagacccgcagugagacaagaacauuuuggcuauuuacauuaugucuaguuuauacaucagacuagugucugauuauugacuaaauaaaccaucuaaaguucaacauuuaggcugggcacgguagcucacaccuguaaucccagcacuuugggaggcaggaguccaagaccagccuggccaacauggugaaacccugucucuacuaaaaauacaaaaaaaaauuagccggggaugguggcggaugccuguagucccagcuacucaggaggcuggggcaagggaauugcuugaacccaggaggcggggauugcagugagccgagaucaugccacugcacuccagccugggugacagagcgagacuccgucucaaaaagaaacaaaaaacaaaaacauuuaaugcaaccccaggccccagaaaacacuuucaaggagugagcaccuccaaccuagggccuguaguuuuccugagugcccuggaaaauuccaggggagugacauguuuucuuauuugaggauauaaagaaucuuucuuggccgggcgcgguggcucacgccuguaaucccagcacuuugggaggccgaggcgggcggaucaccugaagucagaaguucaagaccagccugaccaacauagagaaaccccaucucuacuaaaauacaaaaaaauuagccgggcgugguggcacaucccuuuaaucccagcuacucgggaggcugaggcaggagaauugcuugaaccugggaggcagcgguugcagugagccgagaucacaccauugcacuccagccugggcaacaagagugaaacucugucucuaaauaaauaaauaaaagaaucuuucuuuuucugguugagguuggauauuggcccacuugaaugucagcugacuaacauuauacacaugcuccuacuuaucugugaagaacacuggccuuuccuguggccccugcgggguucccaaacucuggccacgaggcugagcagcaaagaguugguuccaagccggugugagauucaguuuuaaccgcaguccagucaaaugccguuuguaaccaacuauucucugcuguuuuugauucuuugugccccauuguuucacuggugaagacaguugacagcaaaguaucugacauuaaagcaggguuuguuuuuugguuuuuguuuuuuuugagauggagccucgcucugucacccaggcuggagugcaguggcucaaucuugccucacugcaaccuccgccucccagguucaagcgauucucaugccucagccuccugaguagcugggauuacagguacacgccaccaugcccggcuaauuuuuguauuuuaguaaagacggaauuucaucauguuggccagguuggucucaaacuccugaccucaugugauccacgcgccucagccucccaaagugcugggauuacaggcgugagccaccacacccagccuaaagcaggguuucucaacaguggcacuacugaccugugggccagauaguguuuuauuaauaauauuguaaggagcgguccugagcaucauaggaugcuuuuagcaguaucccuggccucucuauccacuagacaccaguagcaccccacccucaacugugacaaccaaaaaugucuacagauauuaccaaaugucucuugggaggcaaaauuguccccaguuuauggaagugacuuagaauacuagaacugggggcgggcgcacugggcucacgccuguagucccaacacuaugggaggccgaggugggcggaucacaaggucaggaauucgagaccauccuggccaacauggugaaaccccaucucuacuaaaaauacaaaaauuagcugggugugguugugcaugccuguaaucccagcuacucuggaagcugaggcaggagaauggcuuaaacccgggaggcggaaguugcagugagccgagauugugccacugcacuccagccugggugacagagcaagacucugucuuggggggaaaacaaacaaacaaacaaacaaacaacacuagaacuggacucugcugaacuggcccaggccccucacuucagauauaaggcaauggagaaccagagggauagugucugcucuaaggucacacagcaagaacaugucaagccccagauuucaaccaagguuuucauuccaguuauugccuuggucuuuaagaucaaaccccacuguguuuuaggagagaacaagcugcucucuugugauucucuauccuaugacucacuuccugccauccuccacucccuauacccucuccccagggaccucuacucacgguuuucugaauggaaaucaggaacaaacugcucaucacugucugguaccugagcugcagagagaagucagaggugaguuuggggcggagcccugguuguccccugggaggcuccauuauuacagcccugcagauuagcaacagccaagaaaggaccaacagccuuuagaucagggguguccacauuguaagaauugucuugggccacacauaaaauacacaaauacacuaacacuaacgauagcugaugaacuuaaaaucacaaacaaaucucauaauguuuuaagaaauuuuacaaggaauuuauguugggccugggccgcauucaaagcuacccugggcugaaaguggcccacaggcccacggguuggacaagcuugcuugagacuaaaggcugcuccacccuagguccuagugucuuccaccucugggcuccacuaagacccaggagggaagacuguucucagaaccugucugagcagauuccagucuuucuucuucuagaugcuuugucuuuauuuccuccauuuuucugaagugaaacagccucgccccucagaguuuacaaaacucccuuaaagcucacaacagucauaucuaggaugggcaggcauuauaagcagugggauccuguggauuuaaaaaucacauaggaggcggccaggcaugguggcucacgccuauaaucccagcacuuugggaagucaaggcggguggaucaccugagguccggaguucgagaccagccuggccaacaugacgaaaccccaucuuuacuaaaaguacaaaacuuagcuggucguguuggcgggagccuauaaucccagcuacucaggagcugagacagaagaaucgcuugaaccugggaggcagagguugcagugagcugagaucgcaccacugcacuccagccugggcaacaagagugaaacuccaucucaaaagaaaaauaaaauuaaauaauaaauaaaaucacauagggggguggcugggcgcagugguucaugccuguaaucccagcacuuugggaggcugaggugggaggaucacuugagaucaggaguuugagaccagccuggccaacaaagugaaacucccaucucuacuaaaaaauuaaaaaauuagucaggcguggcggugggcaccuguaaucccagcuacucggaaggcugaggcaggagaauugcuugaacccaggaggcagagguugcagucagcugagaucaugccacugcacuccagccugggugacaaagugagacucuguuccaaaaaaugaaaaauaaaggccgggcaugguggcucaugccuguaaucccagcacuuugggaggccguggugggcggaucacgaggucaggaguuugagaccagccugaccagcauggugaaauccugucucuacuaaaaauacaaaaauuaggccgggcgcgguggcucacgccuguaaucccagcacuuugggaggcugaggcgggcagaucaccaggucaggagaucaggaccauccuggcuaacacagugaaacccugucucuacuaaaaauacaaaaaaaauuagccgggugugguggcgggugccuguagucccagcuaauccugaggcaggaguaugccugaggcaagagaauggcgugaaccugggaggcggagcuuguagugagccaagaucaggccacugcacuccagccugggugacagagcaagacuccauuucaaaaaaaaaaaaaaaaaaauuagcuggacgugguggcacgccuguaaucccaacuauuccggaggcugagacaggagaauaacuugaacccgggagguggagguugcagugagcugagaucacaccacugcacuccagccuggcgacagagcaagacuccaucucaaaaauaaauaaauaaaauaaaaaaggaggaugacagugggagagcaggaggcuggugacugggaccacugcagaaggcaaaggacacuggcugaguacauaggugccucauccccuuaaugugcagcuaaggaggggagggauucccaagguuggugauccgaagagcucucccaggaugccaggauggguggagcuggguuggggaauaggcaggaaaacugaaauacagcagcagcucauccauggcuucuaaccugaacaucaaacucugauuucuaguucuuauucuggccuccccagagcggggcuucucaggugguuauacagcuaagaaucucccuugaucccagagucuuggcccacuuuugccccucucucaaaaauaaauggaucacagcaggaaauguagacaccaagaagaacuuccugauauuauuccaggaagagagugguucuagggugaugcaguggaaccuguagcccgaggaggcuggacucuccuucccuggagacugcucucuccuucccuggagacugcucucagauuggacaauggggaaacugauaaaaugcccagagaggucaaaauggcuggugagggguaugagauggcuagaaaaaaccuccacacccccggccuauacaaauacauaucccaucucuuuugcuucucucuaggcuaaggcuccaucauuucuuacuuggauuucacccacggccucuuaccaggauacccuauuuucauucuuaccuccuauggucccuugcucuccaccuaggugucacagugaucuuuuuacaacagaaauaaaaucauuucucucuguuauuuaaagcaugaaauccaaacgcuugcccuuggccuccaaggcucugcaugacuuggccuugccuaccucucugaccugccucuccuugccugugaaucugcagcacucuggucuccuuucuagcccucaaagcugcugagcuuguuccuucuuccccagaugcuuucuugccuuuuucuuuuuuuccugaccaucagagucucagcucacuuugacaucucuggagaggccuucucugaccaccccuaaaccaaagugguuccuccuggcucucuauugcaucuauguuuuguuuucucccuggcacauauugccaccugaauauauuaauuuauguuuaccuguuuguuaucuaccuaucuccuccaccaggaaguuaagcucugugagggcaagagcuuuaucuuuuuugucaucugaugccccagcacccagcacaggguuagaguagacgcucagugcuguuauuucuugacuacaugaauaaacaugcaauaaucguuuguccucaggcuggcagaagucagcacugugggccugagggcaugcacugaagagauccugaccauccuagcccuucccugcaggcucccccucuccacacacaaggcaacacuagaggcagguccucuccaggaaagcacaucucacaggggauauuuuagguugugauauguugcuuggcaagaauauucuucaacaauuugcuuuaaauaucagaggugccaaguguuuauaaacauaggcuuauauuaauagauaguugauuucuugacagaagcauuagggagagggaguuuaacaaucacaagccaccagcagcuaaacgagaacuuaggacaagucaacauaauaauacuuuggucugaagugaccaaagacaucaaugagacaugaaauccgcuggcaagaacaaacagaaacacacagccagcacacaucuuuucaggagcacaaacacggcaaaaagacaaccauucccaaacuggccugauucaagagucaccaggacguuguuaaaaacacgauuacagccaggugugguggcucacgccuguaaucccagcacuuugggaggcugaggcaggcagacgaucugaggucuggaauucuacaccagccuggccaauguggcgaaaccccaucucuacuaaaaauacaaaaauuagccaggcauggugguucucgccuguaaucccagcuacucuggaggcugagacaggagaaucgcuugaacccaggagguggagguugcagugagccaagauagcaccaaugcacuccagccugggcaacagagugagacccugucucaaauaacaauaauaaaaauaaaauaaaaacacgauucccaguccccuccuccggagagucccauuccauaggacugggguggggcccaggcaucugcauuuuaaaaucuauuauaaggaagucuccugugucaggcuugagugcaguggcacaaucagagcucacugcagccucuaacuccugggcucagguaauccuuucacuucagccaccacaaccuuaaaaauaggcacauuuggauagaggguaagaggccaaaucuguccaccugcccagggaugcaaagccaggcuccccacugugcccucugguccauucagaggcaacaucccccaagguggcaggaagcuggggugaugggagcagagugaccaacauuucccucccuccuacuaggcaagaagggucccaagggaaaggguggugcagaacucagggguggcugacgcauuccggccccaccccuggggccucauuaacugcuacuuuccauugagguaaugggcuggggguaucucuugcuggcgucacuggugcuggagagcagagaacccucagcaucaucuugccuuucuuccugccucgggccugacaguuuaaccagggaccccuccaggcccggaauccaggaggaggcuuccuccagcacacagaccacaccccaaaagagguggugccauccucuucccagagccaggagaaaucuguccuagcucagccccucccccaaacacuggccuucucccaaagggguaggccagggcccucagucauccagagacugucaacaggauagaaacaggaacacugagccucgcguuccuggagagcaggagaauuuuuaauuaccauguuucgucuuaaguguacaccacucucuuuauuuauuuguuaacuuggcugagucuuggcugccaagccagugugccagggucuguccccagcuccaucccgguacuaagauggaguuuaucugucuggggacgaggcagaugauuaaggagggggugggaaaagugccaagacagcauaaugcccagagagagagaaagaauuuuagggacucuccuuucaaaaagggggguuaguaaaaaaagaggaggggcuuggggggucucccaagcuggauucuggaagaacugagagguuaaaacagagauacacugaagcucaccauagguuagccacccacacuacauaugcucggucacccucuucccaggauccagucauagggugaaggggguagaggcauucuccagagcuucugcuccauugugucaccgcugucccuuacccugcccccacccuggcagccucuguacuggaaggaaccaguucacuaguuguggaggggacauauuuguccccaagagucuucaggaaggggaagagacagaaagauggagaaggaggcauuguagcugggaaagauuagggaggagauuaaccucaucccuccccacagacaugccgaggcaccaguguacaugcacucggacgcauauucagggaugcacacacccuaauuccuuuuacuucacucuugcagcagcaagacagcacagggugaaaugugcccuccaugcaugcccuccacacauggggucuuuuuuugaccuacaaauaugauugggacagccaaagggcaaagggacuggagcccuuggaggaggguuggggagcagugauuccugugaaaaggggagcgcagaucgaucgaucccuuugagaaucugauaaaagcuaugggucauucucuuccuaaaaaaauccauacaccuuuauguauggugcacuuccagcaauuuuacacacaguaucagagggaucaaggaucccagcaaccuauccauagggcuucugggaauccacagaccugagccucacacaaaggggucauggccuagagucaauggcccuuacuaccaaauagacaacaaagucauuuuccccaaggauucagggcuccugacaagccuggaaaggaaccuuggacaaaaaaccagcauaucuuuuaccauagccagacacauauugggcucagccugccugagccugggucucccuguagcagccugauucuuuccccaacaucucaacagaucccaggcacccccaaaucagacacgcccuccuagccucacaucauucaccccuguguacaaaaacccaaccccaaggauaugugagcugccuccauaaagccgcacucacacucacccuucaacgcccggacgcaggacacugaaccugcaaccacacuggaaucuuccuguaucugcccggcuccaaccugugccuccuccaaaugcugucuucacagacccacccacacuaccaggaccccccugcugcuucucuucaaauuggggcuuuggaaaaaaccaaacugagaaagggagguugggcucugguccccuuuccuccuaaugcgucccaccacuggcaaguuuccaaagaagcuagucccucccugccaccccaaagcuccccauggguugccggggucacugaccuggugggaagagacaggagaggaggcuggggugguguugggauggugcagggggacagggccccggcagcugcaucugucuccgcagagaaagugagaaggagcgaucggccucagcaucccccccucagaccuggccauccaucaccagcugggaaccugagcugcucccucagaaggaaggagagggaaccaaggagaucccagcgcccaccccccucaccuccgccuugcaauccccaccccaccuccccacccacuggauuuaaauguacagggcagcagcauguaacuaacacacacacacucucucucucucucucucucacacacacacuugcugucacaccgacacugacacagacagacauuuguacccucuccagaccccuggccaaggggugggacuuccaagguagagagaugagagcauuuuccucccccucccaucucaaacccaggcacagauggaccagcugcugccaaaaugccaaccucagcccaccccuagcucacagcccuaggagcugcccacuguggggacucucagcugacaggcaaggaaugaagcccggugagccagagagaaaucaggcacugggaaaggaagucuuugagagcccacggaaacugacaccucugcauucuucagcucuagcccagcuccagaaccucagaagaaggauggggagacggggcaaagcucugccuguaaauuggagcugggcaugcaggacuugcagggucggggaugaugcacacaauacccucagaaccuccagaucccuccagcacucacacagccauucagccauuauuuccacaaaaugucuugagugcuugcucuaugcuaaauagucauucugucaacauauauauuuuuagaauaucauagugggcaagacagaccuagucucacuccaaggaucuagucaggggucauuuucuuuuuacuccgagcuucuauggagaguuccaggguaguuggauuugagcuuuaaaaaaauuagauacccaggguggagggaugaggagauccuaaggaaaauaccucaaaaagaccucaaaaaaggaguuccuaguguuuuggcuucuucauuuucauaguguuaaaauaaacccuaagauggggguaguuaacccuucccucucagagacugucuaaaccaccauuuucccucccaccugcagccccaccagcgacacccucaggccccaccaaaacgcacugaagaauccaaccaggaaaccuccugaacacaccacuuccccaucagacccagccacggacccagccacggaccccaccccagccagcucacagcuaacuccccagcacacaggaaggggggaauuugccuggaggcagagguauucaagcgggauggaagagggaggaacacuugcuauuagaauuacaaucaaggcuauuuggggagggagcccugggcucucugugccaaaggacugccgaaaagaauuauuuaaacuuuuguuguucuuuuggcuuggacaguaaauuguuuggugcuggggguugggaagaagagaaacccaggggauaagaaucaaugcuugggcaacucuggaggaugagugacaaauuaauuucuccccccaccccccaccaacaacaccccaacaugcaccuuggccuggcggcuucugcaaaacaaacuuuacaaaugaaaauuucaaccaggaaaaugggccuggggccaaguuccauucaaauaagcaaauaccccacacaauggucugauucauccucaagccuaguuacacaagccuggcucaggguagagaaaauaaauaucaauauaaguguccacgcugggugcuggggugaguagaguggcaagggaccuggggagagggccuuggagaacuccuugaggcagggaagggagaggagaaguguagggcuuaggguggaauaccaggggcuacggagugucccccuguccagccucccaaaauagaaaaggucacaaaacuacucaccuucagcgagccacgucuccuggaagugacuuagauccuggaagagaucugagggguaaauaguggaauuggaggugagguggaggggacgguaagagagaaggggcccuagcaagacccggugacuccccugccuugggaguagggaccgagaagaaugaccaaaaucccuuggagggcgaguuuuuuggggaaacaggcggggguuccagaaucggccguguguguguguguguguguguguguguguguguguguguggcggaggagggucgcgguuugucucucuugcucuuuaccuucagagucgaggggcggcagggagcccggguccaugagcuuccccagcgggccgaucagcgcuucgcgcaagcucccauuuccgggcgauuucugcgagaagcggggagaaugcccgcgagucacccugaggcgcuuagucugggggacgagguugggguccucgggugacucaggggcggggcagcccaggacuccgcugggacugcggggaggggggcuguggugagaguaggggcugggugcggggcggggcgggcguggaggccggcgcggcgcucacgcugcugaagguguagggcacuugcugguccaaguauccggcuuucauccuccgcuccauccggccgcucccuccggccgcacggccggggccccaagcgggggccgagaccuggugggggagggggcugcguucgcacaccguccagggagggcugcgaugggggcggggagggggcagucccaaggcucuggguccgacggcgaaacuucuccgacucacuggggcgauggcgagguuuccgccugccaggccgagcgccaccaccacuccccucccgccaaaggccaaaggaggucccaccugcucccaggagccgggcucgccguuucugcuuucugcagcccugcuuuacccgggcucgguuacauaagaacguguguguguguguguguguguguguguguguguguguguguguguacgcgcgcgcgcgcggaggagcaggcgaagcgcacaccaucgcaugcccacaacucccgcgcccccuccaacccugaaucccagcaccucccacccccgcccuggaaucugcggaggcggguggugagagugaguguggugugcauuggaggcgaggcggggaaucacagacacucucccucccuuucccucccgcagccucaccugaggccggggcgucugggcuggagccgcggggggucccgagcaugcccuggagcccgcaccgagggccgcggggcuaggccggaguaaggcggccccggccccggguccccagcgcaccgacuuguuuuucgggcgcagcagacaguugugagcccgggggagcagcugauuggugcauuuccuucgcucggccuca

SEQ ID NO: 21281 - RNA, 15952 nt, Homo sapiens
gucaaaccuuuguuuuucacuuuauuauacaaaaaagggaaaacaaaacuuccacaguuggcuuuaagcauaggcagacaccucuaagccacucccucccaccucccaugauacaaauucaaguuguggugguuguugaauccuacaaaacacuccuuaaauauuagaaaagaaguuggggguggggaugggggucuucccaccccagccaucccaucccagugccaaaaugcacucaagagugaccucuuacagcaccaacacccccacccugacaguccuguuuguacuguaagaauuuuucaauuuuuaaaacaggaaagaaaaagugccccauucaaaguuguuuuuaaaugaaaauacauuccacugaaacacaacaguguaggggcauccaaauaggaaacugggguucuuugcagggcucuugggaagaaauagaaccuauaaaccccuguacuuaauuccaggauuaggacaaaggaaggggaaugggaguggggagugucccccccaggccuccccacccccagcaccaagguccaaggcaaagcagagacugucugccuuccuuugggagagggacccaccagccucucugggaccagggcccuucaccguucuugcuccaccuccgcggcagaguucccgcucuucccccauuccuuggcuuucauucagagggggaagguggaaaagcaccaagccccaauuuaauaggucagugacaugaccauaaaaaagaaccccccaaauuuagucaacaaaaaaauaagaacuacagagauaagguggcuuggcuuauuaagagucaaggaaucaagguaccaaaaaauacgggagauggcugggaagaguuagagacagcugcagaugcagcuuuugcagacuucuugcccagcugugggguugggggaggagggagcagaccugagaaauuaaaggaaauaggggguggugggaggauucaaggaaggcuggagggauguguaaguuaggagcucccagcacauuucuugaagcccagguucugagccugggguggccaggcuuggccucucagaugaacaggggagaccuuuuccaucaaauacaagcuuuaagcuucacaccaucuugccugccuuuccgccuuccugcuggacaauggagaccagcagcucggaugcaugugacucuggcagagggagccuggucugggaagcauccgagaauggcuucagcacacucccccuaauggaaucagagacugggcaaaacagaggauguggagaacggggcagccucagccugcucccaccagggucaacaucucccggcccucaccgacccuuuuuccagauucacaacaaacugaugugggcucuaggacagaccccuuuacacacacacacacacacucacacucuuuugcacacauccacagcugcacccaugcuauguacaggaacacacauacacauacucucuuccacauacaucaagaccauuuuuaaaagguuccaaaucuaccccuaaacccucccucucccagaaaugacaacagagacggcagccgagaucgguaggaaacgucucguugacagcucagagcuuaaaaaaaaauauauacacauauauaaaaaacacuucugcccccucccccaugaacggguccaggcagcuccuuccugcagggggcaggggagagggccaccagggcagugccuguuuucuugaaggcaccgacccuccuccuccccauguucccugccuccaguuccaaugcagggguccagguggcaggccccucugggaaggaaugggucuuccccaagcuuccaccccaccuuggauugggccgcagguguggagggccucaucaaacucuuugggaccccccacccccacucuccgguccauuguccaugccggaaccgcaagugcagaaguggguggggugggccaggcugguccggugcuggcuuagucugauaguugcugucccuggaggaggacccccaagggcugaugucucugaggcugcagaguccuggccugggcuccuccagcccccuacccccaccguauuuuuuuuuuuuuuuaaagaaagaaagaaagugggggaggccaggggggcaagggacagaacaugggggagaaacaaagguggucaguuggggaggggagcuccugggcucucccuggcugcccugggguggggcugagccucaguuggagucagagucugaggaguccccugaggaggaggagcuggagcugcugcccucggacucauuaucuucauccucaucgucauccucgucgucgucuucguccucgucauccucuucauucuggggggugagaaaggauguggagucaccagguggcccuccuggcaggacuccccuccccucccacugugcccugucugccccaccucauccccauccucgcucucguccucgcugcuggacucagaggagucgccgccaucuucagaggaguccccauucucaucaucuuccucuucuucauccucguccucgucauccucauccucuucaucauccuccucggacuccuuggagggauggaggcacaucaguggucucuggucucugcccaaccauuccaggcagugccccccgccccacgccccugcaucugggaggggcuccuuaccgacuuggacugcagaguaguccggcuggauuugggguuugggccucgcagcuuggucaugcucuuacguuucugcaggauggggacacaaagguggcagccaugaguucgacaccccugaauucccccaccccuaccccacugcugcucugcucccagacucacauuggagauguacucuuuauaugcugcacgguccuggggagacaggcucugggggagacagaagcggcaaggguuggaacauagccaacuacugcugacugagcaugcuggcccagugcuaggcagugggcugagcauuuauauaucaucaccccaucuuaccccucccaggcucccuagauuuugggucucugcagagagccccugggaucugagaacacagcucuaauuuuuuuuuuuuuuuuuuuuuuuuuuuugaaacagggucuugcucugucacccaggcuggagugcaguggcacaaucucagcucacugcagccuugaccuucccaggcucaagugauccuuccaacucagccuccagaguagcugggacuacaggcaugugccaccacaccaugcuaccuuauaauuuuuuguagagacagcaaucucacuauguugcccaggauggucuugaacuccuggccucaagugauccuucauaccuugggcucccaaagugcuaggauuacaggcgugagccacugcgcuggcccaaacccuaguauuucugcuucugauacccagaguccuucucuaaaccacuaagacuauugguuuucacauuuucccuguugcuuuucgcaaauggaagcuccuaucagagucuuccucacuccaaagaagugcccccgugaugagucagccuggcaucaucaaccacaccccaacaccaaacccuugagccaucgaugaggcaguggggcucaccaaacuccugaaacagcaaauccccacagucuuccuggguccuuggccaaccugccuuggugagugggaaggacacaggugauucucuccacuuuacagaucugacuacucaaccaaagcacagaggggaagcacaaaggccaggagucuaggagaggucccguggucccagaugggggaggaaaaggcagucugauuuggauucuucuacuuacugugugaccuugggcaaguuacuuaaccucucugagccuugguuuccuuauuuuuaaaagggugauaguggcugcggacgguggcucaagccuguagucccagugcuuugggaggccgaggugggcggaucacaugaggucaggaguucgagaccagccugcccaucucuacuaaaaauacaaaaauuagccagguguggugguacaugucuguagccccagcuacucuggaggcuguggaaggagaaucgcuugaaccugggagguggagguugcagugagccgagacuacaccacuguacuccagccugggcaggagagcaagacugucucaaaaaauaaaaaaaaaaauaaaaauaaaagggugauagugaccguuauccugaaggauugcgagggcauggaaugaaaucaugaaugagaccagccagcacaaguggguggaugggccaggcuaggauggugcuggcuuagucugaugccucucuguuccuuccaagggucccuugcccucucaccuuaacccagagguccaggugcaccuuguacugcuuuugcugcuccucggccagcuuuuuguagugcuccuucuggcucugggagaugcgcugccagcgacugccgaucuccaccaugcgcuccuucagcggcaggugguucagcuccccauuggacagcagcuccugggagaacuucugguaaccguuccugggagguggguugguagaaggagggucaggaccccaacaaagcagccauccagcccugacccuccccgaccuccagggcagacuccaacccccaggcucacaugggaggcuucuuggguucucccuggaauuucaucuucuuggaagaauuuguagcagcuggaggugcccgcaucucacucagcucucucuggagggagaaaggucacgcucaccccccagucccacccccaaaauacugcugccuucugccucaugccaucagcaccuuagcuggcugucuuuuucugugccagggaggaggagaaacagguagcuagugagcaacuuccuaacagcucacgucugaggcaggcaccacaguuuacaagugcuuucacaacugcucgcauccuccgagucagccuggagguuagcaaugucacccccaccuuacugaugagagacagagguucagagaaggaagcugagacuugcugagagucacagaccaaggcugggacuucuugcucagagcugcccaaccaaaggggaguucccgagcuuucaaugaaugggguggccccagccccauuccuaccucauaucgcuuuuggucuucggcugccuucuuaauccacaucaguuucuccuucuuuuccauguuauuccaggucauuuccauggcuuucaaggccuucacccggucauucuggggaccaauaaggguaucagccgugggaggggucacccggggcuagaggcugcaguacuacccuuucccaccccugucaccuugaagcgggccagguagucgccgauaacgcucuguugccagaucuccucagcucuuuugggggacucgggcagcuugccccguuccucgcgcuccccgccgggcuuccucuccgacugagccuugagcgccgccucucgggccuuguacuuggccugcggggauggcccgggcgucagccuuccacccacccccagggggcgcgcgcuccccgcgcagcagcccaggcgcucccgccggcgggcagaagcaugggcuggugcagaugucucccgccuggggcucgcccccgccuggucugcggcgcucagcugacagcuucccgccuuccggcugcugggcgccggccccacgucccagcccaggcaccgcguggcucaggcggccaggggcgagguggcacggcccgccaaggggaagagggggcccuggcagccccccugggggcacagcgcuccgccaggcagccugaccuucuucuucucagacaggucguuccacauucgggccagcaggcgggucagcucgcucucggagagcucaggccgcuccuccugcagcugccgccguuucuccuccgagaagaugaacauggccgacacgggccgcuugggcuucucggagccgcccuguccaggugcagagggucgggguccgugggugcugccagggagcccagucuugcccacccccgccugcgcggccgcacccucugcccaccuugcccccuuccugggcuggcuucuuggaggcggggcugguggccugcuucuuguugauguucagcaucuucucuucccccaagacccgcugcugcuccuccucaggcaggcucuggacaggaaagaggagcacggggcugcaugccuggcacccagacugcauggugcccuaucuccaggggcucaccagggcucugccugccaagucccagucuucucugcccacugccccaccggaggaacacucaccucgaggaaacggagcagcuccaccucguaaucuuucuuuuucugggaaagugaguggagucaggaucagucuggagacagugucaccacagacccugcaguacucggaggacagugaccuucagcgggccuccagagccugggugugggcuggacucccugccuggacgggcucaguugcuaagcccagcccagccccacacuguauuggaggcagguacccaaggcacacgccaccagggacugacuggcccaagaugggaucagaccucaugcuucaaaaccccaaggcaggguggccccugccacagcucaccugaucacacuucuugugauaggcguccuucuccuucugggacagcagcuuccacugcuggcugcacagcaccaugcgcucugugcugggcacguccuucauguuggccaugagcucugcgcaguacagcgaguagcuguuccuaucagagccgcggggagagaggugcagcccguaagcgagcagggcagcaggccuucucaccugcagagcccagcccaacuucccagcugcccacucgcccacccaucccagggcagcgcucacggagguggcuuggugggucgcccgucaaacuuguccuugagcuggcguucggccuuggugaggguggacuuggugauacccuccucacugauguucagcucugggugcuucuggauauagucucucaugaucuccugcagagccagguggggggacggagggcaaugggguguggaguuagcuagggcaggggcagggggagagccgcuggggagggcaggcagggagcaaagcuggggguggcugcgcgucaguggugucacacgagacguggugcccugcccugcccuagccugagaucucaugggggugggggguggggaagguaggggcagaggugaggggcccagaaggccccucccucaacagagggauggggagugacaccucccgcagagugcgguggccacggagucggagggcagaggcucgugaagagccggacggggaggagcgcagcggaagccuaaccucguacuccuuccgcugcuccagggccuuaugaauccauuucagccucuuuuuguccgagagcugagaccacugcuuccccagggaguccuucaccuccuucguaguggccugcaaaccaaaagccgucagacacgcacaggcagccaggggcagggggaggggggaagggggaagggggcacagaggcccccgcccccucaggccaugggaggucacaucagugucccccacaggccaggaggggaaggcggagaggcggggaucccgccugggugcaaggggacuggcucauacacgcacgcacacacgcacacgcuugcacgccagcuggcccgggcccuguccaugcagcccaccccuggggaggggccuccucuccugcuccccugcaccgugcccggccgaccuggcgcggcuccccccuggccaccgccgugcauccuccacccccaacccuuggccggacacucacaucuggccgcacuuugagauacaccuucuucucguggguguaccacagcugcugggggguuuugggcuucucugggauguccgauuucuuggcauucuggauuaggucggggugauccucccuagccaggacacggggagcaaggaucagcaggggacgcugccagggcagacucaagcuagcugccccacccaccaagccuccugggccuuucagcuggggcucagugggacgguggcugccugccugucucugucccugagcaugacacacuagggcucacaugugacccauccucuuccaugccucagagauggcaaacucaaggcucuggccaggguuagccuauucugcugcccccagugccccguggcccuccucugggcuccacugccuuaccugaaucgggccagguuucgcucgaacuccuguuucucucucuggaaguccugaauauauuucaucuggggggaggaggggauggggucacucaggacccaaggguaucucacccugagcuaugaaggccacccagaccccuccucgcuggcucuucugccucccacgcugugaugcagggaguggaggcuggcgcccugcccgccuccuggcgggacucaccacagagcagaccugcuggcuucuaccacagauggugggagcugcaggggucgcccagacacugaauccuacauccuauucucuccuucugagcaagagucccagaagggggccauggcauuacccacggucacacagugcgcaguggcagcgcugagccucccccacucguuucuccaacaccauagaacucucacaguggcgucgggugcaggccuugcuccugucacucccucuucucacugucuguggcagcugacauuagucuguccccuuguacguagccucuacaucuauggccagggcugggcugaguccuguuuccaaggcaugaggggagauuguguggaggggaacccagagcgaguucuuccaauacaagucucagccagcuacccugcaucuuccugcccaguucucacaccaucaccuucuucucuuucuccaggauccuggcugucuggccccuccagcccucccucccucagcccacucauucuuucccaccacuuggcuucccuucccuucaucacccccuuuuuagccuccccacucucaccucacucccucccugcaucuuuccccacuucuccauagucuccuucuuguuccuccuuuccaaugugucucuuucucuuccucaucgaccuucucucuuggcucccacacaauguccaucucuucuuucauccucgcgggcucacaagaguggcacuggcaggugccaggagcucauggcaacugagcccaaccccugccucuuauagaagcaccaggcauagaaaggcagugcuccuuucccacaguucccacagaaaaccagaagcagagcucagccuccucuucccccaucucaguccuccucagacaaaacaguuuuagaccugaaggggaccacacagaccuggcucaccucacauaaagaccaggcccacagaagugaaaugacuuaccaaaggccccauacacagcgguucaguggcagagccaggagaacaggcccaagucuugugucccccaggacagcaccuuguccacucuaccaguuucuucuggccuucccuggcucugacucuagagcuuggccucucccucccaucccaugagaguguuugggugugugcagucaacuguccaacauccucaucaaaggggucaacaguuccagcaauccauaccccucucugcuugggcagugguugcagacagcuggcuuuuuuggguacagcaccaagggcaugugagucugcagccaggguaugccaaccaggaaaaagggcuacucauagcauggcagcggccagugcccccuuuugagaacuggcuguguaugacuuuguuuccucuccaagcagaugugcuucuugucuuuccugcugcccuuccccaucuaucccuggcucugucuccuugucccgugucucuucuuuguguccucuguccccaucccaucuuccucgugucccaucugcaggcuccuccaauguuuugcugccuaucucugggagggaccuccugagcucugugacugagcccugccugggaggcuuaggcaacccuccacccagaguuaaugcuuugauggucugggacagugcccgaccucugcaaggaacaguaugaggccaggagggacaauguguguccuugagugaacacgugugcguggagaagugcacuucacagguggacguggcaguaacagcacuggacugggacucuggggcacuaaauccugcucuagcaucaauaguugugucacccgggacacuuaacccuccugcaccucaguuccuugcccacaaaacugggauaaccuuuuccuaggguuaccuuuauaaagacauugcaaguaucaaaugagaccaugacgggaaacgucauagagggugaagaagugcugcggagccuaacagugaggauggguguaugggggagagagagcuugaaacagaaugcuguggguuuucuguagggggaaagguuggucugagcaccugcugucugguuuacaucugugauggugccugugccugaccaugugugggccgaggaaggggcaaucagguguggcugcccaggaccuauucugcugugcugacucacccucaucccugaugccagguuucuccaaggccuaccuccaacugacccacaccacaccagcugcucccagccucuccccuccucccaccuuaacucuccuccccccaccuucuucuucuccggaagcuccuuguauuucuuggacagaaucuugguuagguccagguugcucaucucaggguggaguuucgcauacuuggcccgcuucuccaugaagaagcggaaauaaggggucaggggcuucuuugggaagucuggguguuucuggaagaagggacaaggacacaauggaggucaaauacaucccuucuuuggaccuuuccucccauaccccucaugcuccuccuccuaguaacucaccuugaguuuuuugccuuuguaaggauuuuuaacauguuccugagcaucgaggaucaauucugucaauguacggaacuuccucaccuggaggaagaggggugggaggaaggggaaguugggaaaaggaaaaugccacacaguaguauacccccaucuuauaacgggucucuucuacucuuuacuagacuaaauuuaccaaagaagagcagaggccaacagccaaaugaagcaggcagcaugacacccaggcacuggcccaugccuaccgcagaggcccaggcagucaguacacaccaaaggccagcaacaaggggacuaacugaccucaaccugguuguccaugcuaacaccuccgucaaucucagcaugcuagcaccuccgucaaucucagcacagcucaggcuguuuggcucaagaccacucagauagaaaguggcauaacuuuaagccagugcugucaaccgugccaccucccaaaaugcaaaggggcagguagagagcuaacgggagaccacaugaaugccucuccuggucucuuuccuuccuguuuacagccuguuucacuucccccaccacgcugagugggggguauguguguaugucagaaaagggggaucaguuaccucauuagaaaucuccacccauuugagcuugcacaugucuccagaaaagucuuuaaaugcuacuuuuucccaguccaugugugauucggugguuuugaacuuggagcugucauuggauggaagguuguucuucaugcauuccagcaaagucagcaugucuuccugggaccaacggucugguaaagaguaacagaggccaucaugccuggcucaugcuauccccccgaucuguuccccaguucuugagugcucaacucuuccucccuagggcaucccagccccugguugcuucccaucugaaggcacagacaagauauggcucagcccuaaggaaacuguggccauauuggaucagggcagggacuccaguccagaccaugcuauaccuagaaagccaggcucgaacucaagucuggcuugcuucaaggcuauuaucauuuauacugugccaagcugcaacgggcagcuauuugcuguaaggggaagagggguggaaaugaagguacagugauucagggcuuugugggaaacgagguagcuugucagagaaggagggaagcagggaagcaauauaucuaaaugugcugccaaguucaaguucugaguggauauucuaaaugugcaacgacugagaaugggguguggacaguaaggaaaauccaugcagaugucucuccugcacagcuggaaaccaauguuagagacacccaccacccccuagccccuuaaagcagaucaagggagaauuucuggcaaauaagaaaaaggaaacagaagcagaagcaggauacagggcagcucugaggcaagguaggcaggugcacagaaacucucagggcccugcuccagggagaacccccagaauuacaagcugucuugucagcccaacuacccagggaagcaagaacaggucuggaacaguuauuuuucagccacugaaaugcagccccagagagcucuaggccacuguggaugggcugggagaauagccacccaaggccagaagucaaaagggcucuccauuuucauuugcaucugguaaccugggccagagauucugcagaaugggccacguggacccauaauccccucuccccucaaugucccacaagcauggccagcuguccagcuucauccuacucucuauccccaucuagacuggaucacugcugaaugaggcagagaucuaguugaguacauauaucccauggcuuggggccuaaaaccaccaaaacagcccuuuucuccaccugccucuacaaaagccucauggucuuccuaaaaagccugagaagccuuccccaaccccuuccugacccuuccucuacacucauccuuccucccauuccaggacacugggcugggacacacuucaggcugaaugggaaccccagaaggcaggccuccucuaacacagagggugagggacagggagagaggggaggugagccacuccaggccaaauaauuuggauucagccaaaccccaagugugggagaugcuugauucauaaauacucaaggcacuuucucccccaguucaguguaugcagacugaaaaagcccuugaagaagggagugagccccgcagccacgagggaaagaggguuuaaguuucagagggccggggguggaugccccuaccuuggccuuugggggcggccauuuccaggucuguggggcagucggcuucuccguucauccuccagcuguccagccaccuccucggucgugcuggccgggcaacccggggucaaagccaccucacccuuuggaagacauaccaguucccacucaggaaggcugagaggugaacgacuaacgacuuucuaaccgcccagaguagaagggggcagguccacacucugagagacucagccaugaccuuauuagacuuaaggggucuaugggaaugggagugcgccccuccucuuccucgugacccccucccccagccccugcagcccggcuccgcggcgcgcgcccuccccuggccacgcgagggccugcuccuagcucccgcgugcagcgagcgcccgcccuccgccccgcuucccaaccccagccaaaaaaaaaaaaaaagaaaaaaucuccuccuccucggagcgcccgccccggggaggccccaggcuggagggcgggggaagaggaagggcggguaaagggcgcgcgcggccacggaagcgggcacgcgccccagucuccuccucccgccuccccccggccgguuccccccgccuccgcaacccggcggggacccggacgcagcgcagccgccgccagccccggagcggagcggccgcaccgcccccggggaccggauccggauucccgccgcuccccccucccgggcucccuucgccguccccgcccgcacaggcgggcaagcagccggagagaagcggccuagccugccccccgcccccgagccacccaccccggccagaggcgccgccaccgcccagccaccccgacgcgcacggaggagcccggcacagaggcgcgaccgcggcgggaaccgccgccuccucccccgagccugcggcccagccccgccggcgcccccgccccggccuccggggagccgagccaaggagagggcgggaggacggcggccgggaggcgggggcgcagcgcucaccggccccgccgcccccuccggcggccggggagaacugcgccugccggcuccgagaagcgcgggcuccuccgccagcggccggggcucggcucaggccucgcuuccugccuuccccucccccggcucucggcguccucccaagugcccuggucugcucgcgcccggucgccugcucgguggucgcuucggguccccgcugggcgcccaccgcaccccgcgguucgcucccgccguccggccccgaccccagcgcgcguccucagccgccucgguuacccggcgcagcgcggccuccgggcuucccgcuccagcggcucccucccuggcucugaguggcggcgcccucccccgcucggccgggcacagccgcagcucccucccgcggcggcagcggcuccuccuccgggcgaggcggcggcgcuggggcggcggcugcugcugcuguggcggcggcggcggcggcggcggcuguggcugcugccugcugcuccucgcggcgaaaagcacaaagcacagcgcccuccgccugcaggcagcccgcccgccgccggccccggccucagcucgcacaccccccgccgccgccgcagccucagccgccggagcggggaggaggagggagaagggaggaggaggagcgggagggggggcgggagaagcggggcagcgagcgcguccuuccccguagagcgcacaccgacccccggggagcgagcgccagcccgcccgccucgccggcuccgcucccucccacagccugcccgggcgggcuccgcggggggcagcugggaggaggggcgggagcuggggggacccgggcggccgaggcggagggaaggaaggaggggaggggggugguggugguggugcuggcggcggcggcggcugcugcugcugcugcugccgccgccggggaagggggggggggccggggcagggagacacgcagccgcccggauggcggcggggcucggagccuaggcgggcgggcgggcgccgagagcgaccucgccagacccgcgggggaacuagcaggcuucgccggcgagggagggccgaggugcggccgcggagagggugcccggaggugcccccggcguccggggaggcucggggggcgcccacagcccugcuccggagcucucccccaaguucucccagcucagacuagggcuuccaggccagcucucucccgccucccggagcgagcgguccgcgcccacccucaucccccggagcguggccgcugguuuggggcgcacgcacgccgaucgcggcguccagcuucggugccuaccucgcgguccucuccuugccgaacggcacauacgaaacuuaaaaaaaaacccgaaaacuaaaaccucugcauuaaaaaaaaaaaauccccguugcucuuuacaccccggaaacggcaagggaacgacgggcuccggcggaggggccgcugugggagccgguucaauccagcccggcaugguucuccaggccugcccgggcgcaugaagaucggcgccgccgccacucguagcaaccccucucccccgaaauccgcggcucccgggcucacuuaccgagcguguggaugggagcgcaggccgggggcaccugggagcacggcgggccgaacagucgagccgcagcuccgcugcagccgacgccggggcagcgagucgccagacaaagcccgagauggcgaagcggagcgacggcuaauggcgagccccacgcgccgcgcuccgcccgccccgcuccgcccgcccgcccgcccgccucggcgcagcgcagcgccgcuccgagcgcuugcccgucagagcc

SEQ ID NO: 21282 - RNA, 56067 nt, Homo sapiens
cccucuucauggucgcgggcaaacuuccuccucggcgccucuucuaauggagccccaccugcucgggcugcuccucggccuccugcucgguggcaccaggguccucgcuggcuacccaauuuggugguaagacucgccucuugucugcccgcggcccgguuucuccgccgcguccggggaaggugggggcgccggcugggggugggccgcugcagggcuggggcuccucuccucgccucccuccagccccccacccgcccaccccuccuggauuuucugcuggugucgccuucagaauccaacuccuggcuccucugauaaucaccauuuucccugcuccccgcugcaggggcuggaggacuuuucccaucucagaagguuucuuauucuuagauccuaacccucugcccgucccaaucuagaggcccccgaagaccccccauuugcuugcaguuggguuucuggaaauccagcacugucccuggggcccagccacuccucuucuccauuuuggggucuucaugggcaaaaccauccuguuccuucacugccaccccaccucugccggcgccuccaucaagagauuccccauaauaaccccccuuugccuuccuauuucagaccccaaaggcuucagggcuccucccggggcaggggaguggguggggggauuucaucagauucuccccaccgcucuagauucaucuugagccucugaagugaauaugguauuugcugauccgggaugccauugaauucggauuuuauucauuucuugcuuguccacccuggcaaaagggggguuccuugaaaauguguugucugggagggguaggcuuguuguucuuugaccaaaaauccaauucuccaugucacauuucuuccuuuuggaaaaccgaggaccgaggagaaagggagagggaagggagaauuccgucccugagaaauguggauacaaaagacauuuuaguaaauaagacugggaagccgggagcagugcuuggggggggcugugcgugucuggggggccugggugaggaauaaacaucgcuuugggagccccagcuccaggaguccccuuguuuuccgagcggccccaucgccgcucucccacccuccgcaggucccaggggccagaggggaagacacugaaaccaguucucuaaauuacacuccgccucuccccagucuccagcccccuacauuccggaaaacuuuaauuaaagaaucuuccccuccuggacauaggagagccuuggccugggcggggggaggugaggaggaagaauuugggaucugugagugagaagugggcuguggcccccggggugaaagucagaaagaagugccaccacggugcgguaccgccugcagguccccagacucccugccuuucgccaacccagaguccaggguaggaggagcagagacagcgagacuugggggccacaccccgagucuuccaguuguuuggggauggcagcauuugugucuggguguuuggggcuccugggagagaggguggggacauggccaagggucucuguuuagagggugcuaggaguugcucccaggacagccagccaaggggaagucuuucuucugcccaacccacacuuuuccggggggcugggcuaaccugaggcuuccagcacauaaagaaguccaugggguggccagggcagccagggacuucaggaaggagguucggccagucuggggaaaggcugcugccaacaccaguccagccucacccggccauuccugacccucuucccauucccgggccaaggccaugccguuuuucgccuugcuuucgcagagacucugguggguugggggaggguaggaaggaaagguuuggcggcccauagguggcagggacugaggaagagagaccagucucuccggcccuaugaacuagaagagggcacucuuccaguugguguagauucuggugugaaaugguaucuuggggaccaucuagauagggauugcccaauaggaagaaacgcuggggaaaccuggaaggucaagacauuggcccuaacauaaugcuagacacauggcuuguuugggaauuuggugggggacaggaaugcugcuuugucuaagccaaggagagaggugugugugugugugugugugugugugugugugugugugugcguguguucugggucuaugacccuaagagguguuuucuauacaccagugugucucugugugcaaaaguguuugugccugcaacugggcuacuauggaugugaaaucgugugggcguguugggggauccaugcccacgacagguugugcugugugugucugcacacgagugugagcaaguggcuggugcugugauguguguauguacauguguaagagacagagagaagucuagaaguaucuuugcccauguaaaggucagagccugugucugccugugacgcugggcuugacuguguucaugacugggcaugugagugugugugugcgugcgugcgugugugugaguguguguguguguguguacgugcgcgcgcaugccuucaugacaguguggggaaagccccacagaugucuuugugcaugaauaucagugcucauggccaugaccugauugugcuuguaaggaggagagugagccucaaguccauagcugugugagggcugugucugaguccgccugugauccuguccccaggugcugggcccagggcuguguggcugugaauaucuuugcagacaucuaccuguggguaugaaugacaccugagcuuggguguuuggugggcagccaugggccuggagggaagguccaacaggaagcaaaagucucacaagguggcugcagggggcacagcuggccagggauggcaagcuagagaggcaggggcacaggcuuccuugacaccagcuuguccugucuguccaggcacuagagucacuggcccuucucucugagguuguuuuucuuuggucuuggagcugggguggagggugagucaccuucucaggguuagggcuggggcuguaggguagaugggccucugauuccugaucccauuucugcccccacuccccaacccagccccccgccuggcagucagauuccaguacuuugagcaucuaagcccaucuuggccugcccucuuuggcccacccagcucaugcauuccccaggaaggauuuacaggggaagucauguagcugggauuucuguccacgcggacccucaagcaugacacccugaguccacacugcucagaccccaguccugacagaagguugaccagaagggacagcucuaaggggccucagacugacaccccuggaaggaagagauguucuccagguagugacagagccgggacaggaaacaacagcacugauuucucgaauuccccuugucagucccaguuagcuccugguggagaaacuugucuuucuucuucuucuugggggcgcugggguggggggaugaaccuauguuauuagggccuagcccagcaccugcuacauuccagcgauggacgugcagauggagggggccugcuggagaucaggagcucacccugccgcugugugacugaggaccaguggccacccaucugggucugcuuccuuacacuucacccaggaguccccagccugcccugccucacagcuugggugaaaauguuuugcagaggacaagggcagugagcugggaaauagcacaccugaguucucgccaucccaggacccauccucccacucgagcaccugccuaagaccuaccucaguuuccccaucugucagauguccugcugccucucccacccacucccaccuccacccaccuuucagaggcuugugaacauguucagucaaaccccgugggggucagugggcugggcccagggaggcaccuggagacugcgggggaggaaggccccaggccagguguuaacacuuguaacaggcaggaauuacagcucgcuggggcugggcuggcuggggcuggugaggagcugagcuagcuggaggcuguugaucccacagacagacagacagacagacagaugggcagauaccagaucggauggccaggcuuuaaccggguggucucccuuccagggcagaccuuucccugggggggauauggcggggaaauuaguccaggucucuuggaaguuaacagcccucccgcucaccccgcccccauuauggguggggcuucggaguccagagggagcaaaauugguggccgaucuguugguauucuuccgauaggaucacauuuugcuuaaaaagaagaaaacaggucaaacguuauaauaauaccaagagccugagcugaguuauguccuuagaagaaccugcuguaauauguauguggauggcaugggggaaggggacgcucucagggaaaguucuagacucucagagcauuuugucaacagcuccggggccaagaggugagagauggguggagucugaguaucacccccaccuccaccccagggauccugagggcuugggucugugaugucugcccugcaauuaauccuggccuggugggaagaccuuuggcgaugaggucaaaagaggcaggagcuggacuuuggugccaaguccuuuaggaggugcuugcugcagcuucaccaguggcaaacccagccaggcccuaccagggcccacacucuggcaucuggauacaugcucagucacugacaaagguggagaaacugaggcagacagcgagggcucuggguggaaaucuccaaagaaugcacucagccuagcaagcaucucucauccuccucacuacagaacuuaaugcuaauaaacauuaaugguacuugggcagauguagaauuggaagaagucucuccuuggucugggcaggagacaaggagccaggggauaaggagccaggggauggcacaggaaaggugacuuaucacagaggaggaugcagcuaacaaacccuuccagggaaaaggaagugggaaaaaggaagauuuuucuggucucagaaugugaugagccaggaguugagcagaaccuuuuccaccuacccugaugugagccacagaaaccuucuccagcugccaaggagggcaagacauccuccaccccucauuccuaacucagggaggagguaugccuagccccacccccaccccccgccaaagguuagagccauccugauauuacaucuguacauccauguuaucuuguaugcuggaaaauggugagaguggggagauggagagaccuaugucugaauuccaaguuuaauaccaauggacccugugaccuaggaugagucccuucccuucucugggcuucauucaagucccugccuccuucugggcuucauuuuccuuaaccacauggaggggucccuuuugccucucagagucccagggcuaugacagguucugggcucguugcugugaagcaugacacucuacugcacacauuccgggccuguauuagacaguccacccguuucuuucuguggcuccaucugaccuaaaucgcaaagagcuggcugccccacuccugccaagccaaccugcuugcacuuccaaaccucgccccaaacacucccacucuucuggagccaggccaucugcauucacaucuggcuuuuucauguacuaccuggguaacuagggcaaguuaaccucugcaagccucaguuuccucaucuguaaaaugaguguaaugauugccucuauuucauaggguuuugaaaaugauugagugaauacuucuuagaaugauaccuugcauacaggaagcauaucgauguuagcuauuuucaccuccuaucugcaagcuauuggcucacugaagcccuggagccaaacuugccucuuccaagaagcccucccagauuugccccaccuggcucuguuuuccccuuuucuucuuuuugccuguuugccccacagugcuuuagcuuuauucuuaaguugagggugcugggccaggcuaaucucacuucagcucuuuaccugcucaggaaggggagggcaggguagagaagguugcuggaguguccccuaaucauuccccgacccccagagucugccagacucuugcugggaccuagagccagggggcugggcacagaaggggugggggaggcaggcuucccagggggaguggcaccagggccgcccagagcagccugagcagaaguugcuucucuaggagcugagagaugauucagaaggugauuuauagucggaaggcagaaagcuuggcuccuggcagaagcugcugcuuaauuacauucuuggggcggggguagggggguggagguauguguggggaggcagcaggggccagacuucugccuccuccccauccaggcccucccugucccuuuggcugucccggcucuaagcaggguccuucuuuaucccgcugccagagagggaauucccugcucucagugagaggcuaggccaggauugcaggaauagcuucugggaguggagaaggugggaaaagaggaaggaagcuggaucccaucucccgggacuucuccaagggagacuggauggcgacgggcuggaaaacgggccuucugggaaggagcacugggucuccucccugcuucugggcagcggaauagcuaaggcaccugggcagaguugaguuucuuucuuucuuucuuuuuuucuugaaacagagccuugcucugucgcccaggcuggagugcaguggcacaaucuuggcucacugcaacuucugccucccgaguucaagcaauucuccugccucagccucccgaguagcugggauuacaggugcgcaccaggaugccuggcuaauauuugaauuuuuuaguagagauggggguuucaccauguuggccaggcuggucucgaacucccgaccucagguaauccacccgccucggccucccaaagugcugggauuauaggcgugagccaccgcacccagccagaguuucuagaaucuucugagaggcaacuccacgcucuccuucgggcacccuguccugcugcugccugggagggccugccugcagguuugcuccuuuucuguugcucaggucucagugggccaugggggcuggagagaagguccugcgcucagaggcugaaacccgguucuucagcguuaggcagccugucccucgugagcacaguggcuaccccaggugcacaacgguucugccagcaggcacggccccauacccucaugucaaacuaauaucucagagagucaccccaaugccgcugggugcagcuacaaucacuuccgcgccauugacaggagcccccauucuguuuccauaccugcugaguugacaucagcauuucccauauuaacacugacccaugcaacaacccgcccgaugacaccuaaggccgcuuaguucccugcaucgcagccgugaaucccaaaucccucacugcuaguucuuaaggcuggaaagguguagggcgggcagggguagaguugcugaagccaguagugucgauuuaucuguuugcagccuggccuguacagccgggaggaguuggcaggggucaggauggggacacuagacagcucucugguucccccugaggcgggccuucucaaaauggccucauuauguguguggagugaauuccagaaaugucaggcacacccauacaucuagggaaugaaggagaugccagagcgggcucuggggcgagaggggccagugugaggaggugggcggcuuccgggcagggaguuagggcaccugagaccuggcucugccaccaucuugauauuaggcaacuuccugaacuguucugagucucaguaacuaggagaguuggauaagcugcuggccaaagacuuccagcuccgagauugcagucauggaggcuguauuccgcguucaggucacccagcuauuuggaccaucugugccugguggaggggguggucacugaaagcuggucucagggaaggguggggggugcagagcucuaaacucuacacacaaagagcugugagacaguggaugagucuccucccucccucaguuuucucaucugcaaauuggaugaugauaauaacacgaccaccugcccugccugcuugcagggccgugaagagcuucagguggaauaaucuuugugggcaugccccgugaccaguuggccucagaccugaggccucugugcccucugccaggggcucuccauugagcaucaggaccccuacaggaaggagcugaggacuccuuccugaggacacuugggaagugucagguucuuuccagagaaguuaacuaucacugugaguccuagaaaagaggaauaagaaggcugggcauggggcuuacgccuguaaucccagcacuuugggaggccgaggcggguggaucaccugaggucaggaguuugaggccugcuuggccaacauggugaaacccugucucuacuaaaaauacaaaaaauuagcugggcgugguggugggagccuguaaucccagcuacucggaaggcugaggcaggagaaucgcuugaaccugggaggcggagguugcagugagccgagauugcaccacugccuuccagccugggcaacaagaccaacacucugucucaaaaaaaaaaaaaaaaaaagaaagaaagaaaagaggagaggaauaagagcuagucccugcucagacagugcuaagaauggaccuaagagccccccugagccucugagcuugaggaguugauauuuccagcagaggaagaaguggggcuggacaggggaguccucagcuccuuccuguagggguccugaugcucacuggagagccccugggagagggcacagaggccucaggucugaagccaacuggucacggggcauacccagguucacagcucagggcauggggcuugguuauccuccuggccuaaugcaaaaaccacuggccagacccagagugagauuuccaaccagggacacaugggaagauguagguggaggugaggggggcgagggcaaagggcugccagcuggaaggggcucugcugaggccuguagucaucagggaauccuaauggccuggguaaggccuagcaaacuaggagacaggcacaagccauucccuccagcucggcuggaaaaacugcgaggacugaguguguguacguguguguuggggagggggaugggagcaacaggaccaagcacccaggucugucuggaagaccuuucugggaaaccugccccugggcacagagucccacuuaucugccagagccagcugggccggcaaggaaaaccaaucucgcagggcccauuaggaaugcaaauagggcuugugcugugagugagcaggaucccgccuccucuccagcucccaccaaucaucuucacaagguggauugcugagggugccacuccccugcucugacaccucccauggcuccccucuuccuaucugguacugaggcucccuaugauuucacuucuguccaccugcgcaguuguaacuuucacaaacccccucgauccccccaauaacccacuucaacuggaauacucaccucuuugcuuguucauugaaauacuuccaccuccucucucugacuuuaaaaggcagcccaaccuggggccuguugaccuggggucagucugcucugcgcugcucagcucggaccccacuuggcucaggucauguagcuaacagcccugaacuauggaggguccuuagagggucucucaagguggaugggccccucgaccugagcaggcugcugucccaggaguggagaugagccuuuucuccacagugucaauuccccuggguuucuuuuucuuuuuuuuuaaucccaguuccacuuguaaacguuuccuauuuguguacuauuucccccuccauguucaccaguucacacgaugcuuaagugucuaagucauuaauuuuaagauugcaauuggcagaaguuguuucucuaucuaggaacagguuaauacguuuguugaccaugugcuaugugcugauccccaugcagacaucaugauuuaucugaaucuaauucuugccaguuuauagauagggagucccacagugcagccugggcauggcaugggaagcccugagcccacacccuguuggaccuaaagccuuuuuccuucuaccaccauucaggcucaguuguggacuuguuauugggguaaaaauuugcuuguucauauucuacuuuguuccccaaaggaugguuuugagacaaguuuacacuugaccuuccacucaaaggcugaugcuuugggcuuauagauacuauuugugaacgucugggaagucucuuauuuggggauguguccucuucacuggccaccuuuccacaagccaucaggcuguccucaagcugggauugcacaguugcugacagcaguggccaugugaggauuuuguugccccugggauggguaaggggcgaccuugaucaaaucacugccucccgggccucaguuuccucaucugugaaacagaaaggguagcguaaaugaccucucagauuccuuccagcacuaagcucuuuccuucuacuuaguccuuuuugcugcuuugcaucuggucuccaucauauacgugcuagaaagcagcugggcagaaucuucuuucuugcccuaguccaauucuuguguugguaucucugaaacagccaauuguucauuucacuuuuacaauucgaccuucagcuuuauuucuccccgaggagccagcaugcuuucuccuuucugauaaagcaugcuucccuuuauguccuggcuaugagaaaacucagagguccaccugaagccacauccuugcacccguguggaccuucccugauccugcucuuccguuuuuauuuuguuauugaaucugauguguuuuccgucaucagccucuugagggcagacauguuggagucuuuguaccuggccugggcauaauggauccucaauaaagacuugucuuugggauacacauuugcugucaaccucuucaaauccuuucuggaaagaagcaaggcacaugcgaauuaaaaagcaaaauaaacauugcucugggagggaguugguccugacuggauaguuuugaguuaugagaauuccagucugcuucuguuucuuuuuuuucuguuuauuuauuuacuuagagauggaguuuugcucuuguugcccaggcuggagugcaguagcaugaucucggcucacugcaaccuccgccucccggguucaagcaauucuccugccucagccucccaaguaccugggauuauaggcaugcgccaccacacccagcuaauuuuguauuuucaguagagauaggauuucaccauguuggucaggcugguaucaaacuccugacaucaagugauccaccugccucggccucccaaagugcugagaugacaggcguaagccaccaggcccggccuucuuucuguuucuuuacugucagcuuuuccccaagucuacaaaggucuugucuucagagaagucgccucuuuuuuuuccuccaugaucuucuccacucuaaagcugagguugguuccuaaucuuccucuagggacugucucucguuccuggccaaugacuauguccaccccuaccccuggcucccuucacaacugguuccucccacccucccuugccuuggaagccgacggugcuauugccaccauuccacaggugacggagugcccagguagcacccacccucucuccaacagagcugcucccguccccagcagccaucgugagggccaagccccacucugcagauggagccccaaggaggagcagaggggagcggcggccagggaucuccccauucacccagcaagguguccucacaacucuaaccggcucuccccuccccuccgcuucugcccuugggcaacacaugugcaggucaccccacccagucccugacuucggaggagagaaugucuagccucaggcugggugguucuccaucuuaacugaagcuuccauaggggauucuggagccuuucucugcuaccaguaaggauggagucugugaccucugcacuguccuggaagcuaaagcagccucgagaaagcagccucuucauccccauguuaccugugagaaaacugaggcucagcugggcgcgguggcucacgccuguaaccccggcacuuugggggacaaaggcaggcagaucaccugagguugggaguuugaggccagccugaccaacauggauaaaccccaacucuacuaaaaauacaaaauuagccgggcgugguggcacgugccuguaaucccagcuacuggggaggcugagaaaggagaaucgcuucaaccgagggcugaaguugcggugagcugagaccuggccauugcacuccagccugggcaauaaaagcgaaacucugucucaaaaaaaaaaaaaaaaaaaaaggaaaagaaaaagaaaaaagaaaaaaagaaaaccgaggaucacaggacccaaccaggagcuguaaggagcucggaagcaagugggcggcuccaguggcagcuaguaauuccucgcuuaugaugucccggguaucacauacauugaggaaacaaagcacacacauuagcucauccucccgacaaccccaggaggcagagacucuuguuauccccauucuacagaugagaaacugaggcccugaggcaccauuccauugccgaaggcuccaugguugguaaaccccagagcucuaaacaagagacaaacugccugaagccaggcccuucagugacaccacaccacaccacagccaggaaguuccuccuuagaucugacuucagucuuuccuuaauccaggcccagguuuucuuccuggggaugugaauaucacugucaaguuucaguuugguuugguuugagacaggaucuugcucuguugcccaggcuggagugcagugguacaaucacagcccacuguagccucaaucuccuggggugaagcuauccuccugccuuagauugccaaaucacuaagacuacaggcaagcaccauauguggcuaauuuuuuuaauuuuuauuuuuauuuauuuuugagacagaguuuucacucuugucacccaggcugcagugcaauugcaagaucuuggcucacugcaaccuccaccuccccgguucaagcgauucuccugccucagccucucacguagcugggauuauaggcgcccgccaccacaccuggcuaauuuuuguauuuuuaguagagaugggauuucaccauguuggccaggcuggucucaaacuccugaccucaggugacccgcccaccucaaccucccaaaaugcugggauuacaggcgugagccacugugcccagccuuuuuucuuuuuuuuuguagagauagcaucucccuacauuacucuugcuugaacuggacucaaacaauccuccugccucagccucucaaagugcugggauuccagggguaggguuccaguuugcacuugaggaccaggguucgucucaucccugaaucuuccugugucuggaguugguuccuuccaguggguucguggucucacugacuucaagaaugaagccacguaccuuugcggugaguguuacaggucuuaaggaccccaagagugagcaacagcaagaguuauccugaagagcaaaagaacaaaguuuccacagcauggaaggcgacccaaggggguuggugcugcuggcuuggggguggggggggugggcggggaggcagcuuuuauucccucauuugucccagcccauguccugcugauugguccauuuuacagagugcugauugguccauuuuacaaaccucuagcuagcuacagagcacugauuggugcauucuuacagagcacugauuggugcauuuuacaaaccucuuguaagacagaaaaguucuccaaguccccaguugacccaggaaguccggcuggccucaucucucauuccuucucuagaacaauuccucccaggugacccauccucuacucaccuuuaacuacuuguucuuccucuucugaucucuuaccagcuuuucuacaacuuccugcaaguccuauagccacagaauugccuuuaaaucagggaaagagggggccugccaucagcucucugauuuagaggcuuccgucuggugucuuacagcacuucccuuccccauagggcagggagucuggaauccagcaugccugcccucaagaggcuuaugacggaaaacacaucagauuaaauaacaaaauaaaaacaggcuaguugugguggcuugcgccuguagucccagcacuuugggaggccgaggcaggcagaucacuugaggucaggaguucgaaccagccuggccaacaugcugaaaccccgucucuacuaaaaauacaaaaauuagccgggugugguggcacgcaccuguagucccagcugcuggggaggcugaggcaggagaaucgcuugaacccaggagguggugguugcagugagccaagaucacaccacugcacuccagccugggcaacagagugagacucugucucaaaaaauaaaaauaaauaacaaaaacagaagagcaggaucaaggucaaggagaagacaaauaugcaagucaaggucaaugcaggugcaaggauggagcuugcccugaguuuccucacagccaggacauaagggaaaacacgcuuuaccugaaaggagaaggcaugcuggguccucagggagaaaugcccgccuacagccugugcccacccucuucagcugcgccaugagaauuuaggcuccuggaguaucuggcccagacagccgugagccugcuuccgggcucugcaggccucugccuggggcccauucugccagggcaggccacacugccuguggccaagggcuggucaagggaaauucauuugcaagggcuguggcuggagcuugaggguguggcuggggccuccagcaugggaugcagaagggaugggcaggcugcaggccuggggcuagaucucccaugucaccauugucuagcgugaacuuuaucagguaaccuagcccucuagguggcaaguaagguuuuugccaagauaggaggauagaaugauuguuuaacuuuuuuuuuucuuucuugagacauagucuugcacuguugcccagguuggauugcagugacacgaucucacuauaaccucugccucccagguucaagcgauucuccucccugagccuugcgaguagcugggaucauaggugugcaccgccacaccuggcuaaguuuuguauuuuuaguagagacaagguuuugccauguuggcaaggcuggucucaaacuccugagcucaggugaucugccugucugggccuccgaaagugcugggauuacaggugugagccgcuacgccuggccaagugauuaacuuuuuaaugaaaguacaggaaaagacguaaacugucuuuccucugcuuucacccugcaauaauugguacagaagacuucugcgaccaaaugcgugcauacaccaagcaagcugucaauucugcggcagacaucagccagcguccucuaauccaauucaauucugaugaucuccaccuggacauagcaucugaucccauagguugaggucuuaguucccaggacagccucccacuuccaguagcaaucccaagccccaggcugcuuuacaugugcuccugacugaccugcuauaaaucaggguuccugugacuuccuccuuggguuccauuaauuugcuagaguggcucgcagaacacaggaacacacguuuacugguuuauuauaaaggauauuacaaggauacagaugaagaggugcauagggcgagguaugggagaagcugcacugagcuuccacgcccuucccaggcacaccaccuuccaggaaccuccacguguuccgcuauccggaagcacuugaacccuguccuuuugggcuuguaugggggcuucauuccauagguaucauugauuaaaccauuggccacuagugaucaacuuaaucuucagcccccucuccccuucccaaaggaugggguugggguuaggguugggaguccaacccucuaaucuuggccgggcacgguggcucacaccuguaaucccagcacuuugggaggccgaggcagguggaucaucugaggucaggaguucgagaccagccugaccaacauggugaaaccccaucucuacuaaaaauacaaaaaaauuagccgagcaugguggcaggugccuguaaucccaguuacuggggaggcugaggcaggagaaucgcuugaacccaggaggcggagguugcagugagcugagaucacaacacugcacuccagccagggagacagagucaaacuccgucaaaauaaauaaauaaaagaaaagaaaguccaacccuuuaauccugccugggucuuuugggguaaccaaccucaaucuugaagcugccuaggggcugccagcucuuccgucagcucauuagcauacaaaaagacaucacuuuggaguuucuaaggauuuuaggaguuguacgcugggaaacuaggucgaagaccaaauauauauuuuauaauaucacaaacaugcguacaggcgagcacacaacuugucaguguacagcuuaaugagcuggauagaauaucuuauguuuaacaguuugugaaccuggcaugaaacuuuucaauacugggcacaugguagaugaggcuucguugaguggucucaaugcuacagccaggccuuagggcuuggcggggaaacaguuccacuagggucgaacuggcacagcaucgggaagaaggcuugccuccucuaauguggcugcaucaucuccaucccucccuuggcagacccacaguggcacugcccucccucacagcuguggucacuuaccuccaagucccuuuuuguuaaacuuggaccauguuuuagccuuucucagccucaacggaucuucuuuucugaucaguuuagucagucuuauuuuaauuuaauuuaauuuaauucaauucaauucaauuuguuuuucaagauagagucucgcucuguugcccagaguggaguguaauggcgcaaucacagcucacugcagccuccgccucccagguucaagcuauucuccugccccagccucccaaguugcugggauuacaggcgccugccaccaugcucggcuaauuuuucuauuuuuaguagagaugggguuucaccauguuggccaggcuggucuccagcuccugaccucaggugaugugcccaccucagccucccaaagugcugggauuacaggcgugagccaccgugcccggccacuuuggucauuuuuaaacggucuaauuaggagugcagcagcagcagauaugacuguguuguuguauacuccucagccuggccccugccgcccugcacccgcuccucucccaaccccaacauggguaagcacaugggccuggguacagcaguccuggacucuagaugguucugccuuuuuaucuggguggacuucaccucuccaagccuugguuuucucucugcaaaauggggauaacgagggcuauugugaggaugaaaggauauaacgcaugugagacuagcacagggucagguguguacucagugaguuagacacacauuuugcugacauuaauuucauguuacagucugcguuguucucgugcacaccucacuucuccgugccucugugcuacccccugccuucucuugggaugacuacaaacuccuguucagucuugaaaucauaguucagccaucacuuccucugcgcagccuucccucagcaccgcggccccagcaaaggcccuucugagcacaucuauuucauggacuagacuguaagucaccugugggcaggaccaguucuccaucaucuuucaacccauaccaccaaacauagcacagggcacacaguggauccucaaagacagguugugggaugaaaggacacuguugagagucaccugcuggucccagacucuugucucccugcuccagcuggauucucauugccucugugaugcucugccaggaagaccagcugguacuuguuguguauuuuccuguauucucagauaccucuucaugugcaucugucuugucuucccaguguaagagucagccccugagggcagggauucugcucuguaggccucugcaucacuagcgagccucacacaucauccugaguguugcaggagcacaguuaggaauucuguuaucaggccaggcaugguggcucacaucuguaaucccagcacuuugggaggccgaggugggcggaucaccugaggucaggaguucuagaccagccugaccaacacggugaaaccccgucucuacuaaaaauacaaaaauuagcugggugugguggugggcagcuguaaugccagcuacucgggaggcuaaggcaggagaaucacuugaaccugggagguggaggcugcagugagccgagaucgcgccacugcacuccagccugggugacacagugagacuccaucuccaauaaauaaauaaauaaauaggaauucuguuagcacuuggcccaggaaucagacuccuucccaagcaggcugcaguucaggcucagcugguccccacucucugggacagcacuccccucacucugugaucucccaggaaguccggcucugggcaucuaaccuugguguggggaggcaacauagcacuccagaaagaggguaggcucugugacagaaccaccuguggugcaaaucccagauguccacuucauagcuucuagaacuuugcuuugggugguugcuuaaaaaucugagucucagucucuuccucuguauaaugggaauaaaaaauaugaucucaagguaguugugagguugaaaugaaauaacagacagaaacuggcuaggcgcaguggcucaugccuguaaucccuacauuuugggaggccaaggcggacagaucauuugaggucaggaguucgagaccagccuggccaacauggugaaacucugucucuacuaaaaauacaaaaaguagccaggcaugguggcgcacaccuguaaucccagcuacucaggaggcugagaugggagaaucgcuugaaccugggaggcggagguugcaguuagcugagaugacaccacugcacuccagccugggcaacagagugagacuccaucucgaaaaaaaaaaaaaaaaaaguagaaauaauagaaacugaguugaaggugaaucauuaaagauguucuacaggucaucuaauguagcaggguuauaaaaauauucucucccaggccaggcuucuuuagagcagaaagaucugaauuccuuccaaaacagaaaaggcuggcuucagggaaucccacacacuuuauguugguuugucccaaccaauaagccuaucugaagaaagaagcggguggggaggcauguggcagaagucugugacuugguggacaaaaggcaaugcagacucuggcaugaccuugcguucugguauccuguucagccagaguacucacaaaggccuccaguucucaggaagggaagggugaauuaaaugugguuagcuaucagggauuuuuuuuuuuuuuuuuuuuugagacggagucuugcucugucaccaggcuggaguacaguggugugaucuuggcucacuguaaccuccgccucacaggcucaagugauucuccugccucagccuccuaaguagcugggacuacaggcacgcaccaccaugccuggccaauuuuuguauuuuuaguagagaugggguuuccccauguuagccaggauggucucgaucuccugaccucgugauccacccgccuuggccucccaaagugcugggauuacaggugugagccacugcgcccagccuaucagggauuuuuauggggguuccaaggaguggucuguguagauuuaauaucacccuaguuaauggcugaggcacuggcuguguaagcccuugcuaagcacagugagugaguguggcuggaagugcaggaggccugggugggaugcaggcugauccagggcuggcagucacugugugcauccaaccuuuaggcgagagagggcugcuaaacucugagaaggaauucagggugaagaagagcugaugugccaaugguauggcuggcacaagccuaagcagauaccagcuauucuccugcaagcugaucaaaaauauuuuuauuacauaauacuugacauauacaagagaacaaucauauauauuagacaugaugacagaaugaaaaccugagccucacuaugucccugaaggaccagaccgugacuaggccgucguguccaucuguggguccuccucagcccauuccccaucucccucuagaugugaccacauccugaauuuuaccuauuuauuccauuacuuaaaaauacugguuuuuggcugggcacaguggcucaugccugugaucccagcacuucgggaggccgaggcgggaggaucaccugaggucagggguucgagaccagccuggccaacauggugaagccccaucucuacuaaaaauacaaaaauuagcuggguguguuagcacacgccugugguccuagcuacucgggaggcugaggcaggagaaucgcuugaauccaggaggcagacguugcagagagccgggaucacgccacugcacuccagccuggagacccugucucaaaaaaacaaaaaaccaacaaacaaaaaacugguuuucccagguaauaaugccuaaaugaaauguuuuauuuugccuauuuuuagcauuauaaaaaugguguuauacugcauguggcccucuauguugagcuauucucucucugcauuguguuucuaaguuucaaacuguuccuggaucuugcuguaguucucacaugcucacaguugcauaauaguccaucuuuagaauauacaguuuaucuauuuugucuccuggccauggaugugcaucucgcugugcacagcagggaaagguguucauggagguaccugccuaggcguggaacuuuggguugcaggaugugugaauguugagcuuuacaagaugaugccaaacuguuuuccaaagagguugugcccaucugugcugucaucuuugagauuguuuuucccauggcccaaggcccuucuucccgcccgaggcaagcccacuccugaggacuccacugccuugggccuucaccgucuuucucucaggaucccauucccuacuggaaaacucuuuccuuucccuccuccacuuggcccugaacuucccaggauuuuucaaaacccagccuggagcugccgucuuccugggaguccucucagccucacuuccacucucucccagguuuuuggaacagcuuuuccagacagcucuugggccagaguaggacaucgcauaguguguuucuuauaacaucagccccacauaauccuguugagaaaggcuucuggagucaaauaaacuuaagaaucgccacaggcaacuuggagccucuugguguuuauuguucucauuugaauauuagcagcucauuagcauaguugcagcacugagagguccugccagugugacccguuuuuauuuguuuaacuuguuuuccaaaaauauuuaaccuuggagcccuuuucccauuuucccccauuuggaaaaugggaucgagaagauucuccugccuauuucagucaguuugguuuuguggucuuauuuuccucgguaaccaagcugagaguccucugacuucuguuguaaucaucccguguaaacuaguucaguccagaccacccuuucuggagggcuugaguggaaggaaugaaugaaugcacucaggaauuaaugaaugaagcagucagccaaucagucagccauccagcugagcccccucuccuaugcagcagccaggaaccagggacugaucaggcaccgcucaucuugcaccaggggacacccgggcugucuggcuggugaaucauucucccgucuuagguccccuguaguugcauuuuuaggaucugucacccaaugaggcugggagccccugcggggcaggaaccaaguugcgcuugccucucugugugccccgagugggacauacagaugggaucucucauccaacuccuucugagaggggcaggagaacauugugguuaagucuucagccucuggagccagaccagaugugucccuaauuaccuggguaaugugggccaaucucugccucaguuuccccacugagauaggggugaugauaacauaccuuccuuacagaauuauuaugggguuaauaugcggcaagcacacaaacagugccuggcauagaggaugucacuggucuuuauuagcacuaugacaauggcaaccaacauuuauugugcaccuacuaugugccagggacugugacaaaagcuuuaucuacaucauuucaauucuuccuccccgcagccucuuugaagugggggauguuuuucucauuaggaaguugaguccucccaaggaaacgugguaaugggugguagcaauaagaucaggauuggggucagccagaucacaaagcccuggccugcaggcguggagggugccaccuaccaccugcggaugggacagcuccucuguuucuuuuuacugauaauuacccugccgacaaccugaucaguucuuuuuuuuuuaauccucuauucaucucaacaaaauggaaauccaugguacugcaaggguuagaauuuaacaugugugcacacgugugugugcgugcaugcaugugugugugugugagagagagagggagagacagagacagagagagacagagagcaagagugcacaagugaaggagaaggaguuaucugagaagccuggggguuacuagcaccuucaugacagaccaaggaagacagagauccccggguggggcuggcuuugagacugcacagcggcagaaucguuugugagucagcagugccgcagaacagcagggugcuccggaacugggcuuggugucgucacccacugccccuugcacagggcccugugugccgggaaauguuugcaggcuggacaccugugguugcuuuuaaccaggcaagugagcuggguuagagguagccacauguuccugagggcucgcagcuuuggaucugagaggguuagacagggcgucaggggcugagggucacuggaggagaauuugcugucgucccuuugcccacgggccggcuggucuucucagaccccagaggccagcuccucuguucuuccccaccucggaggggagccccagaagucacagggucagcugucugcuuuccacacugccuagggcuuuauucuugcaccauccccaguucuggccacaccaggggagugagacauggggcgccgguagaggggcugaaugcgcuggugugggguaggagguuucggaugcacauuccagaggguguuuaugggggagcagacaagccuggggauucauuccugguagggaacaauucccucagcacccgagggugggaaaugagggccaaaaugguggcucagagggacacaggugagguaagcagguaagaauucccaccaggugucucagaaauguccugggaagggccuggcaugguggcucacaccuguaaucccaguauuuugggaggccgaggcgggcagaucaccuguggucaggaguucaagaccagccuggccaacauggugaaaccccgucucuacuaaaaauacaaaaauuagccaagcaugguggugggugccuauaauuccagcuacucggaaggcugaggcacgagaaucacuugaaccugggaggugcagguugcagugagcuggaaucguaccucugcacuccagccugagugacagagcaagaaucuguuaaaaaaaaaaaaaaaaaagaaaaagaaagaaagaaagaaaagaaaguccugggaagcugguggaaggaggucgagaucuuccugaccugggaaaggagggaauucccaggcaucuauagaccaauaggacugucgaaaguuugacuggugugagaauggguuaaggugcugaauuuuagauuuuuauccucuccacggugguacaguguguucugcaaacaaaggagagccagccuugaagagcccuucucagagcugacuauguucuuuggcuccucagcccagugagauggccuuagcucugagcccugugcaauaugcaaacuggaccagaugacccccaaggcuccuucuagcucugacagguccugucgggggauccagccugcauauagggccugggcuucuuucagccccauagauggugaccccucuucaccgcuaguaagauugaagcucaucagcaggaccucaggcccuggccuccuuucuucuuggucccuuggguuuuggaguuuuaugugacaucaaugucccagaaaugcccauccucuuccuuuucucucagggcacaguccccugaggucuugugguuuauccacccccaccccuguucuauguccuccuucacuugcucucccccacgccccucccaccagagaguuuauaagcuggcuguccccuugcuaaccuccugcuguucccuaugaacaugccuguuagauuucaccgugugacacugucuugguuauguccccgucgugccuaguucagugaagaacacauagcaggugccgaauaaaugcacucugcugggauaaacugguuaucuccagaggguggggucuggacagaguggcaaaauagcgauagcaugggauuugggguccaacuccaccuccacuuccuggccgauggcaaucugucauugguaaacuggagccggcaucucuacucucagggcuguugagaggauucauggagaagcugugugaggaaaugcuuugcagguuggaaggugcugggaacgugugucaucuacccuggccucucucucaggaacucuugcccacauuugucagcaucugcuggguguguugucuugggagaggucuuguuaacccucugccaccuugaauucucugguccccugaaauucuuuguccugucucacacacaaaugccuccagcccucaggucgggggucuccucuccuccugcaaugccuugggcguggguccagccuugucugagacacagagaaauggaccuccagugcggaagaucugcaccaacauucgaaagaaaaaagacugauaggcgggagcccagcauuugaauuuacagggauguuaaccccaacagcggccggagcagcagagcaggaccugagcacuuccuucccuuucuccuuagccuuccaugaacaugcucucuauaaacccuguccugguaaaugucuccccucauuuuuuuuuuuuuuuuuuuuuuuuuuuuuagacagggucucacucuguugcccaggcuagaguaaaauggcucgaucuuggcucacugcagccuugaccuccugggcucaagcaauccucccaacucagccucucaaguagcugggacuacagguggucaccaccaugcccagcuaauuuuuuuuuuuuuuuuaauuuuaguagaaacaaggucuugcuuucucggcuaggcuagucuugaacaccugagcucaagugcuccucccgccucggccuuucaaagugccggguuuacaggugugagccaccucccucagcccucacugcuuuuuuugccaucucagugccaccauuuccuagcuaugugacuuuagacgagucacuuggccucucugagcccaugucaucauccguuaaauuggguucuuuggcaaauuaaaggauguauucuauguaaagugcuuuacauggcaacuggcacauagucaggccucaauaaauguuaacuauuauuauuaauaauggccacuggccaggcgugauggcucacaccuguagucccagcgcuuugggaggcagaggugggcagaucacguggucaguaguucgaggcuagccuggucaacauagugaaacucugucucuacuaaaaauacaaaaauuagccaggugugguggcaugcaccuauagucccagcuacucgggaggcugaggcaggagaaucgcuugaaccugggaggcagagguugcaguaaaccaacacggcaccauugcacuccagccugggugacagagcaagacucugucucaaaaaaauaauaaaauggccacucugagugccucagugaauaggcuccuuacuaccuuacuuagagcagaguugaggaaauuggugaaguucuucacuaccuuauuagccacucucuacccaaauaaauguaccccaccuuaucuuauucauuauggguaaucaccuguaaaagcguucuuuauuucauucacagccugaguguccccaaaaaggugcuccaugacgucauccccccucuggaggacaccuccucccacccauggugauuugagccuucucuuaggccagggugauuccugggggaaccuuaacuggggcuaaugugcacugacauuuugccuuuugugucgaacacacaucccauuugcagagauuuagaauuuuuugacuuuaaauguucgcuauuucuauguauguguaagagagaguuguuuucuuuuguuuuguuaagagacaggaucucacucuguugcccaggcuggagugcaguggugcaaucacagcuuacuacagccucaaacuccugggcucaagcgauccucccgccucagucuccccaguagcugggacuacaagugugcaccaccacacccagcuaauuuuucuguguuuuguagagacagcgucucgcuguguugcccaggcugaucucaaauuccuggccucaggugaucccccugccucgaaauucugaagugcugugauuauaggcaugcgccaccaugccagagagagagauuuuaucuuuucuacacaacguguguuucccccagaagaaaugccuuccuacuucugugaugaauguaaguagaaugcagacagaaauuacagaaacucccugugccccagcacccuuaccagggcaugccuggccugguggagugacaggguguuguacacagugaggggaaggaagggagugggagaggaggugaggcucugcagagcagaguggaccauuucuggucagaaaacagugaggaggccgggcgugguggcucacgucuguaaucccagcacuuugggaggcugaggcgggcggaucacuugaggucaggaguuugagaccagccuggccaacauguugaaaccccgucucuacuaaaaauacaaaaaaauuuagccagguauggugguccucgucuguaaucccaguuacucaggaggagaaucgcuugaaccuggaagacggagguugcagugagcugagaucacgccacugcacuacagccugggugacagggcgagacucugucucagaaaaaaaaaaaagaguaaggaaagcgaaguccuggguuggggggaaauguagcugcaggcaagaaccaaggaagguguggagcccccaacccaguagggaaaaggcuugcugccuugaagccaaagagugugagcauccuguaccuuugcagacagaacuuccaccuacucacaaacagauacaccccacugcacagcuaagaaagcuaaggggaaaccaggaagaagggaaaagaaaagaggaaaaccccagaggaaacgaggagucaggccugggcaggggguuccagaugacgcaugaggcugcaggaggaaaagguuucuuuugaaacacaucuuuuauccuguccuuuuccgauguacgugagcguguguuuuggaacgcacauaaaacgcgagcgcaguagccggccucugauuucugccaagguggacggaaacggaggggcgugcccaaaugcuucuucuucauggcugcuggaucagggaaguuuugcuucuguggccgugaacauggagauuugcugagaggccaaggagagagaugaugggggagggcuacuucgggagaggaaguggacaagaccagagguuggaaaacaggggacggguugauccuaacaacuuggagggacugguacugggaauaggagguggggcccagggggagggcagaggacccaggagccccagcuguggacccaggguggggcugugggcagguccccagcccugucugugaccuagggcagugcuucucaaccuugagggagggagggaggauaccacagaggggagggagcaccuagaccacuuaaaucccuuucucugcagggggcccaggcagccuuguuucuaagcucagcagggccacuuacuaugcagccagggaugagaaccaauggcccacccugcugagugcuggaauguguaaugaaguccugcgugggucuguaaugaacccagauucggcuccuaacaggugcugagugcauguuugcaaacccaggcgccuguugcaaggagaggacagagcuaaagcaaggagccugcggaggaauggguggcagggacugaugaaguugggggaaggaggugcagaggaaaauguugaggcucgcucuggacugccucgccuggggauggagaauggggcugcaagggaggggcagccagcgcuuugaacuuggguggggccucccuaaauagagugggggaaguccaggugcugggcagggcugucuucaccugcccauccucagcgccguggggggaugaggcgcaaagaagcccuccugggaaugugguggaaauacccaccuugaaagguagagaguggaaucguugcccugagcaccuggguguggucgcagcaucccccgugaggccucccaaccugcagcugccuccugcgugcgcaucugccacugcuggcuuuagggccagggccaggcccagcuggagguccaagcuggagcccugggcaguguccagugcacuguggccucaaagugcccagccaugguuuaguacuccagcuggcaaggcccuggguucaaacccugcucugaauuuguccaguugcuuccccauggugucauuugguuuguuccucugucccuuguguucccugagagguuaccucucaaagcuugguuagaucagauuaaacgucuuuggccaaagaacaucauagggaagguuggggccuuccugcugcaucaucucauaccauucuacugucacacuucugguggaggcuuuuaaugauccaguuuccuggacuccuccccagaggcucugauccugccacgcugguguuggagccugggugucuguauuuuucaaaaccaccccaagugaucugccguaguguauagccugcaucccugaccccaguagccagcuggucagggacuguccuugguuuucugaagagcauagaauaagagaguggaugggacaguccagguaggugccagcccugguggccagugcuaucaggugugaggcagggaggguggccucugggcccccauaaagaggagaaugggcuuccucagggcagcuccagguucagguaagaguccuugcaagaccaggagugccccacgcacugugcucccggcguccagcauaaggccuggcccagcgugaauguuuauugaauaaagacacacaccaggcugguggcucucugaggagcccuggggagcugcucuaagagugagcucccagccaagcagcacagcuuuguguguuccccacugggcugcuucuaagauucaaacaaaggacucccaaacuguggagcuagcagcuguguuaaaaggcccagagagccagcagggccauggccaucaccugcccucagcucgccguggagacagccugugggaucugggagagacgaaggaaaggacugggcacucaguggggcugcugagggcagggaaaggaggcagggagguccucgcagggagguccucgcagggccacugcaccugcugaagcaggugcuagauucuacauggaaacgagugaaagaaucccuccucucaaaaaacucaccaucaauggagucgguggacaauucacuugagugcauugaagguuaccugugacggauguauaagagcuggggaaauggccagagggaacaauuugaauuggagacauuaaaaggggauuuaaacaugggaccuugagggaugaauagaagucuggagucagaagcgaacaagagggcugggcaggcuaugucuugucuuuuaccagaacuggcuugaaggguauagcaauguggggacccagcaaaguccuggugugggaaccagcagacuuggcugcucagaacggcagccuaacucuguaagguucucauuucccaaucuguaaaaugggagacugacuuaggguuuggaggggucaggaaggggagaaauguuacaagguuaaaaugaacuaaagaugcaaacauggcuuaggaaaaauuugaauuagaauuccacuuaguggagugggaggcaaagaaacagauggccaagcuccaggaggaaaagcuggccaagcugagcucaacuucaaggcccagcucgaaugucaccucuuugaaggggacuucuuugccuucucccacuuccuuccccucagcacaccuauuccuugaagucccaagugggacuucucacacucugcaacugacuggucaccugcacugagguggggucacugaggaggguggaggcuacaucuuuuuuuuuuuuuuuuuucugaggcagagucucacucuguugcccaggcuggagugcaguggcacaaucucggcucacugaaaccucugccucccagguucaagcgauucuccugucucagccuccaggguagcugugauuacaggugcccaccaccacgccugguuaauuuuuucuguuuuuaguagagacaggcguuucgccauguuggccaggcuggucucgaacuccugacuucaguugaucugccugccuuggccucccaaagugccgggaauacaggcgugagccaccgcgcccggccgaggcuacaucucauacaucuugggcacauaguaugcagguacugaaugaggcccagccuucagaugaucaggucuggggcacuucaagaacgaucugcgugcuaugagagagacaagcucuggcugggagucagcaggccugggcugugcucucugcacugccuccaaccaguggaggaacagcagggaaggcacaucgcuucccugggccuuaauuuccccaaggagcugaacuaggugaugucaaaggucccgcuuagcuuugacauuuuaugaccuaacacuguaauagaaucacuaacaugcguggccauuuacagaaugcuccuaaagcccuuccaggacacuccuauuguucccccgcccccgcccuacuccaauagcaagaaaacuuucacagguggagacuuuucuucaacaggucuuuauuggcugggcacgcuggcucacaccuguaaucccagcacuuggggaggcugaggugggaggauugcuugggcccaggaguucgaaacccagccugggcaauauagcaggacuucaucucuacaaaaaauuuuaaaaacuuagcagagcauaguggcaugugccuguagucucagcuacucaggaggcugagguggaaggacugguugagccaaguaguucaaggcugcaguaagcugugauugugccacugcacugcagccugugugacagagugagacccugucucaaaaaaaaaaaaaagaaaaaagaaaagaaaaauggccuuuacugaacaucuaucuuuguacugaugagcacccccagagacaccugggcccaccaggguuucuagaauguucuagaauguucagcauccccugaguugccaagacuagacauuuagggggagcuguaugacaaucacccaaaacugaugggcagaaaugcugugaccccaaguaggccucugggccuugaugacauccucaguaacagagagcacggcaccccuuugugugucugaaggcagagggcugggacccuaccugagcacgcacagggcaucugggcuuuaccugggaguccugaacugcgcagcaaaguggagaaacggacccagcucucagcauguguccuugggagcugcuccccucuguggucaccaggcagcacuugcccaccugugggcuuggugccucucagggagacgcucuggggucugaagagugaggucccugccuuuuacccgucucuggacaccccucugggccuaggcccuucccugugaauccccugccugaaggaagagacccacagcccugggguuccucuggggugccaagugggggacuguguuugguccuggggaggaugggcuggggcugcugagcaggccaggggugcaggaccccuccaucccccgcuucuccuguccuccuccuucuuccacccuugacuccucucaccucuuguccccucuucccuccuguuuccacucucuuuccuccuccccaggucccaccagacugcuccaugccccggaccacaauuuggcugaaggcaacaaucccucucucgcacccuccucccuuuuuccaggcuuaucaacuucacuuuccugugaaaugaagggguggggggguggguaagaaagaaagaaaaagcacuucaugcucacaacacaacaaaaaacagguuuaaacauuuuacagguuucaacauuuuucaggcggucuugucacaucuuaucagaucagccagagccgcaggcaggcgcuccaggagcugcuuuggagaacagaagcugcaacauuccagcccaggcacugccccgcccuccacaccccuucccucccuucccuuuucuccccaaagaaacaucccacagggcucccugggauggagcacagggcccgcagccucuucccucugacugagguauagucuguggccaaacccuuggcuuugagcuccugcccgcacccuuuccuucuccccacggcugcccagaaccaugguccucccgggcucucagguggucccuggcagcugagcugugccaccuccucggaaggccccucguggcccugaaagggaaccuucagaagcugcgggcagaagggaguugcuaaagucguccacagcauguagaaguggucauuuggccagcagggcuagugaguuuccggggcuccuggggccuguccucgggggcuccugucggaggggaaggaauagcuuuuuccuugguuaucuuuucuccgugugcauggguuuuucuccuauggcguggaucacugccugggauauccccuuccacucagucacccccagaccucaccuuucuguuccugcugcacucacggugacauuagugacacaaugcagggugacagguccaggaagggcuggccaaagcccaaaggcucagaguuaagccgaggcaacgugagggauagacccagaaccuggaucccaggacaacagggaagagcuggcuuuguagcuuguaacaggagcaugguuagggcugggaggucccacuguguggucagagagggguccccaagggaaggcagcugugcacugaaggcuuaggaugcaucauaagaaaagcaaaaaggggaggccgggcacgguggcucacgccuguaaucccagcacuuugggaggccaaggcgggcagaucacgaggucaggagaucgagaccauccuggcuaacacagugaaaccccgucucuacuaaaaaauacaaaaaaauuagccgggcaugguggcgggugccuguagucccagcuacucgggaggcugaggcaggagaauggcgugaacccgggagguggagcuugcagugacccgagaucgcgccacugcacuccagccugggcgacagagcgagacuccaucucaaaaaaaaaaaaaaaagaaaagcaaaaaggggaaagcgcagaggagguaggggcacaguggcucccucuguguagguauguuggcugugcaucucguggggaccucguccggaauauggaaaacacaagccagaccugggcgccugcugccaguguuggcugggcaggggcugagguuucgggagagcccaccuuuccagccuccuagugugagguucaggcccugaagcugggcuggcugccccuuggcccccagcccccucccuggugccuccaccccuuggcauauggcaucaaugcucccaccgugacgcucaguguccucccaccgugugcccacagccaagauggggccuaaaguauaauucaacuuuuagcuccuuacaagcauccccagauggauuucuagcuuccgucccucucuugggcccagcucugucucuacguggugccuggaagucccucuggccccacgcacuuccucgucuuguucccaaagcugcuuugcuucuuaccuucccaucuugguggacaccaucuccaucuuccuggucauccuggcucaaaacuuuggccauacuuuccuccuuccuccuguuucucaugggaccaaacggcuaccaguccuuauucacagcuuccugucuguuccugaagccacuguccugagaugaccagcgggcccauccccugccacagaccccggugacccagacacaugggucuuggcccagcugcacaaugagagcugagcccugggagguugcaauggauccccaggccccagagucuccuuagcauccacgucaaccccgccucccagccgcuuucccagcacccaccucuugucucauuuugcacauaacuaacaggaugauauuccaaagcccagcuaaggaaggugcuaguuuguccgaauaaugucuggcacucagggccccuuucuagcugcuuccccuccucugcuucucuguguggcuccuagacccuggcuuggggaggcaugccaccuugccuggggcugucccccugccaccuggcuccaccugagggccccuagccauccuucuccagcucgguagcugcuccacauggagcccuccagaggcagugaggacacacuugcccccguuccuagagaucgcucgcccugaccgugcacccucuggcccagagguuacuggggcugaaaguuacaagugccuugggaccaugucucacucauuuaaggcacccacagugcccagaccuaguaggugcucaagaaaugcuuguuggucuguuacugacagcagccuccugggcugggugcuccucagguguggcuucauuaaucuccacguucccagaaccuggaacccugccaggcugagagucaucacucaauucgugcguguugagugaauaggcagugaaugacuuuguuuaccaaggccagacuucaaccugcucucugaaggacaggcacuuccacugacuccacaaaucaccaggccccagucuugacagcuggggcuaaaucaagacaggagcccacugggcuuagagcccgggcagcugcuccuucaugguuuuaucucaagaccuugggucccagcucagggccugcacccacucuacccucacccuucccuuccuguccuagacauaggcaagggugcucccaccccugcuggagaugcaggcgagccagagggccccguugagagaaugaacuagccccguugagagaaugaacuagccccuaauggcaaggcccagagacaugucccacuucuuugaugaaaggcacccccugaggcaccuuggcgcucucccacagccacaggacacagccccaccugagucccuuugggcucagaagaaacccccuacccuuggcccugcacugaaaugucaagaagguccagaccugugcucaguacccgcagggugcacauguguuccaggagggcgaggaacaguggcagcuggaauccugagcuagguuucucugguuuugucacaagcucccugccaagcagccaggugagcggcuccaguccaggccuguggccucccucauccacagcagugauugccucgucacuauggguguaguugggugcaucagagcccaccaggcccagccccacggugugcacacaugccccugaacuggcuaggcuuccuguccugacaucugccaauccugaacggcuucuugaccuaaguggaaagguagaggccugaguuccaaagccaacgcuugguuccucacuuccugcucuuuccucaaaccuuuccuuucccuucuagaaguuuccguggaggguggagcccuucugggcccaggaacaaguugggccucuguccaguacugcccaggagccagcagguggagcaccuggcccuggccuguugugggguugacaggagcaccguggcccccaccacagggagagaaaaaugaccacaggagaggugauuucugacuccuucuccucaccuucccuccuccucucccucucagcagccaugucagucauuuuaagagacacuagaucuucagaucagagucuuaagaugccuucccuuugaggcuggcacagaugguuagauuuccgcauggagaaagguaagggcaaagggccuauuucugcaaagaaggcaugacuuggggagacuuggcccuggagagcacccugagaccgaagggaggaggggagccuuucccugggccgcagccccuggguccaccuucugcagcuccacccaugugaagccagguggguccuuuuugugcccagccccagagaagcuucugagaaugugcauucaucacccccagguuaaaagccugguggguaaaagaacugugagcccuggguucuccucccaccuccugggcagccagcugugugaccccggaaaaugacaaaccucucugggccucaaucuucccguauagaggaagagggaauuagacuagacccggggcucuggaauuucguccugcacaggggcucuagaugcgaaguugaaggcuggggaugcaagcaccaucccuccuuugauuuuuuuaauuuugcuauuuaaccauuuuaaaguguacuauucaguggcauuaaguacauuccaaugcugugugaccaucaccaccgucuguuuucaucaucccaaacucuguacuuauuaagcaguaacuucccacucccucccuuccagaaccccuggcaaccucuguucuacuuucugucccugugaauuuaccuagacaccucauguaaguggaaucauacaguguuuguccuuaugugucugguugcugucgcuuagcuuguuuucaaguuucuucuauguuguagcuugcaucagaauuucauuccuuuuuuuuuuuuugagacagagucuuacucuguugccuaagcuggcgugucuuuaccuagaaccucauguaagugaaaucauacaguauuuguucuuccgugucuggcuucugucgcuuagcuuguuuucaaguuuccucuacguuguagcuugcaucagaagcaucagaauuucauuccuuuuuuuuuuuuugguuggggggacagagucuugcucugucgcccaagcuggagugcaguggcgcaacuggcucacuguaaccucugccucucagguucaagcaauacuccugucucagccuccugaguagcugggacuacaggcacgcaccaccaggcccggcuaauuuuuguauuuuaguagagaugggguuucaccauguuggccaggcuggucucgaacuccugaccugaggugauccacccgccucagccucccaaaaugcuggcauuaccgccaccacacccgcuuccuuccuuuuucuggcugaauagggucccacuguauguaugggccaccuguuguuuauccauucaucugcugaggacucuuggguugucucuaccuuuuggcugcugugaguagcacugccgugaacacugguguacaggugucuguuggaguccccauuuucuuuccuuuuuuuuugaaacagagucuugcucugucacccaggcuggagcgcaguggcgccaucucagcucacugcaagcucugccucccagguucaugccauucuccugccucagccucucugaguagcuggggcuacaggcgccugccaccacgcccggcuaauuuuuuguauuuuuaguagagacgggguuucaccguggucucgaucuccugaccucgugauccucccgccucggccucccaaagugcugggauuacaagcgugagccaccgcaccugggcagaguccccauuuucaauucuuuugggcguauaccagguguggcauugcuggauuauagggugauucuauguuuaacuuuuugagggacagggcccucuuuucauauguucuguauguaggggagaggagggagauugugugugauuccauuugggaggccaccugguugggugcaggacugccuacccuaauggaucacucaggggagugggugcuggcagcacagugggugucccuggcagcacagucagacccccaucagcaggggauuggccgucacuggguggacggcagcaucugaggccaacaaccccagugucagaucaggcaggacgcacuguacagggugccuuuaggugucucaccauauguuaggugcguaagucaaugcagcauccaggcugaccugaauucacugauuaaaaauguucucuaaaaauguucucuauggccaggcaugguggcuuacgccuguaaucccagcacuuugggaggcagagguagguggaucacuuggucaggaguuccagaccagccuggccaauauugcgaaacccugucucuacugaaaauacaaaaauuagcugggcauggugacgcaugccucuuaucccagcuacuugagaggccgaggcaggagaaucacuugaacuugggaggcagagguugcagugagccaagaucacgcuuuguacuccagcccgggcaacagagcaagauucugucucaaaaaaagaaaaaaaaagguccucucugccuugugcucaccaugcaggccuccugcagcccucuggccacagcaggcguuaucaggguagaggcacagaacugggguggggaugggaguuagauaaggccaugcacaagguuuaggucuugccuauuuguggagggauauuucacuccaaggggucaacaccaaaguuuccacaagcagccuguugugcagggcacccgcagcccauccgccuggcugcccguguguguccucggcccagcugggcaguggguggucggaguggaggaugagccggcuucaggaggaggguggcaggguccuagggaagggaagggccgggccaggagcuggguauaaauagccccuggcccagcugcgaaggccuggcaggguccuccgcccucccccucaccagcugucagugccaggcaggucucuaucccccuugggagccuggccaucaucucagauccuaaacguaggaacuuccucagcggaaccaaggagucuuguccuguguguaggcggaagcuccggaugccgggaggucuggcgagugaggggcaucaggcucguccuuuggaagaguucuucauuccuuuccuccagaaucaugaauaccuagcaugugcccggcccuuuggaaggccgagugggcuggggugugugugugugugugugugugugugugugugugugugugugugugugugaugggguagggaccggggaauaacuggagaaaacacuaccacuaccucucuucuuggagacugagacuggcauagccagauggaauuggaaacaaaucaguucagcacuuugggauaagaagguuugaauuagguacaggaaagauucaggcggaggagaggugacuucugucuggagcucacagaaggcuuuagaaugguggugaccuaggaaucagguuucaaaggaugguguagaaugguugccgggggccgggcaguggagaggugcuucgagccgagggcucagcaugugcaaaugugcagaagugugaaacagccccgcuggagucauucagcuggcuaggcaaauccgucaaagccacgcacacuuuggcacaaagaaucgaggagcaugagagucacugugccgccucccgaaguggaacguguacuucaauaauggggaauaggaguggcgaguuaaaguaaugugucugcgaugguggaauuucagcagugugcgggcaggaggcucaggguggggguggccgggcauguuuggggaagggcagccauccugcagaaaucaaucccauggccacagccucuuuagucuccgacacuggcccaggagcuaagccccaucgccagaggccuugcuaauuacucgcaggaugaccccaucugaacugaagccuuugaauggagcauccugaaaauguccuuuugccugcacucuuugagugaccuugaacccucauccagaucacaacugucuuuguucugccaccccugugaggacugaggucugauccaggcauccuuuccaguguuggauaggaaggggcugagauuucugauguguucuaccaagucagggaugcaaggaugggagaaaugagguuggugacaaggcagggaacaaagugcuggggacagcuccacacacaccguaaccauagcaaccaccaucuagcaagggcuccccacgugccaugcacuggauugugucacuuauuccuccugucgugucuauuuuaccgauaaagaaacugagguauagagguuaagaaaauugcugagaucagcagcuaggaagugguagagcuggaugggacccuggcaccauggcucccagguccacaguuggugggaccugggcaacaggaaggagacaggguuugguggaaagagggaaaacagcucaucaugacugaggcucaggaauuguucucagaggacaucacacugggagucagacaaacucagggcuugaauucuggcucagccacuuccuugcauaagucgcccaacuacuccaugccucaguuuccucaucugcaaaauggggauaacaaugcccaccucccagaguuguugugaggauucagugagauuauguauuugaagugacuggcacagagcaagugcuacauaaauaguugucauuaguauugccaguauccggguaacuguggggacagaaggaaaucccuguggggcagaggagagacugcgucugcacagcaggaagggcucaguggcaccuucuuccuggagaugucugggaagcacuccgaccuuugaggccaaucaagccaugcaggcagugugccagagcucaggugcucugcugggcugcgaagacccaccugggacccugagggagguaacuggugaaaccaggaagcagggagccccuuggagagcugggugaggagccgccuugccagcaugggccccccgacuccucagucccccaagccagccggccuggcuuucucuguggauauggcugugugaccucgcacaaguugguccucuuucacggccucugcuuuuucuuuuucuuuuuuuuuuuugagacgaagucucgcucugucgcccaagcuggagugcagcggcaugaucuuggcucacaacaaccuccaccucccagguucaagcgauucuccugccucagccuucuggguagcugggauuacaggcgugagccaccuggcauggucggccucuguuuuucaucuguauaaugggcuuugugcucccuuagggcuccuccuguggguucugcugcuggaccagggcucagccuccaguuuagcuugagggugcccaggccugcagaaggugucaagcaagggcugggagagggggaggaaggaggaggcaggaaggcaacgggaggggaaggaggagggcagaggaagggucuccgagugccucucacucccgccucagcucuccgcuccaguggucccauauagggcucugggucccaaacaccagaggaaggagcggggacagcccaggcuucuucccugggucuuguuccugagcugcccaucuaggauggugcaaggccgaguugucugcacugaacucucccucaguuuccccuccagugauugcagggcugugggggcagcuggcacagcagggcugggcuggagaugcugcuuaagagcacgggaggggcagccugagcccagagggaggcucaacggggaccucugcagccuggcagacagggcaggguacuuagcucccuggccucaguuuccucaucuuggaaaugggacaauggcgaugauaaugaaguuuuuauuacagaccugccgugaggauuacauaagguaacagacacaagcacucagaacuguguccagcacaugauaggcccauaauaaaccacagggauuauaugaucacucuaaccugcuucuaacagggcaggggcagugcugugugcgccgugugcccaucagggcucugggcucacugacucuacccacucaggcaugugcucaguauggaggcccagggugcagaugggccaggccugaagccaccuucaccccaugaagacccaggcaggcacugcccagcaggcagggucacauagugaugacccccaugggcucuggagucugacacccuggguuccaaccagcaauuccauaggagcucuguggucugggcugcuucaucaaccugcaaggcuaagccaucuguaaaauggggcuaauaaugacccuacuuugugcuggggcuauuuugaggauuaaaugaggcaaacccaaggaaaagccucugcucagggccaggcaccggggaaaucaguaauuagccauuaccaccgauaaaucagaacuucugggccgggcgugguggcucgcgccuguaaucccagcacuuugggaggccgagguguguggaucacgaggucaggagaucgagaccauccuggcuaacauggugaaaccccgucucuacuaaaaauacaaaaaauuagccgggcgugguggugggcaccuguagucccagcuacucgggaggcugaggcaggagaauggugugaacccaggaggcggagcuugcagugagccgagaucacgucacugcauuccagccugggugacacagcgagacucugucucaaaaaaaaaaaaaaaaaaaaaagaacuucuggcugcugcuucuuucucuuuagaaaaagcucagugcuuaagaccuggaaugccucacagauguuaccauccaaacucccagaucuggcuccucaguuccuccacccaaaauaaacaaauggaaaaaggagaaccugccucucccccugacaacugagccuggagacaaccaagguggauggguagcaugccccugcacggugcccagggagcucugugccuuggagucuccacgaauuggccaaggccaacaucaagcucaaguauggaggagggacccgggggaaggcacauggcacucucugacccaccacagaccaaaaagccguaggcaagcuaauucacucucuaaaccucaguuuccuaguccaggagauagugauguucuucauguuugggaauugaucagaaauguuguauauaaagugccuggcaagcaguaacaguugccaaauggcagauguuuggcucggcccuguguccagcccagaagcuuuuguguacuaaaaagcacacaaaaaaccucacccugccccauggggucuucucccggccccucuuuccgaggcuuuugcccaucacuuuuugugggaaacuugacuuaggccaaugcuggaccaaagccuuggucagugcuggacacagagggagaggagaugggccccuucuuccagcucacacugccccuggucauacagcagauugcaauuguccuugaaggccacugacacucacggaucauuuucucagguucucccagaaaaugucauuucugcuguuccugugcugagggcagggaacggaaaagucguaauuccuaccuugguuuucuaguauuuuaaacucuucugccccacccccauaaggucauucuuucuguuguugacuauaaaaccugagagaguugaugggauauugauuacaaagcgaggggcagaggaauggagugaauugaccagucaccugguguugggugugggcagugagaucugagaucucccuucugacucugugcuaaacuuguuuugacacaaagccaagcuccagucucucaugagaaaagagguggagcucuagaaacuucuaggaaacuggaaagauggucauggaggcccugguagacaaaggacuuggugcaagccagcaauuccuuggggagauacugggaggcucugggcugggcuggcaccaucgcagggaagaggcugagggcauugccaaggguagugugugugugugcgcgcgcgcgcgugucccaugagucacuggaaguguccauguggccccaguauccuggacugccuuggaaauugcccagccugaucucuucaaugcccaucagggaagcuggacccagaaccuggaaaggacuggaucugggccccaaauaccaucuuucuaguccaaaccucuuuucauggcuuugcauugcccccaagggcccccacaagcggcuucugcggucccaucccccugcaagcuggaugcagccagagggcugacuugcgugggucagagcucugcgcuuugaggggcggcaugcucccgaggucaaagguagcacauucaggugccagggcacaggcccucugccucuccaccuaccccggaggguucacaaagcggccauggugcccaggaugggcucugugcuuugugcccacaguguuacuacccucugucugccugcaggucccuggcccugggccagcaguacacaucucugggcucacagccccugcucugcggcuccaucccaggccugguccccaagcaacugcgcuucugccgcaauuacaucgagaucaugcccagcguggccgagggcgugaagcugggcauccaggagugccagcaccaguuccggggccgccgcuggaacugcaccaccauagaugacagccuggccaucuuugggcccguccucgacaaagguacugccuuggggcugagggggggggaggggcuggguggggggagggaucaggacuguaugcccuuccaccccagucagggugccucuucucugaagccagggucccucugggagggugauaaauuugguugcaugacugccacaccuucccaggcgcugcugggggcugggccgccuugagaugcuccaggauccugagguuugagggccgacaccaagaaggccacagacuuccuuccuggcuuuugcacagugggcgccucaggcuccugcuguggacauuugugacauuuccccaaugcuguguuaagugcuaugcaaauaccgcuuuggggugggggugagagcauugccaccccuaggucccucccaucuagaaaguccucaguaggugaggaagcugccuggugcugugguagcauugcguugcccccaagagccccucuagguuucuguucauccucaugcccugucagcuggauaugcccaggaaucaugguggggcuagagggugcacuggccucuggguaacuuuccggccgucuugcagccugggagucuaacuggcugugccucaaguggacagggaaccacaugauuugacuuugaaccugcaggcccugggagggaggcuaagugggacaacuccucccaagaaggggacuugggggcucauggacuggguggaagaugggcagcucuuuguggaacggcaguguccaggaauuuaacgauccuggccgggcuggccacagccagaguugcucugccacccaaaccgcugagccuggcccucccuccuauuagaagcuagggaaugaaugagagcugccuauacagccagaaagaaaagggaucugacguucaggugaagggguggggugcugggugggguugggggggaagcugacaacccccauuuuagagugcaguuccccuuuaccggugccucaggugcucagggucugucccaccuacaggcaaagugcuggcuauugucaugggacaggaggguaauuagcaaaucaauggaugaugauucuguuuacgcuucuauugccaaaacuaauuauuccuuguugacauaaaagauuuggccucuuaauuggggccaaguggcggcgguuugcauuucaaacucguucuugucgguguguuggucucagcgcuuuccggugccccuccucgggccagguagcgcugaaucaaacaacccugcgucuagacgcgcuccccaaaagcgagucaccucugaucgcucuucccgucuccggccaagagccaggggaaagcggcucugggagcgcuacccauucacuccgcguugaacguuuuaagucaccaccguagguucuggcacacgccccggucccuagauggcccgaggacagguuuggguugcggggggaggggcgaugugugcccgagaguuugggaauuugcuggcggcggcgaggagagcaucccggaagacgccgcgagcgcauacgcgccccggucggugcccagagcccggaccuugaacccagguucgcgcccagcuccggccccacguuugcaccccgcccccggcgaguccccacaccaccgccgcgugggcggccaaggguuaaucucugccccgcgcuuugagacccggggcgcagcgggucgggcagcccggggcgcgcgucuuccgcgagucugggggcggcggggucggcggccggaaggggcgaggcgcggcggcggcgcggcgggcccgaggcgcuuccccaggcgggggcgggggcaggggcgggggcgggcgccggaggggccugggcggccugaaaagcgcccgagcaccgcccccccaccgcgcggccgccgcgccauucacacgcccucuggccauucggcgcggcgcggcgcggcgcggcgcgggggcggggggcgccgcuucaauggggauuucgcggcccggcgccggggccgggggcgcggcccggccgcgggagccgcccguugcuacgcgguggcggccggcccggcggcccgggcccggcggccgcauuaugcggguaaugcggugugacaccgcgcgaacaaaggcggauugagcggcccagcgggccccgccggacggggaaggcacagcggggcugucagcgccgcucccaggcuaauccccgccccgcccccgccgcccccgcguucccggggcugggaacccagcgcggcccggggcccgggcgccgcugccgccgcgagaggccgcaggccggccggaaacgaggggcgcccgcccugugaacccgcccucggccccucuuccccgaggcgcccccagggcuggggcgucuaggauuggggcgagugagcggcgcggcugggaccccgaggccgggagcacaacuggacgcgggacgucgggcccccuugccgccguccucggucggcccuggcagcgcaggcgcggggcgcgggcgggaccagcucugcacucuucgcccucccgucguuggaagugggacgggccccucuguagguggcgcaggagggcgugggggccgcggagagcggccgcgggagccaagaggggucccgggcuuccuucuugcagcacucggcccacagcccaggaggggaggcgggcgccuggcuucuaaauaaauuuggucacauuuaugaccaauuuugccgacuaggccggcccggcguuucacagccugugucagguggcgagucaccuccggcucccggguccugccaugaggagagagaugguugggcugcaggucuugcaggccuuggccucccuaaucgucaauguccacaucuauaaaaugaguaaaacuuuccaugugaaugaagcacaugcagagacgaugaccguugugaggaggcuggagcacacccuugagagucucuccuuucccugcgcuggacccugggacagaaccaggggaacugcccggugucccuacccuucugggagggaguuggccgugccugggcgugagggcaggagaauggggauggggagacugaggcacgggccacugcccuccuggugaggggcucuaggagcggagggaagccguguccauuuuacaaaaagggcgacugagaccgagaaaaggagaggggccgucccuaugcauccacgugcggaaggggugggccugggcagguuuaggcuguagauucccaggccucccuccuuacagaccuggaucucacucaggcgugggagggcucaggccugugcaggguggucucuggacuuugggaagguggagggcagggggugugggaccaggacagaaguggcugccuuaucucugcagcaaccugccagagguuuggugucggcgccuguuucuaacaggcacugcuuugcccuguggcauuugagguccugagcuaaucagcagcccagggccucaguuugcucaucggugaagugggaauacccaacugggucuaaaccagccaaagaggguggggaagcugccucccucuugccucagggcuggugagcucuucaacucuuccuggccucguuccccucacguccuggccugggagguggaggcagggcaggcgcucccaggccggguccugagugcugccuccccacgaccuccccgcagccacccgcgagucggccuucguucacgccaucgccucggccggcguggccuucgccgucacccgcuccugcgccgagggcaccuccaccauuugcggcugugacucgcaucauaaggggccgccuggcgaaggcuggaaguggggcggcugcagcgaggacgcugacuucggcguguuaguguccagggaguucgcggaugcgcgcgagaacaggccggacgcgcgcucggccaugaacaagcacaacaacgaggcgggccgcacggugagcccggcuacccuccccaaacccuucagggagcagccccccgcuuccccuccggagcugcccuggcccccaccucaccccuuccggcagcccugugggucgcgggcuccuuuuccccuuggccaggcuuggccuccuccccaccccacagccacuucgucuguccacccuccuuccuccuugggcaguuccuggacuccaccccacccgggaugagucggccugggagcauggccaccccgugggaucaggugccacccaccacccauccugugcaccuuggcacgcgguguagggcugucaaguccugggaaccuggcuuugaauucagccuccacucccuuacuaugcuuguaugaucuagggugagucacguuaaguucccagccucaguuuccccauguguuaaauggagauaacuccuauuucuuuuuucuuuuucuuuucuuuuuuuuuuuuuuuuugagacggagucucgcucagucgcccaggcuggagugcaguggcuggaucuugggucccugcaaccuccgccucccgaguucaagcaauucuccggccucaaccucccaaguagcugggauuacaggcguccgccaccacaccagcuaauuuuuguauuuuuaguagagacgggguuucgccauguuggccaggcuggucucaaacuccugacuucaggugauccucccgccucagccucccaaggugcugggauuaccaccgcgccugggcaacaacucguauuucaugcgcugugagaaguggacgugcugucuacccaugcuuggggugugaagggggagggaaacauggucacuauucuuuaggucuugccucaguccccaucaguucucuuccugucacagaggaguagagaaggcuggagggaagggggugggcaguggcagagagggaaggccuggaugugcccccucguggggucggucuguuggccagcugccacuucucucccccagacuauccuggaccacaugcaccucaaaugcaagugccacgggcugucgggcagcugugaggugaagaccugcuggugggcgcagccugacuuccgugccaucggugacuuccucaaggacaaguaugacagcgccucggagaugguaguagagaagcaccgugagucccgaggcuggguggagacccuccgggccaaguacucgcucuucaagccacccacggagagggaccuggucuacuacgagaacucccccaacuuuugugagcccaacccagagacggguuccuuuggcacaagggaccggacuugcaaugucaccucccacggcaucgauggcugcgaucugcucugcuguggccggggccacaacacgaggacggagaagcggaaggaaaaaugccacugcaucuuccacuggugcugcuacgucagcugccaggaguguauucgcaucuacgacgugcacaccugcaaguagggcaccagguagggcuccgggaagcaggggggaggcugggagccugggcgcagggaaugggguuguuugcccaucucgucuucuugacgacccccuucuguuucuaagcuauccaagacacacaaguucccacagccaaaauaggaagcuaggauuuuucaagcauccgugggaaugguccuugggcagagacuugguggauugcacaaagcacagauaaaaacccaguguuggccgggugcgguggcucacgccuguaaucccagcacuuugggaggccgagguggacggaucaccugaggucaggaguucgagaccggccuggccaacauggugaaacccgucucuacuaaaacuacaaaaauuagccgggcguuguggcaggugccuguaaucccagcugcuugggaggcugaggcaggaggauugcuugaaccugggcgacagagguugcaaugaacugagauugcaccacuggacuccauccagccugggcgacagagugagacuccaucucaaacaaacaaacaaacaaacaaaaaaaaacaaaauucagugugugcacauuaggugccagcaauugauuaacauuuuuacacaaguuaguuaugagccagaucaaauuuuugcauagcugcuagcugucauucuugagcauuauuuggagauggggggcuggaagcugggagaccugacgucugguccuaacuuugucaguaacuuccuguucuuucacuuuucugggccucagcuuucuuacuauaaaguggugaugguggugaagggcagggggcaguuuaaauaccucaagcagcgagccaaaaugucuccucuaccccugaggcagagucagugugcauccaccuugaacuuagagggcaaguuccugcacaagcauaaaucguaccaaccucagggagguggguggggggaagcggcauauaagcccauauccugacagaucugaagcuuggguggaguggggagcacucucaccgaguuuauggaugaugacggggagcaggagggauucaaguucagaguggcugggaugaguaaucgagggaucaaaggcggguggauuuuguucccaagcuucccagagguggccugcaugggaggcgcuaugcacuggcccuggguuccacagcaccccgggauaggucagcauggaugaggagugguccuggacccccgggguggaagguuuuaaggcuggggugcccuuucuuccuuuucuguccccugagaaggagccuagugugucgaggcaugagcauggguguuggaauuaggcccugcccugcuccagcuccuaccacuugccaaccgugugacccaagcaagaaauucuucauagaccugguuccucaucugucauccuccccagagaugcugugagggacaaaugaaaggacaccgaggacagggcuugguuaauugggaagcacuucccugcugggucauuguugucuggggugcugcugggcgagagcagccugugaaaggguagagugcccccucuuccugcaguuccacagggcaccucugagcuacuggcacaugucugugccauagggaguaggggagggaaguggacgggccucucugagauaugggagguacuugacgucauggagaagagcucuggcugaggggcgacucacucagcccaucuaggaagccccucgguguagcucaaguucuguccugguggggacaguccagaaaggcagcagguggcacuaccuuugucgguaucugaacaaaagcaguguggggagugggagaggacgaaggugaauccagcgccuccacucguccacucagcugucuggccugggagcgccaguuuccuccucuguucagugguggugacaaugggagcccagcagaacuuuuuuuuuuuuuuugagacugagucucucuuugucgcccaggcuggagugaagugcgcaaucucggcucacuguaaccuccgccaccuggguucaagcgauucuccugccucagccucccgaguagcugggauuauaggugcccgccaccacgaucggcuaauuuuuuuauuuuuaguagagacggguuucgccaugcuggccaggcuggucuugaacuccugaccucaagugauccacccgucuuggccccucaaagugcugggauuacaggcgugagccaccgcgcccggccagaaucaguacucuucaucagcccucuuucuccccauuucugaaauggacaaugaguguuuuuuuuccucaaucuuauguaaagugcuacauagauaugguuucaagaugcuguguccaagugguuccuacccggaaccccuucucuguggaagcucuggaggccucacucugugaccaguggaggacacucucccaacauggugcccuucugauaaacacucccaggccagcucuucugccucgcugagcccuggcuucuucauuugugaacuggggaugagaacuguguucuguguaggguuguccuguggacuggagacccugcacaugaagggccuggcccaggacccagcugcucacagggcagccacagaggcuccugggccaagcagagcugaccucccagagccaccuccccaggcgagagccgccugcucuggagcaaugggcccaggcucggccgagacuccgcuaggcaagacgggagccugcgggaugcacuggcagggauggcaggggacagagucguuagcuguucucuugucuucccugacagucuuggcagugcaggcaggagagagaagggagucgcagagcaggccccgggcccuccacacggugaggagagagcgccugucaaauggcuuguguccuuccuuuguggggaaaacaccuuuucuguagcuuuuuguagcuuuuacccagugucucuggcuaaccauugauuuggugccuuacaagugccagauuuauuccucgucacucugcuguugugaacauggugagcuggagcuggaaagguucuggcaagagucgaguggccuggcugcgcccaaguccuggaucuguuacugccuugcugagagaccuuggaugugucccuucaaucuggcugagccuguuucugccucuguaaaguagucuuaucuuggccuugucagcccccuagaagagcuggggguugacugggaaugccucaaacccuuugugagauaugacuaugcaaaugaguaaaaugaacacacugcugcuccaaugggaaggaauuguucguaauuaaguaggcucucucccauuuggacagcucauuaucaagcuauuuggugcgguacaaaaacacagugcaugccuggcgugagcccagcacagcaguugacuuggaguuggggacugggcccucggccaggcaccguuucucccauccugagugaccugcuccugggcuuccuguugcccaaggcccucagcuagaggugggggagguagaauuucgaucccauucuguggacucgaaagccuuacugcuccugugacucauacgaccucccucaacagcaggcccaaagcacagaggagagcguggagaaaccacccaaguccucaucaccucugagcaccagggacacguucagauccaucagcagccucugaucuuugaaccccaauggguggucucugggaauggaauuauguuucuaauucuuccucuugauuuuccccaagggcgcugggaaggggugaaguguguggcugggcggauucagcgaagucucaugggaagcaggaccuagagccgggcacagcccucagcgucagacagcaaggaacugucaccagccgcacgcgugguaaaugacccagacccaacucgccuguggacggggaggcucucccucucucucaucuuacauuucucacccuacucuggauggugugugguuuuuaaagaagggggcuuucuuuuuaguucucuagggucugauaggaacagaccugaggcuuaucuuugcacauguuaaagaaaauaaaaaugaaaaaaaauuugacuccaacagaacaggcugggcuaaugugagcucucagccuggcagucaagacaucagcaugggcaagguucuguuuccaaacugcugcuucuggugacauuccaagacgccuggagggugggagucaggaaguaggacacaccccugcagucuccuuuucuugguccacucccauucaaauuugagcuaauuucucauucugauaaaagccauagguuuagcuaggaugaagugguaggaagguccguggcaguuguuagaguaggauuuggaguuuggaagaacuggcagcucaggguggccuggucagccguuugaagagcagccauguguucuucucagucucauuuucucuauaacccuguucugcacgaggggcagucagaucucaaaaucuuuuucuaccauucugcaguuuccaccgucaaugcaguuuuuuuuuuguuuuuuuguuuuuuuuuuuuuuuggugguaguggaccuuguaaauaggcuauguaagggggcaagucuucucuagcucaaauggcuuccuaaauaaauaagcgguaucuucagaaggggccauucaguccuucccagcccugcucaccugcagauucucuguacaaauaacuccagguagagcaguuggacuccaggucaccuuaguauaaguuagacaaaggguccgugagggaguagccaucaauuccugaaauuccaacuuugugacuagcagauggggaggaugaaaaccaucccuuugcuuccucuccaauacggacccaucuuacuguguccuuuccucucuggggccaaugugaguaaacacagacacagaguucuuucccccagcucuuccucccucaccugcaugcugagauagcuuccauccaugcaguucccaaggaucuggauuagaaguucaaaggggaaccagcagucaccuacucccuuaggugaagcaucucacggcugaguucucccugaggcauacugguccagcugagcguccuagagaaagcuagcaaaagggaggcacauggauuucacaguaugaauugguucaacaacugucuuagggagaaucagaaagaagagaugcagcaggggaaugagcagaacaaagauuuuucuuucucccccuucucucuggggucuaccuaacccugaccuaaaauaccagggcagcgaucucccagcuggugcaggugggcuugccaagauggucguccaggagcccgccuucacuucuaaaucugcuggccacaagcccugcuaaagauacacaucucacccccuccgccaagucugaaaugccccuccccaucucaccuuagacugaaaaguuuuaaaucaugucaacuggauaauacuugcuuuaugugagaauacuucagcagaauggauacgaauuuucaaaacaaucuuuucauaucuauguauucuauauuaaaagugauaaagucauguuucuggggcguauucaaguagcugacaaguaauuauuuaauaauaguacaugagugcauuguaaugauucucgccguagucagguaauaguauccaaccgaaauuuccuaccaaccugcuguauccaaaguuuuguaaaaaguuguagaaguuguugaucuuuuugauuuuauauucaaaaagucucuuuuuauaaauauuauuuauuauacaauguauauaccuuugaguuaacuaagauuauauauuauauaaauauauauauauu

SEQ ID NO: 21283 - RNA, 6132 nt, Homo sapiens
gcggcggcggaucccgagccugguccggcccggccuucccagugcgcucggcccggcccgcgcaggcggcgaguccuccgagccccgggcccggaccccucgcgccggucccugccccgcgcggccucggagcgcgcgcggccccgccccgccccggccucggcccgccgggcccgcaguguggugagugcggcugcggcggcgggcccgggcggugggggcggcgcggcgggggcggcgggggccgagggggcgcgcaggcagggcuccucccggagcuaggcgggcgguugggggcccggcggcgggggccgcugguuucgggucugccgcgcacccugcuggcggcccgugccucgauuuccccagcggucaggagccagcuccuccugccccuggcgcccggguacuggaggugggccgcgggcggcggcggacccgcggagccgggcgagugcggagcggacucggagacccgggcguccuggagggaggggcacuggacggcgggaggaaaggguggggucgagcgaggcgcccggggguccgcgccagggcccggcggcccggcccgcagcugcugauucauccgguggccgcgucagcucuccccggcgcggggguccgcggcgagcccgggaggaggggcggcgaugggggugcugcggggaagacccugccccuggcuggggcucggguuccgucagucgcgugccagagcccggagggagacuugcugagucaucagcgugaggucacucggugcucaagcugauaccggaggggauucgagcgaggggccucggggacuaaaaggccgccagcgggaggugggagggagccguggggaugugggagggggccaggcccggcgccuuggggugccuguuuaagugagcgccgagcgauccaguugaaggcaggggugcuugaagaggaaguggggguggcucgcugcagguguucucccggggucaaaggugaagccccgggcgguccaccccuucccaggcggcucuuuuccggcagcugguccuggucccaagucuggagcaguuuuccaaacugggaaauaguucccugagugagggaggggaggagcuucggugggccgagcuagccaaaggggaagucggcuuucccugggacuggccugguuggacagccccuggccagagaucgagguccugggagaaagagggguguguguaccaagcccugggugacagugggcugggcagggaggaagcaggggcagcucuaccaggaaacggcaaaggggaggaagcagcccagccucucuccccaguuggcccuggagucuggguugagacuguagguggugggagcuucagggugccuagccuuggggugcagcagaugggcugguguggauggcacaggguggcagaacgcagcacccagccacccuaaaguugucgcuaccugaaguggggucucagcguugugugaaguuagcaaagggaguggcccuguugggugucuggccuggcagcccaggacgcuuagaaaguggcagcuugggagugauguggccagagccaccuuuccuuggguauguggagauucacgaagguugacuuccuuugcccaggaguucauuucauggcuggguuaggcuacuuugugguuugcccucagggaugccccccgccccccgccacacacacacacacacacacacacacacacagguccauucucagugagcaccccccacacauacacacagaacacagguccacucucagugagccccggggcuuauagauuccagauguuucaauguuuuagcugaccguuggccuggaguuugaugcccugggaaaauuuugggguccuggagggacauuuauguacaucuuuuuuuuuuuuuuuuuuugagacggagucucacucuuuugcccaggcuggagugcaguggcgcgaucucagcucacugcaagcucugccucccagguucacgccguucuccugccucagccucccgaguagcugggacuacaggcgcccaccacgacgcccggcuauuuuuuuguauuuuuaguagagacgggguuucaccguguuagccaggauggucucgaucuccugaccucguaauccacccaccucggccucccaaaguguugggauuacaggugugagccaccgcgcggcccauuuauguacaucuucucagucacuuaugcaucaguggaaacuaaguuuuagguucuguucaaagagugacuuucaggagcugagagcuuauggagcagaggccaugacugccggggaguuucggccgcugggcuuugcagccagguggggcugucuguguucaggcacgggaguuucuacuuuagccaaaggagacggagcucccaaaucucccucccuuuccuggcucucagugugaauggguggccuagguacccucgcagguugcggagccgugaccaucugugccuccugcgugaggugggcuuauuagccucugggagcagagggugcaugacaggccccagcucugcccagccuugagggcuggaggagggcgggggcagcuucuccucaguccagcuccugggaucccugcauggucccucucagcccagguccagaggccaggccaggagccuggaacgcacuggcugugcucagggcugccccucccccaccccccggcgcaccuuugauaggaggcgauggcuugcacuugugcugaguucaggccuucugcggagggcaaaaucugucgaggaggcacuuuuccgugugaucucuucaggaagucaccacugucauugugcuuagcagcaggggugggggcgaugggggugggagaagcuggugccagggcagugucucugcacccugacuugcacucaaggcuggggggccccuccaugcuuggcugagggccugucuccuggggcaguguugugccggacguguaggaaagggcuccugugggccuucugaccuccagcucaggucuuccccauccuuuaucuggaagaauccaguggcuggagccucgggaccuugccucugagcuggcuuggcuguggggaggggucucuggccuccccucccugcucugugcuugcagccucaccuccuggucccaggcugggugagguggagucuugagccuggugaggaugugugcauccgccuggccacacuucagcuccccugaugagaguaagaagccccccagcccauaauuuccugaagugauccuagcuccucuggaggagucucccaucugucugcaucaaaccuggaaagugggggauggagcaugaggcggggguccaugcccaagggucuggugggagcugggcugagcugggaaucccagaaacauccuuagcaagaaagugagagcagagugcuggagggaccccgaguggggaagaguugguuguuaaguccggccaccccagcacuuuuguuuuugcucccuggcccugugggcacucacccggggcagggaccagagagcaggcugcagcucggaggggcugacuccgccagccuucacguugggcaggcccgggguggcucacugugggagcccuugugaaauacccuggaugggguggggcaggggcugcuuccugcaacccaaagccacaggaugguuacuccaucaguggaggaggccgacugggaggucuagaggggccucgggccaggcuccucccagcugauggccugccaccuggaaggugggggaacucccuggucaguccugccaacagaccagagcuagauggacggcccacccccagcuuuucaaaguuaggaggcugggagacucgggguucccuguagccuccucucuggccaggucccccguggggccccugugcacccagggagcagggggcuuuguccgaggccggcucaggggagguggcuguagaagguaggacccuggaagaugcacacacagggucacuggcuggcccucaccugcuauuggccaggcugggggcugcggcucucguggggcgcuguuggcuggcgggccagggagugcgggcgcggcggggaggcagaggcaaugugcugagucagcgugacucgccaggaacagccgcgcucugggcagugccgggguuauuuuuaaagcucccggcuuccuucuaggccugccucucccgcgucuuauuccuucuaaucucuccccugccccuugucuugcgccugccuuccuaacagccuucaguuccccuucucccgucagaccuuccugaccucccaccugguucucuaggggcaggguggacaggaagcagcucagcccagccugggagaggccaagggcugccuccuaucagguauugggggcugggcaccuggacagcaggcuggggcgggcugugcggcaagggcucuugugaacugggccgggggcgggggggggggggugcggcgaggguggucuccaggguacugaccugcuccgugucuugcagagagcgccugcucgcugugcccccggguuaugacgacccccaauaaaggaaacaaggccuugaaggugagugggcagggacaggagccugugggcuggggucggggggcacagugggcgugcccgcuuggccugugaccaccugcacugugccccaggugaagcgggagccgggugagaauggcaccagccugacggaugaggagcuggugaccaugucggugcgggagcugaaccagcaccugcggggccuguccaaggaggagaucguccagcugaagcagcgccggcgcacgcucaagaaccgcggcuacgcugccagcugccgcgugaagcgggugacgcagaaggaggagcuggagaagcagaaggcggagcugcagcaggagguggagaagcuggccucagagaacgccagcaugaagcuggagcucgacgcgcugcgcuccaaguacgaggcgcugcagaccuucgcccggacgguggcccgcagccccguggcgccagcccggggcccccuugccgccggccuggggccccucgucccaggcaagguggccgccaccagcgucaucacaauaguaaaguccaagacggaugcccgaucguagggacgcgcgucugcccaggcgggucuuugcggggccacuaggcacauggcgaauuuggcugcccugucccucuguuuccuucucuucucuuuccucccucucuuccccacccuucucucuucccugcaaagcacaaccuguaccccaggggcgccgggcugagccccuuugaucucgucauugucgucguguguuuuguauguugggauuggucaguucggcggugacguggggucgccccaaccccuuuuguaccagggccaugcaggcuuggaguccagaguuggugcugugggaacggacuagagagaguugcgggagagagaaggagcaggcacgcugggccucgcguguccccgagcagugagggucccaguguucccuccacucccgaguggccacaggcucgcgggcugggaaggauucacucucuuuagccccaggggagcagcucagcuuagcccagcaugaagagaugggcucugcucugagaguagggcgggcuugaaggcccugauggguggaccaccagccugggcgcaguggugcugggggcgugcagcugggcccaggggcugugcacucaggccugacccguugcacugaacaagaccaaaucucugguugugcgcuuaacgugaggguggguccagugugcccugcgaugggucccgugucacuguuuacaugaccuauuugugugguuauauagcccuuuauuuaaaagagagaaguuccuuuuacaaaguuauuaaauuaauuauauguuuaaaaguuaaagaaaaaagagcugcagaguauuuauaaaacugucuuuuagaaaaaaaacaagcaagaagaccauuugaccauaugaauggaaaagggaagaaaguauaauagaaacuuugcuaguuaaaaaaaaaagaaaaaaaaagaaaaaaaaucccuuucuuguaaacuuacggacaccucuuuguggcuguuggaguuuaguuuuuauauacacagaguuaucagacauuauuuauaaaacuuaguuuaaaa

SEQ ID NO: 21284 - RNA, 20456 nt, Homo sapiens
guggagucggcggccgaagugcgggcacgcggguccguccguccuuccgcgcgccuguggguccgagcgccccgccgcagccggcuggacccccgguguggccacgggguaguccccaguguggcccaagcauucccaucccgcacacguggccccggcggacacgggggucggggauggcucgggaggcgcgccgcgggcucggucgcagccgcgugcgcgucggggcccgcggggcgggaggcggaagucggggggcggugguuucccgcccgccccgcccccggcgcuccucagucccagccccacccccccaggcgcguucccgcgcagggucccggcucgggcggcggcgcgcacgagcaucaccccaccggcggcggcgcgccgggucccggggcgcagccccgacgcucauuggccugggcggcgcagccaagcugucagcccauguggcguggccgcccggggauggccgcgguuuaaauagcgucggcgccggccuagagggagccagagagacggcagcggccccggccucccucuccgccgcgcuucagccucccgcuccgccgcgcuccagccucgcucuccgccgcccgcaccgccgcccgcgcccucaccagguacgagcagccggcgcuggggccggggcgcgggucguggucggggcugggcccgggguucccgggguggcccggcuccucauccuccgcucucggggcgcgcguggcccggccccguauccaggggucgccugggcggccuguccgggucucgguguucgugccccuucggaggcgcccggggccccgcggaguaggugggcggauggcgggggaaggacgccggggaaagccaccaacagccgccuucgcuucccgugggggaggccgcggacccugaagggccuggaggagcccccggcucggccuccccgcgcccacaaaggcgccgccgcauccuccucccggagccgccccggagccgaggcccagcccgaaggggacgccgcgagggaggaacgggggggcgcaggggccgcgccgggaccggccuccccaucacguggcgcagcccggccgaagcgcaggggucccgagcagcccccgcccggggcgaagggaggccgggcgcgccgcgguguucccacccccugccuggccgucgaccccgcgugaauagcaagcggcgaggacccagcgugcgggccuggagcuggcccggggcagccaagccucugugaaucgcagcgggugggaaggcggccgccucccugccgggacggcccaagggaggccgcacugccgaggggcggcgcgcguaucaggcccuggggccucgugcaaguggccagaccagcgcuggccuccgcccccuccccccagggccgcaccagcccucaugcuggaggaggagccggcggccugggcacccguuccgggucuuagggaccugggcuccagggagggccuccugugguguguggguugguauggggaggcaagcgucuguggguucacccgcgcaggugaagggugccaggcaacaccugcguguccuggccaggagugguucuccagguuggacccugcuggagggguuggacuggcugggucgguccacaguggggcaggggccaccuuucccccagagcauaggcuauccccauuucgucccuccccagcccugguggcucuugggcuggccuggacagcgggcccccaccccaacacgggugagcaugggugcugaguaccccccucuagggcucccagccaccuccaugccccggcuuugggacccugccucuccauuucuuugauggcccuuagcaggcuggccaccugaggccuuguccccaucucaggugacccugccugcuccucacugugagcccccuggugcccuagggauggccugggacaagcuccaggagccuuggaaggcugagacucaggcgaguggaagccgacacaggcgcagaaaccaguaacugcuggggaggccagggcugcagggcuccagugggguaccccagccaauacccugaacugaaugggucagggcccagaggcgggccuguucccagagcacgcagccccucccagcgagagcggggucagggcccaggaacuggccacaugaggaagggagccgcaggagccagggcccgcacggacccucaggguggugcuuggccccauggguguccaccuguucugggugccgaggcuguugacgggggugucguggccgggauguguggggcacucacaccgcccgcccugcagagcagccauggaggagguggugauugccggcauguccgggaagcugccagagucggagaacuugcaggaguucugggacaaccucaucggcgguguggacauggucacggacgaugaccgucgcuggaaggcggguauguggcugcggggcuccccgugccuggggugugaagcuccaucuccaccuuuguccucacagcagccucccugcugugcuguguccucaccacccaggcacuggccugaggccggucccagcugcagagccacuggucacccaugggcgaggccuagcugcagccuccuuccuggacauugcaccagaguggccuagaaaaugcgcccagccugccaggagguucccucaacggcugcaaggccaacaggaggcucccccaauggcugcaaggccgagggcuggcccaggcagggcccaucugcuuguuacggaggagccaagcucagaggaugggugacgggcuggggucucucacccaugcagggggugcggggggccagagcccuuccggccaggcugccccugccugugucuguccugagcugggagguugcauaccagaugugcuccgggaggcuggagcaacugccccacacccaguaggcucuuccacagagcagcucuaccugacaggcaagcugugagucagcaugguagagccgaggcaccagcccggcagauggucccccagccucacucccgccgagcucucugcucugcggcccaucucaggauuggggcuuggggcuuggggcuugugcagcagaucuggucguaccaguccccgcuuuggggccauggucuuccccuccuggggagccugcuccauuguuugggccucccaggcauagcagagaguccucaguuccaccauggccccuccaggggccugcagcaccccacagggcccccaccucugggcagcuuccgucagagauuuaaacacccgccugucccacagggcucuacggccugccccggcgguccggcaagcugaaggaccugucuagguuugaugccuccuucuucggaguccaccccaagcaggcacacacgauggacccucagcugcggcugcugcuggaagucaccuaugaagccaucguggacggaggugggucgggcauucgcgacugcugcgccgagggcuccugcugcucacguggaauaggcaguguuuucucuucuugguucugguagaaccaggugcuggcaccaccuacccuccccggcugugccccuggccuggccaacgggcucagggaggugugggccacgggguaggccgcaguuucccaacugcaccccagaggugucgcgggugugcccugaccugagcguaccagucuccucgcuucugaugucuggcuggugcuggggccggggccggggcuggagugacgagaggcaaagcaggagguucuugaggggcccuccaggcccccacccccaccagccaagcagcggacagcaccggcccugcugucucuccccucccacccuccccacuacccuugcccacguccccccaccccaggcauuucaacccucucccgccagccuggcccucgcucugacuggcauuugaccucggacaagcgccacgccguuuuuuuauuuuuauuuuuauuuauuuauuuauuuuuaagacggagucucacucugucaccagguuggagugcaguggcgcgaucucagcucacugcaagcucugccuccuggguucacaccauucuccugccucagucuccugaguggccgggacuacaggcgcccaccaccacgcccggcuaauuuuuguauuuuuaguagagaugggguuucaccauguuugccaggauggucucgaucucuugaccucgugauccauccaucucagcuucccaaagugcugggauuacaggcaugagccaccacgcccagccaugccauuucuuaagauccaggugcucccuccccgggcggagaaggaccuccugagggggaggcugagcccugggcugcccuugggugugagcgguucacacacccacccacccuagggcagagccagcccaccaggggcgaggaggggcccugcuggccgagagguggaagcccuucuccugcgcccuuccugcugccagaccccaccccaagacuaagguuaugcuccccgggggugaccggugucccucucuccuucccgagccuggacacuuggccuuugucuccucgguuccuuaucacggccuguucuggugcaggcugcccuuggcgcuggagaggccacuggccgacgggcucaucagagcugccggugacaccaggggccaaaggcgucgccuggggacaaugcugcccucuguccuuccuggagccacucuggccgugccuggugcccuccccugggcccgccugcccccuccgccucguucccucugugaccugguuccuguuccaggccucaccugggcuggcugcuggccacaggcucuguucuggccccucugcaggacaccucacccuccuuaggccccuuccagggucccacugggauggacccccccucaccccaagccagugaggccaagaugggaccuucgccccagagccgggugggugggugggcuggcugcgcuguggggcccggccguggcaccuugaccacuguuuguggcaggcaucaacccagauucacuccgaggaacacacacuggcgucugggugggcgugagcggcucugagaccucggaggcccugagccgagaccccgagacacucgugggcuacagcauggugggcugccagcgagcgaugauggccaaccggcucuccuucuucuucgacuucagagguggguccugcccagccuccugcggagguggguggccuucagguccccacaugcugagcagaaaccacguggcgugggcucacuccgugcaguguguguccagccugguggcaggaggugugcucaggggucucgugugcucacagccccaccugagccgcagcacccuuccuugcagggcccagcaucgcacuggacacagccugcuccuccagccugauggcccugcagaacgccuaccaggccauccacagcgggcagugcccugccgccaucguggggggcaucaauguccugcugaagcccaacaccuccgugcaguucuugaggcuggggaugcucagccccgagggcaccugcaaggccuucgacacagcgggugagugugcggcugcgcggccagggcaggcgggacaguggcacaggacggccccccgcacaguccccacgcugagcaggauccugccagcuccggggaucccccacccaagcacccaccccacaccccagagcuccuccugguggggugggggccggcguggggcugagccccgggccugaggugcugcucuacccagggaauggguacugccgcucggagggugugguggccguccugcugaccaagaagucccuggcccggcggguguacgccaccauccugaacgccggcaccaauacagauggcuucaaggagcaaggugggcucugccgggguuccggggugcuggggggcaggugggagccggggcuggggcugcagcacugagccgagcccuccgcaggcgugaccuuccccucaggggauauccaggagcagcucauccgcucguuguaccagucggccggaguggccccugagucauuugaauacaucgaagcccacggcacaggcaccaaggugaugccccccccccccgccccacucaccaccccaugagccuaaccuacgcccaugccuggagaggugaccuggccagagccccucaccccccauguuucccacaggugggcgacccccaggagcugaauggcaucacccgagcccugugcgccacccgccaggagccgcugcucaucggcuccaccaaguccaacauggggcacccggagccagccucggggcuggcagcccuggccaagguagguggggcugggcuugggggucccucaggcuccugcucccugggacuggguugcgccauggcugggcacugcugcuuucucuuugccaaguggaggcgggggcuuccccaccaggagccucugucccccgggcuaugcugcaggucugagcagaggcacugaggcugacagcagggagagcucguagccaggcucgcugggccuucccuggaggccugaugcccugcagagcgucugccggacacggagccgagcuggaggagccgcuugggugggaagagcgaggcaggagcaggccuggggggguccacggcaccaucagggucucccgugucgcccacccgucccuacagcuuccugacccacuagcagaggccuggggaccuuuagagagaccaggcacaggagccccaacacccaugaucacucacgcccucugccccccaacuucugcagccucugagaugcaacaucugggccaagggggccuuaguguucaggccacagccaggcuuugguggguccacaucaggcugggaggcagcaaggccggaaggggaggucuuggaccaagcugagggcagggccauggcggcucaguccucggaccccugugccauggcagaauuagguuggggacaggaagugcaucggagagggcccuggaacccuggccccacaugagagucucggggaggugccugcccccagcucaggcagugguagagggaguggggcggcugcccauccaccacguacccccgcaggugcugcugucccuggagcacgggcucugggcccccaaccugcacuuccauagccccaacccugagaucccagcgcuguuggaugggcggcugcaggugguggaccagccccugcccguccguggcggcaacgugggcaucaacuccuuuggcuucgggggcuccaacgugcacaucauccugaggcccaacacgcagccgccccccgcacccgccccacaugccacccugccccgucugcugcgggccagcggacgcaccccugaggccgugcagaagcugcuggagcagggccuccggcacagccaggaccuggcuuuccugagcaugcugaacgacaucgcggcuguccccgccaccgccaugcccuuccguggcuacgcugugcuggguggugagcgcgguggcccagaggugcagcaggugcccgcuggcgagcgcccgcucugguucaucugcucuggugagcccacacucugcccccaagguggucccuucccuggggaaaggcaggcgaacuggagcuggugguccccugaggugcucucugggacggggaugggcacacaguggcacgggauggggcugagccucgugacgugcucucugggacagggaugggcacacaguggcgcgggauggggcugagccucaugcgccuggaccgcuuccgagauuccauccuacgcuccgaugaggcugugaagccauucggccugaaggugucacagcugcugcugagcacagacgagagcaccuuugaugacaucguccauucguuugugagccugacugccauccagguagggcccagccugccagcgugugagcaacgccagccccagggcucuggcuuucccuggagcccaggagcugcaguguugaguccggggccccugacagccccuuugcuaggcagagccuugugcugggggcaggacgggaggggaggaggggucucaguggggcugugugggggccauaggggcuucuuuccuaucaggagaccugggagggucgauggggcgcggggguggagauggccuaguggggccgggggccgcccccaacagcugcaccugcuggagguugcaaccugaguguccuguucccaccccagauaggccucauagaccugcugagcugcauggggcugaggccagauggcaucgucggccacucccugggggagguggccuguggcuacgccgacggcugccugucccaggaggaggccguccucgcugccuacuggaggggacagugcaucaaagaagcccaucucccgccgggcgccauggcagccguggguaggucucccggaggggcccccagcaccuccaagaaaggaggcugccuucucgcugugggguccucaccugcagcccuggccuggcccccguaggauagaguggcccccgcuggcccggggacacccagcucggacacagccgugcgcgaguccccugcagcugccccacuggccccacaccuggcagccuugggccuaggcacguguccaugggcaucaggccugcguggagcccccgugugaugagcacacagcugcagcauagcaagaacccaggggcucuggugaagccaacacacgggucaucaggguucccucagacuggugcccucuguuggcacccaucucugagccccaugggccacaugugggcaggaccuggaaagaaccuuggcugcagaggacugagggggccaccaucuggggacugggcucccaggagcugccccuggaguggcagcucuguaaugacaccuccacccacgggucaaacacagcagggggcgaaccuuucucaugaaggcuccaaggcugccauuaccacacuugucauuacugcccccagcugcaggcagugucuggguggguggguggcugggagcggcucgguguccacgcuaagccucugaggcuggcucugccauaggcuuguccugggaggaguguaaacagcgcugccccccgggcguggugcccgccugccacaacuccaaggacacagucaccaucucgggaccucaggugggugcugcggccugggcgggcuccucuguccccugcgccugccauugcaagucuggcagggacacgcggccacggucuacgccccaccaagcucugacgggccuggggcauggggcagguuuguccucaggucccuugcccauucccucucgguucccuuggggugaggugggugcgcccuaccucuccgagccugaggugggugcccagccaggaugcuuauccaggcucccacgauguccaggccccgguguuugaguucguggagcagcugaggaaggaggguguguuugccaaggaggugcggaccggcgguauggccuuccacuccuacuucauggaggccaucgcacccccacugcugcaggagcucaagaagguggacuaauacggccuggggggugcggggcgggccaggggacccacaacccagcacugaccuggccccucaugcaggugauccgggagccgaagccacguucagcccgcuggcucagcaccucuauccccgaggcccaguggcacagcagccuggcacgcacguccuccgccgaguacaaugucaacaaccuggugagcccugugcuguuccaggaggcccuguggcacgugccugagcacgcgguggugcuggagaucgcgccccacgcccugcugcagguaggcccagccugggggcagcaggcgccgggagccugggaugggcgccucagcugagcaccaagagagcccaccugcccugccgcccccaggcuguccugaagcguggccugaagccgagcugcaccaucaucccccugaugaagaaggaucacagggacaaccuggaguucuuccuggccggcaucggcaggcugcaccucucagggugggucccuucccagcccgggucucgucucccggagucggggacggcguggggugggugagcggggcugcgggccccucacugacccaggccgguggcagcagcccuggaugguccaccgcaggcagugggugggcugaacccagagccccuggaccccggugacgggugugcuacccaugccucccuucuccguagcaucgacgccaaccccaaugccuuguucccaccuguggaguucccagcuccccgaggaacuccccucaucuccccacucaucaagugggaccacagccuggccugggacgugccggccgccgaggacuuccccaacgguucagguucccccucagccgccaucuacaacaucggugagcaggggcccggcgggugggcagacucuucccuccccacagacgcccgcucugugcugaggccugugcccucccgcagacaccagcuccgagucuccugaccacuaccugguggaccacacccucgacggucgcguccucuuccccgccacuggcuaccugagcauaguguggaagacgcuggcccgcgcccugggccugggcgucgagcagcugccugugguguuugaggauguggugcugcaccaggccaccauccugcccaagacuggugagggguaccccaggaccaaggcggggguagcuggggggcgggugcugcccucugaucuccaacucucccgcucugcagggacagugucccuggagguacggcuccuggaggccucccgugccuucgaggugucagagaacggcaaccugguagugagugguaagcagggccgguggcacgggagcugcggaggcugugcccgcuggccaugccgcccguccucaggcccuuccgcaccucccuuuccacagggaagguguaccagugggaugacccugaccccaggcucuucgaccacccggaaagccccacccccaaccccacggagccccucuuccuggcccaggcugaaguuuacaaggagcugcgucugcguggcuacgacuacggcccucauuuccagggcauccuggaggccagccuggaagguggguacugacuacacugcugcccaagccaccggggagggcggucgucauuguggggaccacagagggcacccacagcuaggcaugcagcuugggagggagcagaggggcccggugggcucugggagguggccccagggaccugggaguuccacagcaccaaccaggcccugugugcaggugacucggggaggcugcuguggaaggauaacugggugagcuucauggacaccaugcugcagauguccauccugggcucggccaagcacggccuguaccugcccacccgugucaccgccauccacaucgacccugccacccacaggcagaagcuguacacacugcaggacaaggcccaagguagccccgccccagccccagcccagugcccccacccaaguaugccgcacucacccagccuguccccacaguggcugacgugguggugagcagguggcugagggucacaguggccggaggcguccacaucuccgggcuccacacugagucggccccgcggcggcagcaggagcagcaggugcccauccuggagaaguuuugcuucacuccccacacggaggaggggugccugucugagcgcgcugcccugcaggaggagcugcaacugugcaagggugaggucccagcccugcuggcuucggacaccucuggcgaugaggagcgaucgccuccccucacguugaccccagacuugcuucuccacggggcccccuuuggggucagcaacccuagcccaacccuccggccggagcucacgauggcggccucccucccucccccagcccccagccuuccucgucccuggucacuguuccucagucuugaaaggguacuugggggcaaagaugacagauucagccuaaggucacaccuuggcuaggcacagaguagccccugcagcugaaugcggccccucacugcguccacagugggcaggagucagccucccaguggugggcagccccuuccucaacccucagcuauuucucauccugugggcagagcggggugguggccccagaaggacagagugggucugagagcccaugccaggcagaugcccuggggcuuugggaacaccaggccugccucccucccuccccagggcuggugcaggcacugcagaccaaggugacccagcaggggcugaagaugguggugcccggacuggauggggcccagaucccccgggaccccucacagcaggaacugccccggcuguugucggcugccugcaggcuucagcucaacgggaaccugcagcuggagcuggcgcaggugcuggcccaggagaggcccaagcugccagaggacccucugcucagcggccuccuggacuccccggcacucaaggccugccuggacacugccguggagaacaugcccagccugaagaugaaggugguggaggugggugccuccugggcagccaggccucugccccggacaugguaggacccacccugacaucaguugcaggagacagcacagacacggggcgggcccugggcgguggguggggccggccaguucccugugugguucugugcacguguccugugcgguccacacagccaccguggaggguccgcccgugggcuccaagaggugcagccuaggcaggaccccagggacaagaccaguggcauccaugcgugcccauggcuggcaccgucaucagguugacggggaagccuuucugccagacugaggccucauggacauuuugcccagccccaggucaggggcaccugccugguguggggcugauuccagaauucacccccuacaggugcuggcuggccacggucaccuguauucccgcaucccaggccugcucagcccccauccccugcugcagcugagcuacacggccaccgaccgccacccccaggcccuggaggcugcccaggccgagcugcagcagcacgacguugcccagggccagugggaucccgcagacccugcccccagcgcccugggcagcgccgaccuccuggugugcaacugugcuguggcugcccucggggacccggccucagcucucagcaacaugguggcugcccugagagaagggggcuuucugcuccugcacacacugcuccgggggcacccccucggggacaucguggccuuccucaccuccacugagccgcaguauggccagggcauccugagccaggugcggccgccgggcagggggacagggugggggccgggugagggccaggcgggcagggugcugaccaccgcccccacaggacgcgugggagagccucuucuccagggugucgcugcgccuggugggccugaagaaguccuucuacggcuccacgcucuuccugugccgccggcccaccccgcaggacagccccaucuuccugccgguggacgauaccagcuuccgcuggguggagucucugaaggucaggcccugccccaccuccaggccccaccccaccucccaacuugccgaguguggccugacccuccccgacccgcuguagggcauccuggcugacgaagacucuucccggccuguguggcugaaggccaucaacugugccaccucgggcguggugggcuuggugaacugucuccgccgagagcccggcgggaaccgccuccgguaggagcacggccccucaccacuuccccuuccccaccagccuccccauccccagccugagcuccccgccucugcccccaggugugugcugcucuccaaccucagcagcaccucccacgucccggagguggacccgggcuccgcagaacugcagaagguguugcagggagaccuggugaugaacgucuaccgcgacggggccuggggggcuuuccgccacuuccugcuggaggagggugagcccccgacacugcccugccccucccgggagacugcacccgaaggccccgcagcagccccaccucccuguuucccuagacaagccugaggagccgacggcacaugccuuugugagcacccucacccggggggaccuguccuccauccgcugggucugcuccucgcugcgccaugcccagcccaccugcccuggcgcccagcucugcacggucuacuacgccucccucaacuuccgcgacaucaugcuggccacuggcaagcuguccccugaugccaucccagguauggguggcauggggccgugggaguggacugggccggggagcagagaccccagcagcuaggaccugccugggagccccucgggagggaagggcaggcggugaggggcucagugccgucucccccagggaaguggaccucccaggacagccugcuagguauggaguucucgggccgagacgccagcggcaagcgugugaugggacuggugccugccaagggccuggccaccucuguccugcugucaccggacuuccucugggaugugccuuccaacuggugagugugucgagggugugagccugggccccacguggauggcggccaggccugugcugacccaccugcugcauccccaggacgcuggaggaggcggccucggugccugucgucuacagcacggccuacuacgcgcugguggugcgugggcgggugcgccccggggagacgcugcucauccacucgggcucgggcggcgugggccaggccgccaucgccaucgcccucagucugggcugccgcgucuucaccaccguggguaaggccccgcccccggugccucccgcugcccuccuggccccgccgcccuggcucaccagccgcgcuuccucucuucaccagggucggcugagaagcgggcguaccuccaggccagguucccccagcucgacagcaccagcuucgccaacucccgggacacauccuucgagcagcaugugcuguggcacacgggcgggaagggugaguggcccccacagcccccaccugccuccugccuagccuccggcccagggagaagcagggucuggcccucuggacugugguggcugggcuugcagugggugugauugucuggccccucuggcccccuaggcguugaccuggucuugaacuccuuggcggaagagaagcugcaggccagcgugaggugcuuggcuacgcacggucgcuuccuggaaauuggcaaauucgaccuuucucagaaccacccgcucggugaggccggcagcgccugggcgggggugggcauggauggguguggguggaccuguggaaggcccugggugagcacggccccugcccgcaggcauggcuaucuuccugaagaacgugacauuccacgggguccuacuggaugcguucuucaacgagagcagugcugacuggcgggaggugugggcgcuugugcaggccggcauccgggauggggugguacggccccucaagugcacgguguuccauggggcccagguggaggacgccuuccgcuacauggcccaagggaagcacauuggcaaagucgucgugcaggugaggggaggagucccggcgccucgggcaccccaggcucugguccccaggcagugccugagccggugggugcugcuuggacgcaggugcuugcggaggagccggaggcagugcugaagggggccaaacccaagcugaugucggccaucuccaagaccuucugcccggcccacaagagcuacaucaucgcugguggucuggguggcuucggccuggaguuggcgcaguggcugauacagcguggggugcagaagcucguguugacuucucgcuccgggauccggacaggugagucggcaggggugcuuguggaccagccugggccaggcacagccccgggccccugagcccuucucugcagcccaccauugugggcugucacggugccuggggucugucccccuccaucuuguggggggcuugcuggauggggcucugcggcugcuccccacuuccccagcccggcguguagggaagagaccguacccuggcccaguccagcccacaguccugugucccgcaggcuaccaggccaagcagguccgccgguggaggcgccagggcguacaggugcagguguccaccagcaacaucagcucacuggagggggcccggggccucauugccgaggcggcgcagcuugggcccgugggcggcgucuucaaccuggccguggugagggaaggccccaaauggggcccucaaaagccccaagaccaagggggggacccuggguggacgggugaggcccuggagcugcagggagugcugaggaugccucccccaggucuugagagauggcuugcuggagaaccagaccccagaguucuuccaggacgucugcaagcccaaguacagcggcacccugaaccuggacagguggguaccgcacagcccugcucccgccucugccgggcucugggcucagggccgugggagccaaggugguuuguugacagcccucucuggcguuuccuggggaugggacguugggggcuccuggggaugcuggccaauggggagugacacgcgugcccacagggugacccgagaggcgugcccugagcuggacuacuuuguggucuucuccucugugagcugcgggcguggcaaugcgggacagagcaacuacggcuuugccaauuccgccauggagcguaucugugagaaacgccggcacgaaggccucccaggugggccccacccucuccccucgacccugcccacccugcccucucccaguggccacuccccacccccaccuucuccccgcagcccugcccaccccacccucucccaguggccacuccccaccccgaccuccccgcagcucugcccaccugcccccucccccacaggccuggccgugcaguggggcgccaucggcgacgugggcauuuugguggagacgaugagcaccaacgacacgaucgucaguggcacgcugccccagcgcauggcguccugccuggaggugcuggaccucuuccugaaccagccccacaugguccugagcagcuuugugcuggcugagaaggcugcggccuauagggacagggacagccagcgggaccugguggaggccguggcacacauccugggugagcacucccaguaggagccgcgccagguguuuccccugcuggcaucagggucuugggacauagcagucgugccccugugcgccucaguuuccccaucugcagagccagggugcgggcgcaggugucacuguggugguggugcuuugggagaugcacagcccacgcaccccugggugucagcccugccgcauacaggccguccccaugcccccucuggaguugccgacccggcgcaucccuuccaggcauccgcgacuuggcugcugucaaccuggacagcucacuggcggaccugggccuggacucgcucaugagcguggaggugcgccagacgcuggagcgugagcucaaccuggugcuguccgugcgcgaggugcggcaacucacgcuccggaaacugcaggagcuguccucaaaggcggaugaggccagcggugcguguggguggccaggcgggagugggguccccgggccuccccagcccuuccuccuuguugucuggaccgugucccggcaggcauaccgcccuucgucacgggugccauucugagcguucccaccccgacucccaccugacguagcaccguggggaccugcgugcgugucuguguguccuugcgugggugccagggcucugcacccagaccagccuggcaucugccccugucuucacagagcuggcaugccccacgcccaaggaggauggucuggcccagcagcagacucagcugaaccugcgcucccugcuggugaacccggagggccccacccugaugcggcucaacuccgugcagagcucggagcggccccuguuccuggugcacccaaucgagggcuccaccaccguguuccacagccuggccucccggcucagcauccccaccuauggccugcagugcacccgagguacucccgggcccuccucuggaagcgguggucagugcuggccaucacggggcccguggcugccgccugcacaugcugagugcccggcacugccauugcagcugcgccccuugacagcauccacagccuggcugccuacuacaucgacugcaucaggcaggugcagcccgagggccccuaccgcguggccggcuacuccuacggggccugcguggccuuugaaaugugcucccagcugcaggcccagcagagcccagcccccacccacaacagccucuuccuguucgacggcucgcccaccuacguacuggccuacacccaggugagagccaggcugguccuagaggccuacggcaaacgucugggcuccccaccugugcccuggcuuugggggaccgucgcuuaggaggccccgccccuuccaucugcucagcagucccuccuuccucucagagcuaccgggcaaagcugaccccaggcugugaggcugaggcugagacggaggccauaugcuucuucgugcagcaguucacggacauggagcacaacaggguggguccuggacaccccugaggccgcaggacccagaguacugggcaggaacggaagggggaagggaaggaugggaugggacgcgaagagcguuaaaggccccccaacuucaccccuuuaauagccgaucccggccggaugcgguugcucaugccuguaaucccggcacuuugggaggcuaaggcgggcagauuaccugaggucgggaguucgagaccagccugaccaacguggagaaaccccuucucuacuaaaaauacaaaaauuagccaggcaugguggcacucaccuauagucccaccuacucgggaggagaaucgcuugaaccggguagguggagguugcggagggaggagaaucgcuugaaccggguagguggagguugcggugagcugagaucgccccacuccaucuagccuggguaacaaaaaugaaacucgucucaaaaaaaaaaagcccacccgcaguguagcacagggcaggccggugcugugggugcugccagcaccugcucagagcccgaccccacaggugcuggaggcgcugcugccgcugaagggccuagaggagcguguggcagccgccguggaccugaucaucaagagccaccagggccuggaccgccaggagcugagcuuugcggcccgguccuucuacuacaagcugcgugccgcugagcaguacacacccaaggccaaguaccauggcaacgugaugcuacugcgcgccaagacggguggcgccuacggcgaggaccugggcgcggacuacaaccucucccaggugcgcaaggggccugacgggaacggggacagggacaggaguggggugggacggcagcugaucgcauccccugcagguaugcgacgggaaaguauccguccacgucaucgagggugaccaccgcacgcugcuggagggcagcggccuggaguccaucaucagcaucauccacagcucccuggcugagccacgcgugagcgugcgggagggcuaggcccgugcccccgccugccaccggaggucacuccaccauccccaccccaccccaccccacccccgccaugcaacgggauugaaggguccugccggugggacccuguccggcccagugccacugccccccgaggcugcuagauguagguguuaggcaugucccacccacccgccgccucccacggcaccucggggacaccagagcugccgacuuggagacuccuggucugugaagagccgguggugcccgugcccgcaggaacugggcugggccucgugcgcccguggggucugcgcuuggucuuucugugcuuggauuugcauauuuauugcauugcugguagagacccccaggccuguccacccugccaagacuccucaggcagcgugugggucccgcacucugcccccauuuccccgauguccccugcgggcgcgggcagccacccaagccugcuggcugcggcccccucucggccaggcauuggcucagcccgcugaguggggggucgugggccaguccccgaggagcugggccccugcacaggcacacagggcccggccacacccagcggccccccgcacagccacccguggggugcugcccuuaugcccggcgccgggcaccaacuccauguuugguguuugucuguguuuguuuuucaagaaaugauucaaauugcugcuuggauuuugaaauuuacuguaacugucaguguacacgucuggaccccguuucauuuuuacaccaauuugguaaaaaugcugcucucagccucccacaauuaaaccgcaugugaucuccaccaccguccuuucuucccuccucccugaccuggcagcugcaagcucu

SEQ ID NO: 21285 - RNA, 2252 nt, Homo sapiens
gcuguugucuuguaugcucagcgaggcccggagagacccgggagagagcuaggccgaguccaccgcccgagucugcugcccgagcccgcguuacgcacaaagccgccgauccccggccuggggugagcagagcgaccaccgcccgggagcagcgcggcgagacgcacggugcgcccuaugcccccgcgcccccaccgcccccgccgcggcagccgaagcgcagcgagagaacgcgccaccgcggggcccgggugcagcuagcgacccucucgccaccugcgcgcagcccgaggugagcagugagcggcgagcgggagggcagcgaggcguucgcgggcccccuccugcugcccgggcccggcccgcucauggcggccauccgcaagaagcuggugguggugggcgacggcgcguguggcaagacgugccugcugaucguguucaguaaggacgaguuccccgagguguacgugcccaccgucuucgagaacuauguggccgacauugagguggacggcaagcagguggagcuggcgcugugggacacggcgggccaggaggacuacgaccgccugcggccgcucuccuacccggacaccgacgucauucucaugugcuucucgguggacagcccggacucgcuggagaacauccccgagaaguggguccccgaggugaagcacuucugucccaaugugcccaucauccugguggccaacaaaaaagaccugcgcagcgacgagcauguccgcacagagcuggcccgcaugaagcaggaacccgugcgcacggaugacggccgcgccauggccgugcgcauccaagccuacgacuaccucgagugcucugccaagaccaaggaaggcgugcgcgaggucuucgagacggccacgcgcgccgcgcugcagaagcgcuacggcucccagaacggcugcaucaacugcugcaaggugcuaugagggccgcgcccgucgcgccugccccugccggcacggcucccccuccuggaccagucccccgcgagcccggagaaggggagacccgugucccacaaggaccccaccggccugccuggcaucugucugcugacgccucuggcuugcgccaggacuuggcgugggcaccgggcgcccccaucccagugucugugugcguccagcuguguugcacaggccugggcuccccacugagugccaaggguccccugagcaugcuuuucugaagagccgggccucagaguguguggcugugugucuguucgacuccccucgccccauuuucaccccacccccgccucugauccccgggggcgagauuggcgcgggaguguggccgcgccccaucagauguucgcccuucaccagcgggagcuugauaucccuugucuguaacauagaccccggguacugcgggaggggagggcugcuggggaggauggggggauguuauauaaauauagauauaauuuuauuuucggagcuaagaugguguuauuuaaggguggugaugggugagcgcucuggcccaggcugggccagacucccgcccaagcaugaacaggacuugaccaucuuuccaaccccuggggaagacauuugcaacugacuuggggaggacacagcuucagcacagccucuccugcgggccagcccgcugcgaacccuccaccagcuaccggagggaggagggaggaugcgcugugggguuguuuuugccauaagcgaacuuugugccuguccuagaagugaaaauuguucaguccaagaaacugauguuauuugauuuauuuaaaggcuaaaauuuguuuuuuuauucuuugcacaauuguuucauuguuugacacuuaaugcacucgucauuugcauacgacaguagcauucugaccacacuuguacgcuguaaccucaucuacuucugauguuuuuaaaaaaugacuuuuaacaaggagagggaaaagaaacccacuaaauuuugcuuuguuuccuugaagaauguggcaacacuguuuugugauuuuauuugugcaggucaugcacacaguuuugauaaagggcaguaacaaguauuggggccuauuuuuuuuuuuuccacaaggcauucucuaaagcuaugugaaauuuucucugcaccucuguacagagaauacaccugccccuguauauccuuuuuuccccuccccucccucccagugguacuucuacuaaauuguugucuuguuuuuuauuuuuuaaauaaacugacaaaugacaaaa

SEQ ID NO: 21286 - RNA, 6460 nt, Homo sapiens
guugcaucauuuaauuuuaagcuauuuauuuucauaaacaugagguauuucaaagugcuauaagaugcagcacuaaauauauacauuuugaagaaauuaaacacagaacuuugcauuuacccaguucuaugcaccaaacaugaacaaauacauuaacaggaagaaacaggcuaggaaaaaggcauauauauauaguaaauuucuuuacaaaaguuucuuaguucaaaaagugauaaaguaauaucuacucaaaacuuucacaacucauuuucauacgaaaauauaaguaucaaauuuaguuauguaucagcgucauacuaaaguauacaggcaguguaagaauuaguacaguacauaacagagauuaacaauauauuuguauacaaaacaugcuccucaaacauugagguauuauuacaguacuuagguaugaacuuccagucuaauacuggccgcaaaagccaccucucauuacccaggauguauacaaaaggcggaugugucaaugguauuuacagaaauguuccccagggguaucaaauggcaaaccccuuauguggcaucugcuggaacuuaagcaccauuuuaaaaagaaggaaugacuuucuguuguuuggaaacuuggaacacacaaggugacuucaacagccccagaggcucccaaccgucaccaacguuuagcgcugucauggaggugagguggaggaggcugcagggccacccagcauccugggaugcaggcucuccaaggucccagcagaaccccacacuggugguccuacugcccacccagagccgaacucgacaggggaccgauuugaaaguaaaccaacauucuuaaugucaacacaauguuuguuuaaaaaaaaaaucaaaaugugcaaaguggcagugacuguccaguuuugagaagcgucuagcaaguccgagcguguucaauuuucuuuagcaacugcugcugucuugccugcaauuuuuccuuuuccagcaaaagcuggugcuccucggccuggagggaguggacauacucaguggccuuuuucaaaaugaccaccuuggcggccuucucauucuuuaccaacuccggcacguggucccugagcgugagaaagcuggaccgaaggucguugcggcgcuggcgcuccaggauguugugguuucugcgacgcucacuguccuccgagucagaguuucgggggcucaagcucuuagccuuuggggggaugacacucuugagcggacguggggacgccucgcucuuuaucuucuucugugggggugcauccucacucuccacguagggagagggggcggcauaguugugcugcugguggaugggaaggcaucguuugaggaucagcucgcuggacugagcccucccgggacccagggcugcguucuugggacgcacagugauggugaauguggugacagccuugguguuggaggaggaacgccgcuucuccacagugaccacgucgauuucuuccucuucaucuuccucuucaucaucuucaucaucugagagaaagaugcuaguuacucucaugugagaaccauuugaaugaaauucacauauauauccauguuaauauguaugcuuaucugucucuuccggcagacccuggcagacugcuauuuuuauggguccaucaacauagauguggacaguuuuguauuuguuuuagaucucuuuaaauuaaauauaucuguaggccggacgcggugacucacaccuguaaucccagcacuuugggaagcggaggcgggcagaucaccugagaugaggaguucaagaucagccuggccaacauggugaaacccugucucuacuaaaaauacaaaacuuugcugggugugguggcaugcuccgguaaucccagcuacucgggaggcugaggcaggagaaugacuugaacccgggaggcggagguugcagugagcccagaucauaccacugcacuccagccugggcaacaagagcaaaacuccuuaucaaaaacaaaaacaaaacaaccccccauacauacauacauacauauacauauauguauguauauauauuuuucuuccccauaccccaacugugcuuucagccuccauucaagacuuuagcaggugguagaaauaaauauaaagaacuuggccuuuagggucagacagaauccuggcuccaccgcagacuaguugcaugacccuggucaaguuacccagccuuucuaagccucuguuuccucagcuauuaaauggggaugauaccacuuugacagauaacauguagacuuagcauagagcugagccuaguagacagaugcucaguaaaugguagcuuuuaucauaaucaccagucugcccuguggacuuauuuacauuucuagcuccacacuuaaagaguugaggccucucauuuuaggagccucauuuagcaguuuacacaugguuguguuugauuuuaaguccuuaaacaaacuugaggaacaauuuaauuaacugaagaaaaaaaacaacuuuucguccacaaaccugaguuuuauacaauaaacaguuuuucauuuaacaaagaucaaaucuuaaugacaaagccauaauccacaguugguauaaacccccaaaugggagcagcucuccucaaagccaccaauaauaacagcaacaacagaaacguguagcaucaugugcgcauucuuccccucucuccucauugacuaccacgcugggguagaaaauuauuguuuaaaauacaagcaugaaaaucaaaacauaucuucugcuugaucugaaggggaccggaaagcugaacaauugugggauuuguucuaaagccgaaaugugaggcuguuccagucugugggucccuuuaagccaauguuuugguuuucugccaagaagacagcuguuggaaggaagugcuuccucaccaaaagcugucaaggcacagacauuaaagggacagagccguuucaaacuggaggcuuaucaccaaguuuccuuccaggagccucaaagaucucuccucagcccagaaguaaauuuaggcuuguuauccaccugcauucugaaaacacugguuuucaaaguccaaggggggucccagcucccugcuccaaggacaaggcaaugccacucuuuggguugaguucuguucauccagacccccagggaaaggcuugguuuuaacucuucccuucagcuuaagacacagacaaaugaacacaauagaacuaaucagugaguccucccaggaugugagccuuccuggagaggcugcugagugccugcccucaccuucaagggcacuggguuacagauacaacucacaucucaaauuaggccuggaauucaggcuggaagacaaaacuacagccaguuuccacugcacacuggaaagaggaggcccccugagaauguacacaacugcuguugcacuugcagccagcugcugaauggagggagggagggugcccccaccacccccagccuuucagaucccgggcccgccugcuggccucgcauaucgccgccugcuggccacgcaccaggagcaaauagcccaccacccaccgaggaugggggaagggaaagguaccgacauuugaaaaaaaaaaaaaaagaaaaagaaaaagaauagaaaaucggcucuagccaucugugcaacccuccuauaaguuccugcgccuuaaacagggcuuugcacagcccuugaaucuucucgggaugucuuucccuccccugaccugggccagagagucccuuucaccccugcgcuaacagguuucuguccaggcagugcacccagcaacccccuaaacccccacccgguuuagccaccaacuuucuccaauuuuauuccucagacugcgcugcaaaagagaggugggggaccgggugagggcccgugauggccuagaggagggcuccccaggagaggguggaaggaacuuuagugaaggcgagaauuggagagcaccccuuuugcaacggcauucucucagccccuucucuuuaccccgaggagagacuugggggaaacaggaccucucugccccuagcacugccuccaaaaugcuccccaggccaagacauacgagcacuaacaaaggggacgcgacccgggguccagugccccagggaggcagccggacccgaguucggucuuuaccugaaucgcucaggguguccucuccggagguacugagggccuuguggucgccgccgcuggucuggcggccgccugggcgcggaggggcgacccccggggccccggcuggggcggcaauacccgcccccgaggcgaccgcagggcccgccgccggggcacuggccggggcugcgggcacgggcgcuggcucgcgcuuguucacgggaaaggggaagaccacggcgggauccacgcacucggcggccgggugggcgagcucggcgggcagggcggccccggcgcggccggcucccgcagccccgccgugcccgcgacccgcagggcuggcggcgccggcucccggggacugggcgguggaaccggcgguuggcggcccgcggccgugcugcagcuucucgcucacggcgcgcuccagcuucucgcgggcggagaagccgcuccacaugcaguccuggaggaugaccggguugggggugaggccacccaguccccccaggccgaacgcguccuccucggccgggcugccccacagcucguucucaagcagcaucuccgugacccagcucgggggcucggagcugugcuccgcgaagccacggcugggcgacagcgggggcgugggcagcagcucaaacuucuuccagauguccucccccgggggggucgagucggggccgccgaaguagaagucaucuucguccggguagaagcagggcuguagcgagucaaacucgaggucuggguucuugcagaucaugcccggcaugguggacguggagcagcucggcaucggcucgccucccggccggcgacugagggcuucuuuccgccccguucguuuuaauaccgggggugcuuccuucccguggggggcgcggaaggcgggggccggcgccgaccuccaacacugcaaccgacagacacaccggagagggugggcaaacggggcagaccgaggggauaggcaaugggcgcccccucuaaccagguuccccaaucuucccuccaagccccccacucugcccacugcucccgaagguggaggaaguugugccucucgcucccucccucccgcccuccuuuuguguacaagcugucuacgacagggggugggagggggcaugcagaugcagggggugguggcgaggcuccgcaacuuuggaaacugccauuucauucacacaaggcacugccugggggagggggcuguuccuggcugcagaauucuagcucucacgagcacgcagacaaccgcacucgcagcgguguggggccggcugcucaggggaagccccaggcucuccgacccagcuaccgggaaugguauuuggaguaccuucuacccccuuuguaaaaaugcaaccucaggagugcaaaugauagcaggggauuuagaaaacuuugcaaauaaaaaaaagccuuucucuagacagagaccaacaacagacacccauauccacaaauccuuccccuccccaaauuugagcaaacgccccucggcauucacccgcugcagggauacuccugccaauagcuuaauuggaagcucucuaagcccaccccugcucuuccaaacccacgacaacguccucuuccagggagggagaggcugagccccuguucccgggaauggcaggggcgcccgcgcgaggagggucgccgggagagccgccucuccuccaagcuggagcagccgugacccagauugcgaccgcggcggccucgcccugccuaaucccccccucuucuuccuccaggggcacccuuuggagaagaaccccagccugggguggggacgcaccggcucuccgacagcucaaacacagacagaucuucuagagccgagggaauuucuuuucgcagaagccauuacuccccccgguaagggcugcaaaaggauuagggcgggucuccucuagccaggaugccuucggggcuggaacuggcuuuucugggaaaacccagagaugguuuuguuucggaagcagaaacagucccccgggcauauuagggcgcccggugcgcacgucgcaaucccguccagggcuugccuugccccggcgcucgucgcuucccugggcgccgggcgguuugcaagcccugcuccuuaccucccgccgacugcaggggauccggaggcgauucugcgcgggugucuccgggugggccgggggggcggggguguccucggauggcuacagucugugcgcgcuugcgccuggcuagcgcuugcucggcuccaacacaguucccaggagccccccgcauccacccagcgcguccagacagaugacugucaca

SEQ ID NO: 21287 - RNA, 25726 nt, Homo sapiens
cacguaaguaacuauuaauaccgccucgccgggggaugcgggcgugcugagcgcggggauuggccucgggcaccgucggccguccccuuuaauuuuuaaauacacgguccccucuuuucucuggggggggcaagcaagaaaucaaagaaggaggagacaagccgucaauuuucuccaaaacaaaccccaccgggcaauuuggucucgggguagggggagacggggugauugcaaauuauuccaggacgagauccaguucuccagcgggaaaggggcaaaggaacgccgcgcguuggaagggccagggacgcagcuccccuugcagcgcccgcaggacccccgcaagcucgugccggcgaaaucggagaccgccgaucuguccucguucucuccugcacgucuggcugcauucggaggaagaccuggggcgcgagcgagcggcgacagcaugagccugugcugaccuccgcgcggcgggccgagcccagggcuuugucgcgguaccugcgcccagcccgcgccgcaacucugugcccagcuuuugcaaucuuuuguuggcagcgcugaccgcaccaaguuaaaugcucccuugcaauuuuucuuuuuuuuguuuguuuguuuaauuuuuggagagcucgcgaucuuggaaaagccucagacgccaucuacaguuaaaacguagguaacugcccucucccgcaccccccccuuacacgccccccacccuuuccaccaaaaaaagggggugcagcgcggauucuggcugccgugcgucgccagccgguagacccgugcuuguuuccuuucucuuuuuguuuggcuucuaacgcguugggacugagucgccgccgugagcuccccgaagacugcacaaacuaccgcgggcuccuccgccccgucugcgauucggaagccggccugggggucgcgucgggagcccuggcgcugcagcuccgcaccuuagcagcccggguacucauccagauccacgccggggacacacacacagaguaacuaaaagugcggcgauucugcacaucgccgacugcuuugggguaacaaaaagacccgaguugccugccgaccgaggacccccgggagccgggcucggagcagacgagguauccggcggcgcccauuugggggcuucuaacucuuucuccacgcagccccucuucuguccccuccccucucgcucccuuuuaaaaucaguggcaccgaggcgccugcagccgcacucgccagcgacucaucucuccagcggguuuuuuuuuguuugucgugugcgauccucacacucaugaacauacacaggucuacccccaucacaauagcgagauaugggagaucgcggaacaaaacccaggauuucgaagaguugucgucuauaagguccgcggagcccagccagaguuucagcccgaaccucggcuccccgagcccgcccgagacuccgaacuugucgcauugcguuucuuguaucgggaaauacuuauuguuggaaccucuggagggagaccacguuuuucgugccgugcaucugcacagcggagaggagcuggugugcaagguaaagggccaguggguugcuuuuugucuuuggaaggggcccgagggagcgggagggcgccaggcccucgagucugggagagggagauucgcgggauaauuaccguggccuuauuaaauggguuuauuuauuuauuugcucagguucgguaaguugcgaaguuuuuagaccguuucagacaauggggcgggcggcagugggggcguuucggggagagcccggggaggagagggcggcgggacugcgcgggggccacggacacgcgugcaccgaaggcuccaggagcucucugcgcgaggccgggucccgcugcccgggggggauuucuuccugugucuagcccccuccccuuccaacaaggauuagggaaucccccgguaauuuuaagacugaugacuucguucuuuucgcagccauuguucuuagcagcgggcagguguuaaaccuuuguuccgaaggugcccuuuaaaacagacacacaaaggugcccccuucggcugagcccaggggcccagcgcagggaaggaguuuacaaagaccuuucuucugccuggagccuugaaaggaggguugggguggaaaucaaagccugagcacuuucuggugaauagugaaugcuuugggucuuucucucuggucuuggucucucuccccaucucuagacuucccugucugcucauccccucucuuccgugccccccugaacaacaccuuugccuguaagguuaagaggcucccguuuggagcccuagggauccgcagugguaauaccacugcgauggacacuucgguuuccuuuuuugucuuuaacccugaacagugacugguuuauguauaugugugucuguguaucuuugugugcacccaccgggccccagacaaguggaugaggggcgaaauaguugcgaaaaagaaaauaacuauaauagagcauacuacuacccagaauuggaccuagaucaaggauucuuugucacuuaauuuuagauuugcugacuguuuuuuuuuuuuuuugaggggguaaggggagagugggggacccauucugccuuugaaauggucacugggcacgguugugcugcaaauaacacaucgcgcuuuugccauucaccacagacuacuuugcggacuugccuuauuuccuaguggacuggaguauuucauugcaaaauuuggguuuaguggagaucuccagucaguuuugcgauuguucaguucagcccuuagggggaaaucggagacucuuuaaauguugcccuuugcuuguacugagcauuugguauuuugcaucuucucuaaguuauugagacccagagcaacugugcccaguuaaccaaaauucaguagcuggauugaauucucagaagucugcaagguugcacaauaggauagucauccuuugaaaugaaugaauuccacagaacugccacucuuguaugaaauaugcacaaucacccagcagugaauauuuucauuccuuuugcucaacuucaguacagcauuuuaauauuuuucaaaggcuggagaugcuuuuaaguauagggacucugcagccaaauucugcaggggcaucuggcuguuacuucuuuguuuaaaaucagaggugacucuggccucugcucauucuuucuccagauuuugcaagacauauuucacuuugggcugaccuuacagugucauuugcagacuugugcucuggccucaaauuggacuuaaucugcugguuuaguuauugcaaagauugaaucagccccucaccaauuacaguguggcugcaaguggauuuaagugcaguaucauuguucugcuugacagaggucaucccuuuaagacacagcagcuucuguuuuccugacuuuuuaccauagaugaugugggugacuucuuaugcaagcauaguuguguaucuccgaagaagcuccaagagaguuuuauaaggcugcuucucugaacugcccugagagauauauaugcuguggucucuuagcuuacuuuaaggcucagugaaaucuacacauugaaucuaguuccuuuugaugucuuagaauagaaggcucauguuuccuagcuguguguugaccaaugaaaaaauucuuugcaaaaacagaucaaauguaaagaugcuauuuauuauaggggacugcguagagaauuccauaggacacuauuuggaggaauagagauuccagagucauuuaaacaaaauaaucaaggcugcuuauugucuccauguaccuacuuuugcuagaugaaugaaggcacuuuaaggagucuuuaacuguauguuuucauggagauacugguagcuacugugcagauugacauaauuacuaucuuggcagaauggguacuuuuuuuuugcaaauguuauuaaugauggccuaaucuuacugccuuaucugaacugucacauuacauaaccaaggcuccaaauuaaacauguaaagaagcuggcaccaggcuuguggcuugauuuugcacgugaagaugaugguuuaaauaccaguccaagccccuaaaugccccugauagcuacuaauaaaaguuuggcuccuucucgugugggaaaacauaaguacuuauuuuauuuuucauacucuguccaccaucuuggaauuuggucucuucuacaaaagguauggcuacauuugaagcugccacaaauauguuaguuuuuuaaaaauucugucuccaguuuuucagcaguggagcaggauaauaggcuaaaagugcugagcaaaagucaccuuuuauguuuuuguaaaugcaccuggaaacaggaaguagauuauaaauaaucauaacucugugagcacuggcgacagaagcugcaaccugguauuucagaacacagcaucuucauuauaugaugcaguguuuacguuagccacugcaaagcuuauuacuccucgaaauuuuugaggcuucccuggguuucuguugccugcauucaggguguuaaaguugauucaagcauuucagauuccuaauugaacaggccucuuaggucacugcucuugggucaucauuugacaguaucagugugugauuuguggucucuggagauguugaaguauucuuucuuaaauucuagguuauaguggcagcagcugugccgcuuuucugagaugccucguuaugguucauucacaacauuacuguuaacuuugcuuccuuggccguguuagcagcaacucuugagguuuuacaucccuguuugacucacagauuuuguuucaauuuuuugaagcuuagagcaacuuaacucauggauucuuaaauagcagucuguggcuuuggaugggcuucagaaagcccgugaauccccuuaaaaugaauccgguaucgugcaugcauuugagaacgggcauugucagcuaagagggaacagagcuuuuaucagauuuuaugugacaucaggacccaaaaaagguuaacacuguucuaaaucaacaucuucauuuuaugaagaggagggagguccaguaacccuaagcucuuuauccaucucauccagauuauugguggcagggccaggauuagugccucaagguugccgacuuccaguccagcauauuuccuaccacacugcaaaaugaugaugaaagaaaguaugucuaacuagugaaaaagcgauuuaggcagcuaaaucauugugaacugauagcaugcaguguauuguuagggcguuccugccucagaugcuuuccagcgaagcucacccacgcaugccccuggcucacgcacacacugaauagauucaucuuacccacaucccaggcagauagaaaaaccacauuccagacccagggacuuguauuccugauuuaguggaggucuugaaaugaaugaaagcgccuuuuauauaaccucaaaaauucucuguaguguuaauugcuguuaggucuguuucaaaagguauugauggugccuuuucuuuuuaagcaaccgcacaaugaguuggcauuuugcaggcuaauuuugauucauagaaaaucauugcauaacugguucauugaguuagauaucuguggagggaagagaggaagaagcaaggcugcuucccuauucagaaggauucuaucauauuccuaccucugccacugggggcuugaguuuuggcucauucucugagccucaguuuccauaucuguaaaaugaaaguauugaauuagagaccacugggcaaaagcuagcuguuuauucucuuaguugcucauguguuguauaaugccuguuuaugugcauuucuuuuuuuuuauuuuugaaggcaaauaaaguguuguugaugucauugagguggaucacuuucucuccaauuuugccuuaguucuauaaacacgcaauugggcuagagacaaaaguaaugaaaauuauuauuucuguacugcauuacguuuugcaaagcacuaucaccuucauuuucucauauaauccuccuaacacugugagucaaguaucaguuucccauguuguacguaaagauuuggaggcuccgagagguuaagugacuuguuuagugccacacagcugguaggaggcagggccaauguggucuggguccaaguucagcauauuuucugucaucucaaaagcccauaccugugggaggugcagcauuauguguuuugguuguacaagaggcaccucugacuuuggucuuacuguuaauccugucguagguguuugauaucagcugcuaccaggaaucccuggcaccgugcuuuugccugucugcucauaguaacaucaaccaaaucacugaaauuauccugggugagaccaaagccuauguguucuuugagcgaagcuauggggacaugcauuccuucguccgcaccugcaagaagcugagagaggaggaggcagccagacuguucuaccagauugccucggcaguggcccacugccaugacggggggcuggugcugcgggaccucaagcugcggaaauucaucuuuaaggacgaagagagguaggucucauccuguccagaccuggguacugugauggacugcuccuaacaacagcuuccuagaaaagucuugaauggacguuuuuuugccgucugugguccagaugaggggaaggaaucuuaggagggcaaaaggaagugaauauugcaauuuucaaguguuugggaaaacaaauagcuacuauucuaaaggugucaucuggugcucaaaggacagguaccaggauauucugugacccaaugaauauguaugauuaggugucuugaauuccgaagguggcugcaaaccucuuugacauuuucaaugccaguaaaggcagggccuugaaaauucuacccgcagaacacucagcagccagaaucagucauuuauaauucauucauccaugcacucauucaguagcucuuaccuaagcuuauauuagguauuagucacaauucucaguacuauuaauaucuagaugaauuagauagccaacggaccuauaaaggaaaugcuaccagcucagaauagagguccgugcugggugggaugagaacuggggugguggggacaugucaguucucccuaggacuuggagagucaaggaagguuuuacaggaggggugauuuuggagccaagacucgaaagaugacuggauuucaggaaaugugggaaagaccgcauuccaggugaggaaacugcugaugcaaaugcauggcagugcagaggucuugguuauuggaggagacagcuggacaggaugcaggcaacuggcuuaugccguuaacucauuaccuucuauuuagcagacucugcuggggcccugcuuucucucccagccgauuuugauuacaagaacuccuucaagcccuuuuuguucuuuuuaagaauaugaguuuagagggacagaggcaacaaaucuguauucauugcucaccguaguuccugaaugaggccccacauaauguggagaccagcucauaucuugaucuuugcuugugaaugccuuuaccuuuauuaacaaacugagaaggggcagcuguuggaagauuuagaguguggaaccacauuuaccuuuucucuuccgcucagaugccucugccccuggagccuggagauguuuccccugguuuugccuucgauacccucugugaucuuggauugguccuucgucuguuuccacccucccccuaccagccucauauuucuccuucuguuaccuucuguaugcuguauuggcucuaaggucuuuucaauuaauaauaaauugguguaugugcuucuuugaauauucucauuuagaagaugaauauauguugacccccaacgauacugacaaagguauucucucuacccuuguauguuccaccuuucuuggagauuuaauaacugcaccuacaaaaauaagaggucauauuuguuuaccucuuaccauaagguuaaaguuuaauucucucucccuauugaagugaaugucaucauguccauuguauagacgagagcuccaaagugcaacguggugaagucccaaaguuacggacaggaaagagcagaaguaaggccacauucacuaguaagucagcucucaagaaauucauuugucugccagagggcauggggacagcaaaugcccucucucgcagggaucuguguuuuuaagugucgucuuugauuguguuuccauagggaggaacucucgggcaccaacgaguagaaggaauggccuauucagggauaggacccccauagugaauacauguuugugcaaaugaguagagcaggguggagguccccaagucauagaacaugggaacaaaaguggacccggagguugcauagucuguguggcacucucuugguuugcugccaggaggcagaacuccagaggugagagcacgccccagugcacacagcuagcuaggagccagugaagcacagccaggccucaccugggcuguggagggcuuuuacucccacccagccuuugcuucuccuuuaugagugugucaucacacgccaaaauccuugaugucccaggauccagggaagaagcuuccaaccucaggagugugugccucugacauuccgucuggaaguuacguuugacuuucgcgaaagagcaugacccuguccagagauaaccagaaaggaguauccagugugaaugugaaaccgaaacaauugccuggaguaaacaugucaaagcaaaauccuuuuucauuuucaagagcauuuuccaagguaaaaagagaauguaaaggacuguagggagcuggccuauauagucccuacagcaugguggcaugugugauagccccuuuggccaugcagccguguugccccaggggccagccuugaggcugaugcccuguaggaccuuggagaaaaugagaacuccuccaucugaucagugagguuacuuggccucauggcagggucaccuagcuggcuuaauguuacacagccagucugagggugcagccagccuggaaauccugucauuccaucgagagcucuucuuccagcccaagucacauggaggucccagugggcuugcuuuucaggaacaugacaagugucugucugggcagcucugagaaggucaccucuguuuucaaggacauuuugaauguucucagcaguagcugauugauaaagagcuuuuuuguuuuucuaaaauccaacuaucaacuuuuugugaaaggggaaucaugccuagucaccuuuuucuucuuguuguuuuguauuuuaaccucucgauuccagaaugugaaacuucugcuuuuuguuccacaauguauuucuccuucucugccuccuggcagcauugaguuucauggcagauucucuuuuauuuggccugcaugguggccuacauggagcacauugccagcacuuccugagggaagagugugaggccaagugucaggggcccaggaccucauuggcuccaugcuugcugcugggaacucucaucuuccacccuaauugcaucacuuuuaguggagcuaaagcuuccuucucccucaacaacaucgaaaguguaaggaagcaauggguuaaauuuuaaaggcuuuuggaaagcuaaaccacagaguuaaugucuguuuucucaccuuuugggcauuggucccacggugaaaaagcaaagaagcaaauuugggaagugcugcuuuauucaucuucugaccaucacacaccucuuuugcgcaucagucuucuucucagugaugugcuucuugaacucuggugaucuggaaagcaaucgaaagugcaggcuuuacgugugaaauuggcugaggcccaccuggugcagaagaagaccugccuaugggcugacuccuugugccuaaaguuucgauugugugccaucugggacucugcauccauggccauccauggaaacguuguuaguggaacugccagcgccuucaguccggucccccacuggugguuuugcaggcagacacagaugacacccagcguuauguuuggaccuaaugccagcaagccuugugcugcuggguagaaauggcagcagcucagagucuucuguuuccauuuuacuuugauuugaguuuuagguuuaacuucuggcucuucuuagcuaccugaucuuggauaagucauugaauguuucuaagcugcgguuccucaaagcagaaauaauaauggcauuccugucgggcaguugugaggguuaaaugagaugauucugugacucaccgggcagggcaggcacucaugaagggacagcuguuccuagagucauugacgaaauaguaccauuaugggagagcaguucccaggacucaguggguucuugaagaauuaagucgcucgccugggcagccuauucagugaagaguggcacccuugugacauagggguucagauuuaggccacauucuccucucuguuugguuuaauuauaaucauuaaguuagugccaaaggucaagugcaccuggucuggaaccugaggcucagaaaggccagauugaccauaugugcacuggaguaggcggccacaggcacauguagggaguggaggaucauaccccaccgugccugaaucagcuucuguguugcaggccuuggacugcugcuucuccuucguucccagggauguuugugcagggcagagccugguucuuuuuguuuauacugcugaaaaggaaaaccucagggcccagaggcauugagcagcauuuugaggaaguuaaucuccaaucccaguugaacucaccuggccacacccugugcauccacaguucguguaguaaaaucucagacagucuguguguaguagcggccacccugcugguuauggcucagaaucugauagaaggcagcacccacauccccaaagugcgugcccugugcacuccgccucccccucucugcuguggcauuggggugaccugcuugaucagucuauucuuagaagccccauguuucaggccccuccaauuccauuuuaauucaugggaaggccugagcuugggagaaguccuguuacuucuauguagagucacagcugccgucuggauuccaaucccuguucuugcacuuuuuaggaauggaccuugaaaaauuaccuaagcuuugugcccagacugccucaucugcaaaguggaaauaacaacauggcuuccaucauggaauuaaauguauuaauacaagggagcccaaugccuagcacacagucagccaucagcagacgggagcuccuaccuagcacacagucagccaucagcagacgggagcuccugcugauggaagccuccucugcacucagugucacucuguggucacagggccaguucccuggcucacucaagaugcgaagagcccuuugagcaggugcacccuuaugcugcucaaggaagguggguggggccuuguuaccacagcacuuccuguuugcuuuugcccauuggauuucucucuggguucaaggcuuccugccaucccucugccacucucugccucaguuucaguucaguguugacauuuccuugcacagaaggaccccaugugaacugagaaacaugccucuuuacauguuucuucuuuggguagaagaucuuuaucucuugacgugacagguuucauuuccuccgcuuuguggaagccggucaguacccacuucagcaggguggaagcugcgacuguuugcaggaacucaguggccugggggcuuucgguauaauaaacgccaccugcccagauucacagaccugugccucccugugggguggaggcguuucuccuucccccaccaacagaggucaaggcacucuuucucagcucuuaguaucuuuauuggcuuuuccuucagaucuucaaguugcacccgccuccauugaggucucaguaucuaacagaguacagagggcaggcauggaaacccuggagaccagacucagcuuuucuuucauuaaaagcuguguacauuuuuucaaguuguaggcgcuuuguauuuugggaaaauaccuuucguuuuugcuuugaaggaaauggagcuccuggaauucccuuauuuaugagaaaccccuuuauguacuugagguauugccaaccuuuggggaaggcuggcgagccuccuguuccccaggguggaucagugaucucucucccauagcacucccuuuccucaucagagcucaucuccugcuguauucugauggcccgugugugcaucuguagacuguccuuguccccugcugggggcuuccuggggacauaggcugucucauguucacugcuucuggaacagguugggccuugcuauuuguugacggaaugucuccuuuuuugagugggagcagcucagauuggauucuaaugacagaaagagagaggcagggguaaguagaguauuggugucuaggucauugccuggaaucagugggagcccagaaaacguauacauccccuauggagacaccuuuucaaagagagcuauuuccaaaguuucccaucaagugagaaauuuacccaucauuucccuuuuaauuuaaugauuuaugcagaagugacauuuauuuaagacauuguuuucagugucuauggcaggcuguaauuuuauucaugaagggcuuuucuaaucacgguuagaaaggggagagcuuccuccagguuccaugcuuauaaguagacuaaauaguagguauucuucagcaggauuucuugcugggcugcuuacugcuuguacuuaguaacuaguugaugggcuaguguggguccucaagcaaaccaagcagaggcacaguggucagauuuuuuuauuacuccauuuagcccuauggucuuagccugccuucucugaaaucaugagaagagacaauauauuaauauguuaagugcccagcacagugccuggugcacugcagcuacuugaauacauagccgucauuauugcuauugggcauccucugaugucauugagccucauaacccaacagcccggagauucaauuauuuauuuaacaaauaccuauugagcaucuauuaugugccaggcacuauucuuggugcuggggacacuacagagcccagugagagagaaacccuguucucaugagaccuacauuucaaugaaauaauaucuagggcccaccauguguuuuacucauaacaugugauucaccaauuuaauucuaauuagcuacuguauuuaaauuaaucaauuuaaacccagugaguaagauacucuuauuuucaccauuuuacagauaagaaaauugauccucagagucuaauggccaaccaguggcagaccugggguugguacccaggccccuggcuccagagcccaagcuuucaaauacuagguugucuccaggaaauagacaacagguaaaauaccgucucuuaugcccaacccugagaaagaauuuucucacgcaguuaggcaacaggugugcaccaggaggaccugacuagccagggucaaaacucagcucacgacucaguuuuccugagcagucauggauugggccaccaaugagccaacccugcgggcaguccuacguccuguuguuccauucuguggguuuuuuuuguuuuguuuuguuuuuguuuuuccccagggaacuauacaaugggcuucauuucuuuuucuauccuccaugccuagcacuggacuuagcaguacuuaggaaugugugaccauugaugccauggauauacaaauagccccuuaugucccguggcgugaauaucauaagaaaaaucaacuagccauauugacaguggaaugcaguggauggaaacucauuuucaauguuguuuucuacucaauacucuugggaguuucucuaaaucaugaaaccgaguccaggcuauuugaaauuucuuuggacucuagacauugccaugcauaagaagagucuugccuagaugccgugaacuccagauagaauguuggaguuggggagucuuagauaugggggucauucuaucucgcaaacauuuauuaagcaccuacucuguccuacggugcuagguguugaugguacaggaaucaguacaagagaguccuugccuaauggauguaaucauuauucaauaguuauuuagcuguaagcauuauuuaacaguuccaacaguggaguacgguguggagaauggucaccuccgggaggugaugaccuccugcacgagguuggcuugagugcuguaguagggauggggaggucccagaaggcaugagucaagccagaggcacaaagagccguguguagggagggcugugcugcuggaggguccccugugccaggacagagaugaggcugaguccagggccugaaagacacaccccucaccuccaacuugaccugaagcccagaaggaaccauugaaagguuuuucuggauggcagggauggguuugugauuccggaaguacaugugaaagaugaacuggguaaagcagccgggcauggguucuaggaagaaguggcucaaacugagacuguggcagugggauugaagaauugggggcaacaaguggggguuuaaacccgacacuuuuaucuuuacaaacaaugaggaggagagugggcuuacucaagguuucaaauguguucauggcacagccaagugcaggacccagguuuuucgacuugaucucauucauuacgugccuacgcgcacaucuccacaagccuguguggggcucccugucaagugcagcgucccugucuggcccugcgagugggugcagagaugcacucacaggccucccugaacucugugaacucccaccccacaccuggaacaagacugggaaaauucuggaccccgaagcacuccuaagccaccgggcagggcagcaacaccaucgcugggugccccuggccagcacugagccugcggaagcuuugcggagaggccaauccacugauaugggggaggagggauucuucaggagccauggcugaaagucucaaugcagggagugaauggagcauugaugaggaauuccugucagcauggcuuccucuuucuuggguuucccuuucuguuccuauggcgacaggauggacuuccucugugaagcccuggcggccugcaggcugugcuuguguggugucugcaugggggcgugggaagguguucggguacaaugagacuccccuguucauccaggcaccauggaugggagucgggcaggaaugugcaccugcaugcggacagggcagggauuccgucguggccggguagauggcacugcagaaaaccccugaguauuugagucagauuggguuucccaucccaacugugcuauuuccaagcaaguuccuucaucugucucuaagcugcuguagucuccugcaucaaaucggugugggcacacccaccuuccagauugugugguguuguaaggucacaagaggcauauucucucccuauagacaucucucccuccaccacgaugcccugagaugcuucccccguggcucaccuguugcucucccugcuaauuugugggccauuugagguaggaguuggggugguucacugacucuccaagacuuggugcagagguggcucucagaggugacuguuggaaaagucugugcauacaugaaccagaauuaagugaacgacaauuuauuuggcaucguuuaguggccugugacguucuaaugcagcugccaggccggcaugauggugccaauggugccaggugguccuucccaggcccuugguagcagccgccccgggcgggacccuggcuuucacagcuggacuggcugcccagaggacuuuuucaguaacagucagggcaaggucagaucuggcagcagcugaccuuuucacuugacccuuaagccuaucuggaccgccugacuggacggccuucagugacuucucuggauuucacugaccuuaggccaccggacuucccaucccugccaggcccacuuugucuggcugaacucccagcucagccccacccuggcccacccuguccugaucucuuccugccaagggcccacagugcuguuuaaagauuggaaaauacggcaugauuugcuuguggauacuauuuuugaucuuguggauugagcacuaaacuuggaguuaaaaaccgggguuugaaucccagcucugucacuggcuugcgagguggccuuggacaagucacaucuacuuucuguuaccucaguuucuucauccgguaaaugggcaggucuagucaccuguaucuaccucaugagcuauagcaguuagcugugaaugggaugguuuuguaccagaucuagugcugaauaaacugcaccagauuugccuccaucaucucagggucucccuuuaaaaguuuuucuuucuuuggcccuaaguaaaucagugauuuuaguaccagaauguauuuuggaaaggacaauggcguuagaguccagauguagauucagagcucagcuuguucaguuucucuguguauggccuagggcauuuaauucccugugccucagcuuccuuauauauuagguagcaugcauauaucauacuugucuuuuacuuuguuuugagaaauaaggaugcaagcuguaguaaucucagcaucuuauagaugcuucacacauaguuucuauuauuguuacuauaauuauuauuaggauaucauaugguguguuguaaucacuagagcuuaagaauuaaaggaaacuuuaaaaucuggaauucugaagcuagacgagcccuuuucaggcccuguagcuauuuguucuuauuuuacagaagggaaacugaggccaaaagaaccaggggccacacugguaguucaacuuaguggcgcaagggagcucuggagccugugcugagaguggauggggguggggggagaaucggggcuuucagugccgaccugugcuguuccacagaugcugggagaggaaccacacccugcugcuuuuggcuuccucaccuggcaccgggauccggugacacaaggccuggcacugggcugggccgucauugaguacacaggcugcccacguguaagccuuguucauucagcagguugagagcaaagcaggcuguucucuuccuaugccaggcacaguuugcaaaaggccugcagggauccagcuucucuggccaaaccaauccugccccaggcugguggcuggcagggagaugucucuuccccugagaaguuacuggagauaaccauugucauuuacagcguuuuaggcacaaaaauugccaccacccuccaccccuugucucuuugggaaauguuuauucuucucggacuguuucugguaccaccacuuccaggaagcauauccugauuacuguagucagaacugaauaaagugaggggacugggcugggcacagagcuggggaaaagcauuccagcccgcgggaggaacaagugcaaaagacccaggaaggaacgagaauucacaucuacggccguaugcuggggacuugcauuucgugcuuccucaccuaucuucuccacuaggcuuuuggguugaggguaggugcaaagguucauucuuaauaauaagaucgaucauuauuguugcccccaguuuuuugcagaucuaccaugcuaggcuccucgguagauaccguacuugcauuauuacaguuaauucucacaaaaacugagaagguggguguuacuugucaugucugucuccccagugccuaguuggggaacucaagcagaguaaaugcucgguaaaugucuuuuacaugccugcaugacuagugggacauuugaauuacuagguccacagaugcuucuguugguuuuuauggaaaucagcuccuuugccuggaaaauucauaaugcccagacugugaggggacaugagccauugcaagacuguucauucauuucugcucccauuucugacaugugcuagagccccaccagggacuccccauacacauucuugagaccgugacuggcagcccucuuucccagaggagggagccaaggcccaaagaccuucagcagccucccugcaguuacacagcaaguccacagugaccagagcugacacucacccccgccugucagaccucccuccauuccucucgcgugguaugcauccugaaagguccucguugaaagacguaauccagaccaguugccuugacccuugccuagaaguuuuguaaacaaguucacaguguucugagaaggaagcaaggucaaaagaaugaccuaccaaggccagcaagccugcauuuccuccccauccuuucucccggcuucucuuuucuuuugccccucuccugccugggaugcagauucuccccuagagaaagagcaggcuccugccccaaggauuggcuguccccugacacuggggaagcacacguacagcgcaccuugauggagccuagugaacugagcaacccuggugugguuuccuccgccagcugcuugaguagguggggucaggccuaaggaaggugagcacccagccacugccuugccuugccagccguaggagccuacucagacucucugagcauuaggcucauuguccaugagaaaaggaaucauaguaccugccuuggaaauggaucuccuaaacuuuaaagagacuauauguguaagugccucgcaugcauuagguacauagaugacaucugccguuugguacuuuguaauuuucaaggccugaucuugaacccaggucucuguggccucaggacacugcuuugcucucugaccugggcugguuuuugugguuguccuucugcagcaugugccgaaccaaaugugacaagcagaccugggcccuccccacuaaaauuucagccucugaaggaaaggagcacguaguguuggauacaugagcuuaggggcagcugguauuuggcagcaugugggauggucuuuucauuuuauucucaaauucacgaaguaucgggccuagauucugggugcucaucuugagguaggaaaggugaaaggugaacuccagcuugggggaaggccaggguuaguggacagaguggaggccuuaaccauuuucugaggcuuccagaaagagggguuaggaugcuuugaauguggggacaccugggggcaggaggaggugaaggagaaagucagaaucuaaaauugugaccuggaaggggauaggaauggaaaagggccucagauuuggucagagaugcgacaaaagugagcugacacagucggggaagcacaauccggguggggagacacuguggcaaaggccucagaaggacuggggucaagcagggcaugugaggaacagcaaacaggcugggaaggagggagagggagauggucgagagucccuugcacgaaaagcuugagguggugagcucugcacccugacaagacugagcgaggagaaauucaagucccuguagucauaucucccucccaccuuuacugacagaugccugauauccccacccccuuaucacuaugggagauuccuugaugcugucauuuacaaagcccauccucuguagagcucucauugacugccacuaaacccuggccagguaggcagagcaccggcccuuguuccuuugccggugagcgcacugaagcucacccccuggggucgacagcaggacagucccugucauugauggauuguguaucugcccugugccagguacucgucuagguacucaagguacagcagcaaacuuaaguguuguucucugcguacaaaaugacaucaaccacaugcccaugggcucuuggaggugggaagugaggugaucaucccaaaaugaucaccauaaugauacauaguaaaucaugaaauguaaauguacgauaucucccaugcugaaaagaggaggagggcgugcuccguaauguaggauggacaggaucaaguuuaauaaccuucauucgagcagaggcaagacaaaagugagcugucacacaguuggggaagcacaauuagggcaaggggacacuguggcaaaggccucagaaggacuggggccaagcugggcaugugaggaacagcaaacaggcugggauggagagagagggaguguggcccaagagauggucgagagucccugggggucacccugcagccgugaccaagcccuaggccuccaccuggaugagcugcaucaccacugcagguuuggggcagacgaaccugggcaaaaccugggcccuuugauaccaagauccaugcuuguuccacuggaccgccccuugucccacagaugggagagcuuguuuuucuucuuacuauuauuuccacaguuguaauucuuuccauagcuauucugcuaaaacagugaaauuggagaugaggagucuggcuugcgcugggugagaauggguagaggaagcuguggagagaacucacggugccugugguucgagauccccgccuuccuccuccuuuccucugccccuuggguuucaccuuuucaccuccgucacaucucgacagcuaguaagucucgugggccagcuccaccugccaccuuagauuaggaaacgcaaaaggacaaaagagauuuguuuuuaaucagcuccauuccagauuagcacauguagauccuuccuguuuuuguagaacauuagcuauaggcgcagaagacuauguauucuauagauuauaauagaaugugagugagcacacaaaaaagggagagauggguauuacagaaucccagaaugauaaaacuggcagagacuuuaagacugccuuguccagauguuugcaugacaguguaaauguacuuaaugccaaugaaguacacuuaaaaaugguuuaagaugguacauguuauguugugucuauuuuacuacauaauuuuuuuuuuaaagacuuccuugucuagugcuccucuuuaggucugaaaaacagagaaguugagugacucagccauagccacacagcaggugagagacagagccuagccuggaaacugccuuccuagcucuuagcccagugccuuuucccacgaccacaacuauuguuuguucguugguggaaauuaauacggaaaguagucacuccuugagcuuugaacuccuguaauccaaauaugaggcauuagagucaacccaggauuucacuaaaccuuuugcuguagagaacucccagcagcaaucuuuugguuaauuugaaccuugccccgcuucuauggcucuuaguggcgguggugaucacgcugaaaggcuaagaccuucaggcagacggaggaagagaaacagcaggagauggacuugagucacaagcucugacuuaugacccaaugugguuuuuccaagcucuuucuuauucaaugcuuacuugagcuuuuuuugcacuucggggcaaacagggcagaugcuugcacgugcgcuugcaugugugcuuuugagaugaaggaaauacgugaugugagugagacagcccuuguggaugcugucuuaauccuaacuccaacuccuccccaucccuccucaccuucucugcaagccuccaggggugugaugaugggauagauuaacugagcuuuugagacccaaggacuaccuacaacucucugaggcagugcccuagccaggagagucagaggaagauuucaauuuugagcacgggaagguagcaauuccuaacuuuccacucaaagaacaguagggcaggaaaacaggaauucuuaggaggccccugagcuaaggagaggaggcuggucuaggagcuuggggcgcuggguggaggaagcucucagugacuuucaccauagccuugaacaagucaccgcgcauccuggcccucacaguagauuagguauaguuaaugauaagaauucaacucacuuccaaaaguauuuccugagcacuuaauuuaugucauacacaaugaugacaucagaucuuacuguguaaggaugcaugcuggguuccaggcaguuuaaugcaggauuucuuaccucuuuucuugagcauacccuggagaguccuacuuuccugucagcaaccaugauggaccuuaaaugggagggaaagacuggggguaggaugccuaguuugaaaaggaucuugggcucaugguucuguucacacacacccuaugcacgcagacacgugggaaauuggaaucacagaugugcacagacagaagaugugggugaccuucaucagauguuagaaccuggucaaggacaaggccuugggaguaugaggggcaggacagaagacaaaggcggcaggaaaucuggggaaagaagaugguuuuguuuuucuuuuuugagacagagucucacucugucacccaggcuggaaugcaguagugcgaucucagcucacuguaaccuccgccucccggguucaaacgauucuccugccucggccuccugagcaucugggauuacaggugugcaccaccacgcucugcuaauuaucguauuuuuaguagagaugagguuucaccauguuggccaggcuggucuugaacucacccgccuuggccucccaaaguguugggauuacagguuugagacacugggccugaccagggaaagaagauggucuugauacgagggugucagccucagaaggaccaggugauaggaguccacuccugcuugaacauucccugcuuccugccugguccuaaagagaggcaccugguauagcagaaagagcagcagcaucaacuuaggaagaugugggaucaagucuucuccauuucccagcuaacagguuuggggaaguuacccgaacucucugagucucgauauucucaucuguaaaaugggauguuaauauccuacgugucuaauacaaagggcuguagugaggccaaaaugcaaguaaggugaaaggucuuuguggacuguggucugucauguuaguuacacgucugccaaaaguuguagacaaagcugugggcuuccugguugguuaggucucgguuugaauucuguggugcccuaucauuaugcaaaugugacuuugagaaagcuaguuaaucucuuguucccucaucgcaggggugaugaugaugugauucaugguucgcuaaggugcucaagguuugagcuccccaguggauuaucagcugcaugaaaagaccuugucagucuuguucacccauguggguguccucagcccuggaauaguagcuggcagcuagaaggugcucagugaguaauguuuggcuggucagaugaaugcgugaaugaaugaaugugaaugaggagucuucagaaacacuauagucgguuauguuaugaugcuggugguaacgugucucugagcacccucaggagcuuauguuuuccuccuuucuugcaggacucgggucaagcuggaaagccuggaagacgccuacauucugcggggagaugaugauucccucuccgacaagcauggcugcccggcuuacguaagcccagagaucuugaacaccaguggcagcuacucgggcaaagcagccgacguguggagccugggggugaugcuguacaccauguugguggggcgguacccuuuccaugacauugaacccagcucccucuucagcaagauccggcguggccaguucaacauuccagagacucugucgcccaaggccaagugccucauccgaagcauucugcgucgggagcccucagagcggcugaccucgcaggaaauucuggaccauccuugguuuucuacagauuuuagcgucucgaauucagcauauggugcuaaggaagugucugaccagcuggugccggacgucaacauggaagagaacuuggacccuuucuuuaacugagcucaugccccacggagacuuagcagguuccaggagugagcgagggcagcggaaaggaguucuuccgggggacacgaauugccuggcugaguagcaagaaagacacacucuuaaguuucuugguucagagcaggaaaaccuucaaggagcugacugaccacguagcaugggggcaagaggcgugggauggggauuggggugagauggaugggagcccgcuggagcuugucuucccuaacauagccugggagaccaccccuugccacuugggccacuuccgccuaccccacuuuucauuuuguuccaaaauaguugcagauccugacagaaucaaaacucucugccucaaacacacauccuggcaucgcacuguuagcauuuaacuucuuguuaggauucagggaaggaacaguuggccaagaauuuuuuuucuuuuaaacaagccaaccaccuagcugguaauuaaugagguucacuuaaaaaaaaaauucggugcacacagacugacaugaaaccugggugcuacaguaaaagaaaacaaaaguccaguuugugucucuuaaucgcucacuucaacucauuucuucuaaauaaacuauuuaauauccuggucaggaaaugacauguuaaugcuuugcucccugaagggggaaaaaaucuguccuuuaacaagcuauucuguuuugugucaauugguucguggcaggaagcuauuagaagucaaacguccagaugcauuacugcuaucuuaguuuaaagggggaaagaaaagggaagaagaaaggaaaagagaaauccaacuccuuuuucauguuuugcuuuugaacaaugaggguuugugugacaggcauuccucuuugcugagaugauagcaauggccugagauuuuagcaagcuccuggagucugaugcuuuugcaguacucugaucgcaacuaaacauuugucuuuguuuuauuagaaacuagugaaacaaagcagguugucccacauguauaaaauacagggcagcuauuuaguuuucuuuacagagaaugauccuuuuaaggcuuguaaggcccucugguuuggacaaaaacccucaguagagacaagcgggaaggauaauuagcugaaagcuaugaugauauaaauaaaaacagcucucuaucccaauacgcaccuuuguauuuucaagaacucuucuauuuauuaaggaaaaugucacauugugauguauuaagccaguacuucaauuacggguugacuugggaugacauauuacaugcuguaguuaacauuuauaauucuuuuuccuuguuugaguauuucugucucugaaauaaccuuuuacuuggcuuuucuagauagcuuuauuugauuucgaguggcaaaauguuuuuuauuacggcuuuucuauugcuguaugauacagaacucuuuuggcauaaauauuuguguucccaguaccucacuuguucggauuugacugccuguauauguuuugugaaaugguccuguuuuuggguaggugacacguggacucuaguauguaaauguuacuugaaucugugcuucauaauaguguguggcauguaugugcagacucuuggaugcuuuaugccugcgcagcaggagcccuguccucacguucccaggagggcggcuucacccuucguaaccaggagacaaggcggccauggauuugcccuugauucuauuuugcuaauggaagauagaaaggagagaagguuuuuuuuuuuuuuaacauucugaagauggugcugugucaagaaggaccuuuuuuuuccccucuccccuauuuuuuaaguaccuuggaggaggagagguuggugacaugcaugguggggaucuauggccucuggugcuuuguccuguauuugguuuaauguuuuuguccuaaucucuucaaucaauaaaauugugcguauuuaacuaaa

SEQ ID NO: 21288 - RNA, 2155 nt, Homo sapiens
ucgcgggcucugcagcaccggcaccguuuccaggaggccuggcggggugugcguccagccguugggcgcuuucuuuuuggaccucggggccauccacaccguccccucccccucccgccucccuccccgccucccccgcgcgcccuccccgcggaggucccucccguccguccuccugcucucuccuccgcgggccgcaucgcccgggccggcgccgcgcgcgggggaagcuggcgggcugaggcgccccgcucuucuccucugccccgggcccgcgaggccacgcgucgccgcucgagagaugaugcaggacguguccagcucgccagucucgccggccgacgacagccugagcaacagcgaggaagagccagaccggcagcagccgccgagcggcaagcgcgggggacgcaagcggcgcagcagcaggcgcagcgcgggcggcggcgcggggcccggcggagccgcgggugggggcgucggaggcggcgacgagccgggcagcccggcccagggcaagcgcggcaagaagucugcgggcuguggcggcggcggcggcgcgggcggcggcggcggcagcagcagcggcggcgggaguccgcagucuuacgaggagcugcagacgcagcgggucauggccaacgugcgggagcgccagcgcacccagucgcugaacgaggcguucgccgcgcugcggaagaucauccccacgcugcccucggacaagcugagcaagauucagacccucaagcuggcggccagguacaucgacuuccucuaccagguccuccagagcgacgagcuggacuccaagauggcaagcugcagcuauguggcucacgagcggcucagcuacgccuucucggucuggaggauggagggggccugguccauguccgcgucccacuagcaggcggagccccccacccccucagcagggccggagaccuagguaaggaccgcgccgcugcaccccuucgccucucagguggcagacggcaggccggccaggccgcgguucccaguccaccucgauuuccuccccucucccacucuccgcucagccuucccaccucacuuggcaccguugccucgcgcccccagcguccccggaaggccggucugaccccgcuagggagagcagucuccagggggaugcgcccuggugaggggugugugugcgcgugagugugcgugacaggaggggagacagagacacccagggucacggguaaggaccguuuugucagcgccacccuuucuuucggcuuucaauuuuuguucuccuuaaaacaaauguuuuaaaacaaauuccaccuccuccuccuuuccacccacccacuuccucuugcccuugggcugaaauccuuccagguuguucagcuuaauuucucagugguggugauaagaacagugcucacuagucuuagaaaacagccgcagagaccuaaacaauaaccgacuccccccccccccucuggguuuuugcagaugucauuguuuccagagaaggagaaaauggacagucuagagacucuggagcuggauaacuaaaaauaaaaauauaugccaaagauuuucuuggaaauuagaagagcaaaauccaaauucaaagaaacagggcguggggcgcacuuuuaaaagagaaagcgagacaggcccguggacagugauucccagacgggcagcggcaccauccucacaccucugcauucugauagaagucugaacaguuguuuguguuuuuuuuuuuuuuuuuuuugacgaagaauguuuuuauuuuuauuuuuuucaugcaugcauucucaagaggucgugccaaucagccacugaaaggaaaggcaucacuauggacuuucucuauuuuaaaaugguaacaaucagaggaacuauaagaacaccuuuagaaauaaaaauacugggaucaaacuggccugcaaaaccauagucaguuaauucuuuuuuucauccuuccucugaggggaaaaacaaaaaaaaacuuaaaauacaaaaaacaacauucuauuuauuuauugaggacccaugguaaaaugcaaauagauccggugucuaaaugcauucauauuuuuaugauuguuuuguaaauaucuuuguauauuuuucugcaauaaauaaauauaaaaaauuuagagaa

SEQ ID NO: 21289 - RNA, 5377 nt, Homo sapiens
ucuuuuguuaacauuugauuuauuuaaaguccuuaacugcaaaugaucaagaacauuuuccacggcuuaaaaucugguauuauuuuuguuauuuaaaucaaaauauuuuuaauuacaaucacauugauaaaaauuaacaauuuaauuuguaauuuuaaccaucauuuaaagcaauuucagcuguaaagaaaaagaauaaaccaugcaauaaauuaacauugagaaagcaaagagaaauaauaaugaaacccgucuggcuauacuaacaccauguccaacuguggaaagugcauaacacuggaugaaacaagcacacgauggcaaugauuaaaauggccacuaucaauaggauuuuugaaucuuggaccacguuuugaaauccagcucccuauaacuuaucucuccuccaacauuguaauauucccuuuuacugaaaaaaaaauucuuuaaaugguauacacucauagaaacuaauuuuauguguuaugugaccucagaaugacaugaccauggcacucugcaaagcaagaagcagaguucuugagggcaauuccugaggaauugauucccagggccaucuguggguagagaggacaaagggguugggguccuuguaacuuucggucaagcaacucuugagaauguaucauguauaucaccuaucuauuaccucuauauguuauguaaauauacggaggaugucuacacaucugagcaugugcauaauuaaguccauacacaauauacauguauuucauuuaaagacaucugcuaucugcauguaucagaaauguaaacugagaagcaaauggcucugauguuuauaaucuguuuaugucuugcuauauaacagcaguauugucuuucaauacuuuuaagagccucuaguguauacuuguuucuucaccauuucaauucuuaugguuaagaguauugccacagaccuguaaacucguagggggucagguaaggagggggaaaaagcacaaacaaauauuuuacaaacuugaccaucuuccuuuuuuguuuuuuuaaauaacccuccacaaacuagaaugucuggaggggaaagagggaagaaagagaggggggcaaggaaggaggagaauuucauauauacacuuguggaucauuaaacuucgcaggaaaaaaauugguuugggguugucuuuguaguaauauacacaaugaauuuugaauacaauaauaaaguaacagucuuuugcacugggggaaagguugugcaugaaaaaugaaauaaaaauaguuguugggauuuuauuaugcuguugacgguuugguuugugugguuuuguuugcuguugauuuuuucucucuugcuaccagcauggcuaugccagacaaaccccccagucccgggagcuaggaaguguuuaggacgggucuggaauacacaccuugguaguacgccggcuccagggcugagggcucgauggggcuccugguggucaccgaggcgcugccuagaggcaggcuggcgggcaacguagagccguaaggcgaguauugcagugccuguucguaugccuugaaguccagcuuaugcugcugcuccgaggaggacaugagguuguugauggagaacgggugguugaaggaguaguggggguccccuuucaggugcagcugggacucguggggugccaagccgugugccgggugagaggcgggcacagaggccagcgccccgggcccggagcuuauggggggcgcaguugaggaggcuggagucuucaacuccgaggcgcccccugucgccgucgccccacugugguccagagucugggggcuggcggcgggcccgggggccggcgcgcccucuagcuggccggucuucccgugcacaccccgauggaggggcgagucggcgcugggguuagaggcgccagagggguccuugcggcucucagggccgcccuuggcgccgcugcccccgcuuccgcucccgcccccgccgccggcccccggcugcuucucgcacuugaagcgcuucuggcggcgcaaguagcagccguucucgaacauguugccggaguccgggugcagcguccaguaggagcccuugcccggcuuguccggggagcgugccaccuugacgaagcagucauugaaggacagcgaguggcggauggaguucugccagcgcugcugguucugccgguaauaggggaagagguccaugauccacugguagaucucgcucagcgugagcaucuugcugggcgccugcuggauggccauggugaugagcgagauguacgaguagggcggcuuggcgugcggguagcugcgcuugaacgucuuggcgucgccgccgccgcccgcgcggcugcggcccagguuggacggcgcguacgccauggggcucaugcacggguucauggcggccgcguaggggcccaggccauucauggaggccgccugcugcgcacccauggcgcccaugccgcucgggcucagcgccguacccauggccgucacgccggccgcagucaugcuguucauggcgcccgccgagccccccggcaugccggcuacugcgccgggacucaggccggccccuaggcccggguuggcauaggacauguugaaggacgccggggucauguugccgcucguagucaugguguucauggucauguagguguucauggaguucauggagcccaggccugaguucauguugcugaccgggacggaggaguaggccuggaguggagacagcgagugaagaagccccggagggcgggguuaguggugggcacuggagggcggccguccgggaccuaacccgggggcaagugcagagcacuuugcagaacacgggacgcccccacccggggcaaauggcuaagcgcccuccccagaccgagcaaagaugucuugcacggcagggggaaaauccuagcgcggcaggcaugaaagauaaacgcucacagaaaauaugaccccaggaagauguguaaucgccuuacacgccaggcucaggggcuggcuuccagggcccccucaucgccuccuccauccacgccaggcgguaucccaagucuccaccccaaccagccucggcaaagcgcccuuuggggggaaaucguugauagagcaaaucaccuauggacaugggacccccugaaucaucuguuucccaacaaguggcuuuauuguccuagggguuuuugccuauggugacuuuuuguuguuuauuguauuuagaaguaguguuuucuaccugcuuguagcaacuguaauguuaaaagggaagcaaacucagaguuaaauaaguuuuggaaaaauaaaacuaaaaguagauccauaacagaaagggcugggagggggugcuauaauaaucucaaagugcuauaugcauuuuauuuuaacaugacuuuacauguacaccuuugcaagcuauuuagaaacucgcauuaauuuugucaccacuuuacaguccccuguuugaaaaauuuggugacacaguuugucaaaauaaaucuuuuuuuuuuuucacaugcugauguugcugccgaugauuucaacgccuggcuuugagauuccgugaguagucuugaauaauuuaaaauucgaaaaucaaauucuacuuauuuucucuuaaugcuauuguauuuccuaauucucagcuuuaacauguaagaaaguacuuucgcuaggggucuuaauugaaugguggggucgagaugacugcgucagaauuaaaucucuggaagaccucugagcuccuuuuaaaaucaucaacaagcgaaaauccuuaucaauagcgaugugggaaugcauuagguacaguauuuuaaacauacaaaaccuaggcauauuaaaaagcacuccucugguaauuuaauaaggaauaaugauguccuuaaguuuauuuuaaucagcaaguaugacucaauuugaaaauaugagaacaaauagauuuaaauaggaacacccaguaaacuaugguaugcaaauaaacucagagguaaacuugugaauacauaaaucuaaauaagucaguuaccaucaaaauauuacgugauccuauauuuuucuguccacgucuuaaaaguauuuuuuaccuuggggcuuuauuuucuuucccucuucccaagauuauccaaggcaguuccaauacgcguuuucaauaaugguaauuaaacuuuuggaggguaaucgccagcuguuuccagaaaaauacuuuuaauaggugguaguccucccuguaacugguuuucccuguaauccuuuugugcacauuguaaaaauaacccccaugaacgugccaccaaggggacaaugaagagaaacagguucucggcccagaguugugaagaagauuuuggucgcacuagcgccacccagcgguuuuagagaaggagcacacuucuccccaaauagggcuuuugaagaacaaguuuuacaaaauuuagaaaucguuucauuauugagacacccaacuuggcggcagagcgcuuuaaucagaagacgucugcgaauuaaacggugggacgaagaggucgccuuguggguaugcuccggcuuucucagaguugcuuccaacucgcaccggcgcucgcccgcccgcugcaccccgggcccggcuccugcucccgcucgcugcugggaagaggcaagcgcuuccuagagccgcuguuuucaaagcccggaguuuccuaaaacucccucuccggcugcgagagucgggacagagcagggcagcaggucccgcuuccaggcccggccaaggcccggccggggccacaccggcgggcgggcagcgguggcaccgagaaggcgcccccggcccgccugccugccuugccuggcgcccaccgcuccccggccucccccggcacgggcuccagcggcgccccaccggccgcccgccucgccuugccucucaccuccugcgugucugcguaguagcuguuccagucgcugguuucaugcccuuccaucuucacaguuccuaacauccuggagccacccugcccaauacaaccauccagcccugugcgaagcgacgggcggccgcgcggcgcggggcgggggaggggagcugagcagcugcagucacccgagcgcccgcgcgggcccaacgccacccgggcgaagaggaagcccagagcugcggggcgcggcgugcgcggcggcggcggcggcgcggcgggcgggggcagcgccgggggcaggcggcugccgcggagcgcggcgccggggagcgccuccgcgggaagugagcgggcugccucugcgaggcaagugcaguugagcugauguggaucuuacgucgcuugagugcccaccuccucguccucuccccauuuguccgccgcacaaagacgcucgcaccuacaaagcc

SEQ ID NO: 21290 - RNA, 52718 nt, Homo sapiens
ccugguccacagaagauguuuauuugauguaacaaaacaauacaguuaguguuagauccaaccacaaagagcaaaaggaaugaaaaauuuguacaauguacauagaaaaaacaagauauuuacugugacaacuauauauuccuaaaauaaugcuucuaaaauuacucaauuauugaaaucuacaugaaaaaaaggauguuaauagcgacaaagugcauaaaaucaaacauuguauuuugagcaaauuaacauacuaggcaauuuugcuaagaaugcaugauuuuuuuuuucuuguuuacagucugcucaaaauaucuuuauaccaacaggguaggcagaacauuuagguuuaauaucaguuacacaauauuagcauaaacuuccacaacuacauaggguauuguuuucuuuugagcuggcaaagugacuauagaaacaucagaugauuucucugaauugagaauuuuauccaaauaaaugccacauaccuucuagauauaugcauaucuuucuauauuauguaaauggcuuuacccauuuaaauaauaaaccauacagcauuuaagaaucauuauuauaugauuaacaaugucauguuccagguuuaacaauuucauaggccaaaaaaaauuucuucuuaaaaacuaguuuuauaaacgcagaauauauuccaugaguaacugcugguauuuuuuaagaaaauauauugugcaauuguggcuaccacguacugcuggcaaagcauuauuauuuauguaaaaugugaaaaaaaagguguaaaaauuuuucaacugccuaugaucaugaugaaagguuacugccuucuuacaaaaauuauauuggcaucuucuuaaaaauaauucgaaaaagggauaaacucccuagccaaaaauaaauaaauaaaaaggugcauuuuuuaaaaugaugcuacugcaaugcaaugguuuaaauaccaaaaaacugagaaaaugagcugucugugauccagcauuaaagaacauacuaaaaaagagcauuaauguaaauuaaguagaaaggggaucaaaauugaacuaaccaaguuugugcaguauuguagccaggcuucuaaaauuagauguagaaaauauaaauagacugcuuuagguaaugagccaccaguguccaaaaaaaggaaugaaauuaagaaaaagcucaguuaacuugauccaaagcucugaguaauucuucacccugcaguagguuucugcugccuuguauaggagcauuaacuucacaaucauaacuggucagcugugguaauccacuuucauccauugauugccccagcagucuacaugcuaaaucugaaaaacaaaagagauaccuaaguauacauucaucuagucaaugaauauuuauuaaacacccacaauguguuagguaucauagaaaauaaagcaaaauucuggaaggguuuuuaguuuaccuggcaaaaccacaacuauguuaaaaaguaaguauaauccagugauacuguugcugugucagaaauguuuacaggauacaauaaaggcacaaagaaauaacaauuuggaaaaaggcauaaauauggugggcaucaaagcugaugccuguaauccuagcacaggcugaggcaggaggaucacuugaggccaggaguuugaaaccagccuaggcaacauagugagaccccaucucuacaaaaagcaaccggguguggugaggcaugucuguagugcgagcuacucaggaggcugagguaggaugauugcuugagcuugagcacaggaguuugagacugcagugagcuaugaucaugccacugcacuccaggccugggcaacagagcgagacccugucucaaaaaaaaaaaaaaaaaaaaaagaagucauaaaaguucacaaauuucagcuucuaucaauauugacagcacauggacauagagaaaucaaagaaaauuacuaaaaaugaaaagcuccaccuugaaauguuaaucucuguauuaagaccaucacaugaaauacaacuguacuuuuuuuuuuuuuuuuuuuugaggcagagucucacccuugucgcccaggcuggagugcaguggugccaucuuggcucacugcaaccucugccuuccggguucaagcaauucucaugccucagccucccaaguagcugggauuacaggcgcccgccaccacgcccagcuaauuuuuguauuuuuaguagagacgggguuucaccaugguggccaggcuggucuccaacuccugaccucagaugaucuggcugccucggccucccaaagugcugggauuacaggugugagccaccgcgcccagccacaacuuuacuuuuuaaucuugcuaaggaaccaaagucauucucacuuagauuaaagcuccuaaauaaaaauguuucauguauuuugucuuugugauguucaaggucaaaaagaauaaacuaaccagaggguauuaaaauaauugucuuuugcuccauuccauucuguucacuagauuugcauccuuuuacacguuuccaagaaagugauguaguagcugcaugaucgucuggcugcuguaauaauguucccuauaaacaguaaaguuauuucaaguuuaguuuguugaauuuuuuuuuuaaacaaccaaaaaccuugaaauugguguaaauuuaauaacauuauaggcaguuucuuaaauacuacccuaaauuauuuugaauucuuucuuaaguuauuugucauccauuaugaccauucugucuauaaauacuuuccaguuaauuuaguuugaaaauaucagaauguauuauaccaccauugacuuaccccaaaacauagcaguucuuuuuuaaauaugagauggacucucacucucuuacccaggcuggagugcaguggccugaucucagcucaucgcaaccuccaccucccggguucaagcuauucuccugccucagccuccagaguggcugggauuauaguugugcaccaacacgccuggcuaauuuuuguauuuuuaguagagacaggguuucaccaaguuggccaggcuggucucgaacuccugaccucaagugauccucaucuuggccucccaaagugcugggauuacaggcgugaggcacugugccuggccaauagcaguucuuuuaauaaggcaaaguaacuuaaagggaagagaaugagauugguggugauauucaggguggaguaaggggagaacuucacuuuuuaacucaaaauacacuggaauuguuuggaauuuuuauaccaagaauguauguauuaaacauuuguauuuuuaaaaaccagugcauacagaguaaaaaaacccaauguauaacuucugaaaauauaacuuuacuauuuggaagaaacguggaaacacacacacacacacacacacacacacacacacgaaauagcacauuagcuagaaaagcaaaaccuacuacucauacuuacaauuccuacugcuugaaaaagugaaccaucauguuccauuuuucgcuuucucugagcauucugcaaagcuaguaucuuuggauuuaguucuuccucaggaacuguaguucugaaaagaaaaaaauucuaaaugaaaauauagcguuuuuaaaaaaaauauccagugagcgcuuuuaaagaaaauacauaauucuuuaguucuccaauauuaaggaauauaauauacauaagauaacuuuccugaucacuaaaguuuaucaucuuaaaaguaaaagcuuaauuuuuuuuuuuuuuuuuuggugaaacacggucuuacucugucagccaggcuggagugcagagacgugaucucugcuuacugcaaccaagcccugccucuggaaucaagugauccucccaccucagccucucaaguagcugggauuaugacuaauuuauauauacauauuuuuguagagacaggauuucacuauguugcucaggcuggucucaaacuccugagcgcaagugaucugcccaccuuggccucccaaagugcugggauuacaggcgugagcaccuggccgucaaagcuuaauuuaacaggaaauuuucuacaguaugcguaucccuauuuuauaaaauagagcugaacacaacuaaauugacacuauuguagagucaaaacaguuaaauauuguccuuuuauuccaccuaauauaacaaugcagugauauuguugggacuauugaaauacaagaucaaucucacauucguauagcauuuucaguuuauaaaacauuucaaguucauuaguucauuuuaaccuuacuuaaguucccaagacagauaaggcaggcauaucauacccauuuuauaaauuagaacccugaggccuauuggguaacuuucucaaaguccuacugcucacuaguugcaauauggaaguacacucuaggucuccagaucccuaccuccccuccccugcucuucccacuaugcuauuuuucacucaguauugaucugguuaucaaacaugaacuauguauaucuaaaauuaauauuaaauugugaagaauuguucuaaugaguaaaguacaucagcuuuguuacauuauuuugacuuuucaagacaccccacaaaccaaaugcauaaucauaauggcuccuugcuguuccagacaguugagaaugccaaauagguaagugaucuuauuuugcaguuuucuuugguuuuuaaaaaauuucucuaaaacuucuauuauauagacagggaaguuuaaaaauucuuauacagauauauugucuuuaugaaauguaacucagucuauuauguaaauaucauuguaguaguaguaguacuuaguaauuacguuuuuaaugguuuaucuuaauuuuugaaauuccuuucauaaaaguuuucaguguacacuacauuggaacuaauguuuaaaaacaguugcuagcugggcacaguggcucacaacugucaucccagcacuuugggaggcugaggcagguggaucaccugaggucgggaguuugagaccagccugaucaaccuggagaaacacugucucuacuaaaaauacaaaauuagcugggugugguggugcaugccuguaaucccagcuacucgggaggcugaggcacgagauuugcuugaaccagcgaggcggcaguugcggugagccaagauccgagaucacgccauugcacuccagccugggcaacaagagcaaaacuccgucucaaaaauaaauugcuaaagugacuugauguguuguuacacuuuggcuuugacaaguacaagagaacaguuguucagaaaacuggauaucccauccucuguagcugauaguaaacuguaacuuauaagugauugucauuuuuacuacuguauucaugcaucugucaguccaacaacuuuuuuuuuuuuuuuuuuuuuugaaaccgaguuucacucuucucgcccaggcuggagugcaauggcacgaucucggcucacugcagccuccaccuccaggguucaagcaauucuccugccucaaccucccaaaguagcugggauuacaggcacgugccaccacgcccagcuaauuuuugcauuuuuaguagaccggguuucaccauguuggccaggcuggucugaaacucuuggccucaggugauccacccgcuucagccucccaaagugcugagauuacagugaugagccacugcgcccugccucaacaaccauuuauugaggaaguacuacacauuaggucaugagcuaaguauuaguaucacuaaaaugcccaagacacugugauugcccucguggagcucagagucaaaagugaguaagugacacaguaaauaaaguaauguaaaguacuucugaguucaucuaaagccccaaugucuuuuccaagcuuagggaaaagaccucucccagcacucuaggucaaggugggaauguuaggcagggaaaaaagcuauguguucuggcuacgacagugguucuuuccuauugcuauugauaucuggcuuagucuagacauaguagagaaggaaucauuucccuuuuccacacacuuauuagauaaaacuuaauuucuucuagcuauagccucaaacuuaaaauaugugaaauccccuuacaaauuauauacagaaaguauaacuuaaaaauugggucauguccauauguuuguuugaacuagcuccauagaaguaacaauucaugcuuagauuccuguuguacaguuugaaaaccuauguagccugcaauauauauauagcuaauguucuacaaauacguaaugaaaaauaaaagcaacuuuaauacaaguuaacuauaauaaaauuuuaaaagaggggccuguaaauaucuauauugaaugcugaagauggaaggcucaauuuggaaugugcaauuggaaauaacccuuaaauuggaagggcuuuucuucagauaagcuuaaaaaagagcucuaagaaauggaagcaucuaaguagugaggguaguuaacuagucugauuuaaacaacuguaagaacuuuaaacaaguucuguaaacacauuuacaguacugagcuggauuuuauuuuaaaggugucagaagacccuccuccauuuagauagguaauuuuagaauuuauaauuauuuuagaaaaaauaggagcgggcaugguggcucacaccuguaaucccagcucuuucggaggcugaggcaggcggaucaccugaagucgggaguuugagaccagccugaccaacguggagaaacccugucucuaugaaaaauaccaaaaaaaucagccgggcgugguggugcaugccuguaaucccagcuacucgggaggcugaggcaggagaaucucuugcacccaggaggcagagguugccgugagcugagauggugccaugccauugcacuccagccugggcgacaaagcgagacucugucucaaaaaaaaaaaaaagaaagaaaaagaaaaaauauaugagguuaauuuagaaaguuuuuugaguucucaagaauuugcguuagggcauauauaucagaaaguuugcuauaaguuuaaaaaucauguacuaucacauacauuuaucucaaaaauaauaaaagaacuauaacuugaauguuacauauaaauaccuuugacucaaagcgacagauaacacguuagggcuucuuggaugagauuuuucugucuguucuaugacuccuuuuccugcucuguuuggugaggcuguccgacuuugaguaucucuauauggugaugauguggcacuaguaguuucuuuauguauguggguaggagauggagaugcaaucaauauuuuaaugucuuccauacggucuuuugucacuguuuuuaauucaucagugguggcagugguagugguggcauuagcaguagguucuuguauuugagucugcuggaauacuguaacugugcuuugaggacuugcgcuuucagggcuugcggaacugcuuucuaauggugacaacugaucgaaggaacguaacuggaagucaucauccauugggauauagggagcuaacaucuccaagucuaaaucuguguccuuuaaaacagcaaauacaugaguuuuuacaauggccacaccuuauaaauaaaaaacaagugaaacucaaagucacuucagacuaaaaauuaaugaaauuuaauauaaaacaaauaaguucauauaccugaguagaaaauggguucuuugcuucugugucuucagcaaaaaguuuuucuaccaauuccaacuugaauucauugaccauaucacuauccacauaaaaacaauauucacugggacuauuaggcuguaaaaagaaauauguuuacuauuuccugaagaagcuuccauauacuuugcuaguugucagaauuuucaaacuagaucucagaaaaaccagaaaacacacaaccaaguccaucguguuuaucaaauuuuauuuaacuaggccgggcucaguggcucacgccuguaaucccagcacuuugggaagccaagguggagggauaaugaggucaagagaucgagaccauccuggccaacauggugaaaccucgucucuacuaaaaauacaaaaauuagcuaggcaugguggcaaacgccuguaaucccagcuacucaggaggcugaggcaggagaaucacuugaaccugggaggcagagguugcagugagccaagaucaugccacugcacuccagccuggcgacagagugagacuccaugucaaaaaaaaaaaaaaaaaaaaaaauuugugaaaauagugacauuuugaagcuuauacugguaacuaauuuugccaauauauauauuucugacuauguaauauaacaucauuuacaaaauugagaugaaaagaaacaccuuauucuaaagaauaaaaccuauuugguaauucacaucccacaaugguaccuaauugaccaauuaacuagaugcuacauucacuggaauuuaccuuugaacugagaaggcacacuccuguggugacugagcuaccuaaaaaucucacuguuacugucgggggugggaguagaaaccuaaguuauuuuaccugcauauaccugaacgaauguacauuauuacuauuuuaagaguucugggcaagaaguuuaacaaaaaacuauagcuguguauucuaaacaagaaauuuugcuuuccucauucuaacguuuuuguuagauuuacuuuuguuagauaaaaaccaagaugaaucaaacauuuuuuuuucuggguaaauuaagcaaccagagcauaggauauauauucauucaacacaaggcugugagaugucaaauccccuacucuuagcuugucaguuuuauucaacaaauaccuaauguagaauuauuuaccacuuauuaaagcuuauuuaugccucauuuaucaaguuauaauguucagaucuaaguugcccuacuccugagcauauuuuuagauguaggaagcccuaaaauggaaucauucuagauuuagaaauagagcccugugugauaucucuaagucuuggccagccuagccuuuaaagauuauuuuuguguucauaggacaauuaauaucaagacagauccagaauaaaaaagaccaguuacuaaguauuuauuuuauguaacacuuguuauuuucauauuauacuuacccaaaauuucaaaauagugauggaaauuagacuaaauugggcaaagaauuuauaagguccuuucccauuuaaacccucguaagucuauugcuaccagacaguucuccaacucaaagggguaaugggccaggcaugguagcucacgccuguaauccuaguacuuugggaggccaaggcaggaggaucgcuugagcccaggaguuuaaaaccagccugagcaacauagugagaaccccaacuccacacacacacacaaaaaaagguuaaaaaauuagccaggcauggugaugcaggccuguagucccagcuacuugggaggcugaggugggagaaucauuugagccugggagguugaggcugugauugcaccacugcacuccagccugggugauagugagacucuuucucaaaacaaaacaaaacacaauaaaacaaacuaaaagggguaacagguauaggcuguagcuaccuugagcacacuuaguacuauucucuuuaaauguccaaauucaagauguuuuuguccuacugauauaaauaauagagaaacaauguacguuucaccuuuugguuuauauuaagcuaguuucuucccauguuccugacuaucuuugagccuaaaacaugugcucaggucuagguuaggcaguagcucuugcaauaauuuuaaagugcuaaaauucaaacacacacacaaauguaauuugugguucaaauaaguguuugaaucaaacuuauaaauacauucuugaauguuaaaaucugaaaguugucccuuucugauuauaucaugacaccuaccucaggugaacuuugucuagugcuuccaucggaaggacuaggugucugauccugaaucuggggcaugguaaaagaaaguuccagugacucuggauuugguucuaauuuuaaugcaacuucuugauugagugcagggucagcacuacuucgaaguggcuuuggcguuucagcgguggguaauggagacauugccaaauuuauauucuguaauuuuucguugggugaggggagcauuacaucauuauauaaugguacuuccucaaguugcuggucaucaguuucugugucuguggggaaaaaauaugagucaaucuaaaguauagaaggauuuuuuuuuuuuuuuacccaagacagagucuugcucuguugcccaggcuggagugcaauggcgcaaucuuggcucacugcaaccucugccucccagguucaagcaauuccccugccucagccucccaaguagcugggauuacaggcgcacaccaccacgcccagcuaacuuuuguauuuuugguagagacgggguuucaccaugguggccaggcuggucucgaacuccuaaccucaagugauccacccgccucggccucccaaagugcugggauuacaggcgugagccacugcgcccggccacaaggauuuucacauauaaaaaauuuauguucuuuuucacaaaagguuugucuaauucaucaaacaacaaaaugucaccaaauuuuccuucaucagaaaguuuacauacaauaguauaguauaaccauaagucugaguuaccuuuacaauccacuauugauaccgcgucuuaaucucuauggcauaaaagacaaaaggcaauaccaaccuuuuuauacauuaaaauguucucuacuuuaaaauugcaguuuucaucuucaaugcuugauguuauaguaugacuacuuuuuuauccuuuaaugcaacaaugccuacuuccauauaacucugcuaaacuguggagaaaaucugacagcaggauacagaaauagaguagccaggaaaaauuuaugugggaagaagaaauaccuuaaggacacuuugaagcacaauuuccaacaguauaaaaaagcaagaaugguaagaaauuacgggggcaaaaauauuuaagcaaauacauuuaagaaaacuauaaacauauauuagcuuguaauguccaaaugauuaccaacaaaaaccguaaaguaauguuuaguugaaauggggcuuguagcaacagacacaauuuaggggauuaacaaaaauaacuacucaccguugcugccaaaaucuaaagauaugauugugucuccagcggcuggggccagcaaaguuaaagcaucagguuccuucuuaaguuugucaaagaggcuacuuguaucuucugauucaacuuuggugaauagcugagucauuuucauaucugaagauucaaccgguuuaaggacacauucuguuuguugaagggagaaaaucaagucgugcugaauaauaccacugucaaaacaagagaaauugguaauucacaaaugagcacuugauacagugaggggaagggagacugugaaauggucucuuaaaaaauucugcuuuauggacaggaacauuucaagauuucuugagaugcaugaucacucaugcguacugugucacauuuaggguuuuaaaaugcuaauacaaaauaaagacccaauaaaauccacaguaugcaaccauaaaaaagaaugaaauaauguccuuugcagcaacauggaugcauccagagaccauuauccuaagugagauaacccaggaacagaaaaccaaaugcugcauguucucacuuguaagugggagcuaaacacuggguuacuuguggacauaaagauggcaucaauagacacugaggacuacuaggggagaggggcaaggguugaacaacuguuggguauuaugcucacuaccugggugacaggaucaauuguaccccaaaccucagcaucacaugauauacccauguaacaaaccuaugcauguauccccugaaucaaaaauaaaaguugaaauuaaaaaaaaaauccccaguacaagauaauuugacuaauuucaguuaagaauuucagauauccaggcugggcgugguggcucaugccuguaaucccaggacuuugggaggcugaggcggguggaucgcuugagccugggaguucaagagccuggccaacauggcaaaacccugucucuacuaaaaauacaaaaaauuagcccggugugguggugcacaccuguagucccagcuacuugggaggcugaggcaugagaaucacuugagcucgggaaauggagugagccaagaucacgccacugcacuccagccugggugacagugagacuccaucucaaaaaaaaaaaagaaaaaaagaauuucagauauccuuugagaagaguaguaauggcaaggcaauuuguagucaaguacaugaaagacaccaacaaaucuucagaauuguugugcugacacacauuaugaaauuggcacaaaagaacucuuuggcaucaauaugugaggcaugaucuaaggauaguccuaaagauacacagauaaaugauuaagaucuuucuaagagaggggccauauuuucuuuggugguaagaauauaaggugauaccaccuacaggauacggcugaagagggaugaugagcaauaguuuaucuucacguuuggcuuaaauguaaauuauuccuuuaauuaacguauuaaauguucacuaucugaaaugaacugauaaugcaaagauuaaaauagccaacccuugaccuuaagaaauuuauaacccauugugaaaguagauauguaaacaauuaaaauacacugugauaacugcuaaaauagagaaggcuugcuucacugagaagcuaacaagcugauacuugggaucaaguggcauuugcuaggcagacuggggugugaggaagagaaagacauuccaaguggaagauucuuacauaaugguaaagucacaaaagaacucuguggcacuaauauuaaaacauuaaaggauggugucagaaguagcaaaaauaaaaacugcccaaagucuuccuaagaggagugacccuagauuuuaaagggaaggcuaaaucucuaaugcgugaguaugaugguaaacaaggaugcuguacaccuaggcaaguguuuaucuuggaaaugauaaaaagaucgcuaaaauucuaaggaaaauaagaugaugacauauccacacuagaaagcuuagccugguaguaaugggcaagauggacuagaaugugguaauaauguggacagguagacuagauggggcaggagucuaguaaaauagaucaaaugaaaaauuaaauuuugauguacauaauauucacaagccaaagagcuaagugaagaguucaugaauauacaagagccauguauuacaucauauagcuuauuaaucucauagaauuucuuuucuuuuuuaaauuauacuuuaaguucuagggugcaugugcacaacgugcagguuuguuacauauguauacaugugccauguuggugugcuacauccauuaacucaucauucacauuaaguauaucuccuaaugcuaucccuccccccucccuaaucucauagaauuucauuuaauuuucauuauaaccuucugaaggauuaucuacauagaugaaauucagaaaaaugaagagacuuccccaaggucagggagcuaaugagugguagagcuaugauacaaaucuaggccaggauucuuccuacaaaaagaacacagcugucuugagauaguauaugccgauaucuguauaauuagaccaaaccaaucaauggaucugguauuuuuuucauggucuuuuuaaaaauaggagugaagguauggggauagacaacuacugacaguguuuagcagcaucacuguggaauagcuggacuggaaaccuaggucagaguauagaaaauaauaauuugguagcgauguaaaagaauuaaaauuuaguuaauauuuauuaucuuaucuuccuauaaaugaacagaguauccaaaaagaauuacuauuuguuccccaaaaauguuuauuucucaaacuuacuuaccucacaacguaauucacacauacaaugcacugugguugagaauucuugguguuauauaugacaguugcuugaguuucaacccagacauauccaccucuuuuggcaagcauccuguacuguccuguggugacuuguccuuuaguaaacacuaggggggaaaagaaaaagaaucaugcagagaaaauauuuuaacuuugaauuuucaauuaaaugaacagaugcugaauguucaucauuguuuuggaaaacaaauguuuauuuaguggaaucaguuguaacugcuuacauucugacagugcgucccagaauagcugaaaauguacccauuuccuuuuucaaacccccuaaauaaaacuccuuugcugccagugagcuaagugaagaguucaugaauauacaaucuucaguaacuaaaauuccuuuaaugacuuagguuggugucagauuagagaauaaucaauagccuuuuucaagaaaauggugccacaauaacuuccuuaaauucugacuaugguuuccagagaaccaaagaugcuuuaaaaagcuauauguagcauauuuaaauauaaauugauaccacauuguaagucuuuuggcaauuuaaauuaaauacugauuugggagaaaguacuaaauaaaugcuaaugaugguauuauuuugaggauugggguguccugacugcagacuuggauuuacucuugaguucaaggcugaucagucacacaaacucagugauauucagguauccucaagcacagugggaagucaugcauagguacagauuaaacaggugagauaguccaaaguuuaacuuaucuuggggaucuuaacauucauuugaguaaaauucagaaucaaaucuuaugucaaagguacuuguuuugggugacuauaguaaaaaauaauuuaauuguacauuuuaaagaaacuaaaagaggccgggugccaaggcagguggauaaccugaggucaggaguucgagaccagccuggccaacauggcaaaacccugucuauacuaaaaauacaaaaauuagccaggcauggugguacaugcuuauaaucccagcuacuugggaggaugaggcaggagaaucucuugaacccgguaggcggggguugcagugagcugagauugcuccacugcacuccagccugggcgagagugagauccugucucaaaagaaaaaaauaaaauaaaauaaaauaaaaauaaccaaaagaguauaacuggauuguuugucacacaagauaaugcuugaggugauagguacuccauuuauccuuaugcacugcaugccuauaucaaaauauuucaugaacccauaaauauaaauaccuaacuaugcacuuauaagcauuuuuuaaaaugguacuuauuaccaaaggugauguucaccaccuucacauucauugauuguacaaauacuuucugagugccuuuuacauaccaaccacuguucugaguauuuaugugaauucugaaaauuaugcuauucaauacucuauaauauuuggauuuucaaaagucuuuguauuuaaaaugccaggaaguuuuuucuaugauuaaaugauucuauuuuuacugauauuuguugcaacacauacaaaacacaaaauggucaagaucucuacugaauaggccuguuaacacauuuagucuagaacuuuuaaccagagaauuagauggguagccaaacuguacagagguugcaacaguuaaguaauuagaauaucucugaguucuuccauuguacuuacuaucaugaugaguuuuggucagaugaucagaguccaaagcaugauaauauucauaaauugagcggccuaaaaguucuucuggcucauaucccaucaauucgguaauucuguuaguaaaaaauacaagauuuaagaaaaaaaagggagacacugauaaagaaaaauuuuucuccucccaaguuaacugauaggcauuaaucuuauggacaagugaauuuucaaaaaugagcauccuccuuugcuuagaauaaauuuacaccucaccuuuggcaacuacaguuauuaaauccaacaccacacauuucuuuaaguccucuagauuccuccuguuauuuaacucuuuaauccuguucacccaaacuuguuaccuggucuuuuuuuuugagacaagaguuucccucguguugcucaggcuggagagcacaaugaggugugaucuuggcucaccgcaaccuccaccuccuagguucaagcgauuccccugccucagccucccaaguagcugggauuacaggcaugugccaccaugcccagcuaauuuuguauuuuuaguagggaugggguuucuccauguuggucaggcucgucuugaacuccugaacucagguaauucacccgccuuggccucccaaaguacugggauuacaggcaugagccaacgugcccagccuacuuguuaccuauucuuauuacaucucauuauacauacuuuugguaacaaggcaggguauuaauaaacagauaagaaauacuacuaaacuacaugguaaaaguuauaaagguagucacuuacacuuauuuuaaaauauagauaaaaucuguaacauuucuucauaaagccaaauucuuuauguaguaacuuuuaagccccuaggcaacaccucacuuugagagaucaauagccauuacacaauucuaauaucaucaaccaaagagcaucuacacuaaaugggaacuaaaggaauuauguugguuuuugaagaugcucuuguacuuaguuuaguuuuuggcauuacaugaaauuaugggaguaauuucagauaaaacaauauuucaaaugaaaauagauuggaaaacaauccaauuacccuaucuagcucgcuggcagagaguagaccuuuauuuaagacagagacuagaucuuauucucuguaagcaguaugaaauggcaaccaugacaugaggaagagaaagcugucuucuuaguaccaugcugaacagaaauacucucuucucaagucuuucuaggagcaaaacaugaguuaagcuuuuagauucucagccuuuagauuucagaggacuuuccuaccgaggugcaagcaaaccuuauauaacaugcugugugucaaaaaaaaaacccuaccuaacuacaggaaggacauaggcaagauauucuauaaagguauaaaaguaacauugcuuguguucucacacuuaaaggcaagaucuuccauaguuuauuacaaaauaaauauacaaaggaaaagcugauuugccaaaaaccaaaccaaacucaacucaaacccucaauucuuuacaaagggacaucucuaaacacagcaacaccagguggcagcauuauaaaggaaaacauguuuuuaaacaaaaucagucauauuucuugaaauuaugcuuuaaaaauaauucuaauuggucuuauauuuuucuguuuaaauaaaauccccauggaauuaaaaacuuuuucacuauucaaaucuuaauaugccuaugugugcccggcauuauucuaggcaugaaaaugcaaagacaaaacucaauacguggcuaaucuuccaguagauguacuguacuacuuaggaaauaaugugauaaaugcagugaugagaaucuauuccauggaauccuauccaugcaaaggaaugguagaaugaggaacagccucuuauaggagacuuaugacuagagacaaaggaaaggcaaaaccgcuuucaggaaaaagguaugguauaaacaaaagauuuuuaaaaaugcuuaacauggugcagguaacaaagauucuauaauaugauuaguggagacagauaugagaugaugcugaagaaguagguagggggaucagauuaaugaagguauuguuuauauugucauaggaagcucugauuuaaucuaaugucaaucagugcuucucaaucugagguaugucuaucacuaaaagauaccaagaagucaaaaauauaaacuguauaugcuuuccuagaaggucaguuuuacacauauuagagcaagaaaagugagguuaauuuaacuuuagagaauuacauagguuauauucuauaccaaaagggucgggguguccagaaaauaugaccaaaaaguguuuuuaauggacuaggaaacccaugaucuaaagcaguauacuacucauuuauuuugaggcaggaacuguucaucuucauuucuacuuuagugccaugaacauaguagaugcucaaauaaaguguugaauaauuuuaaaugauuauuacucaguauaguaaauagcagcuauuuguggaauauuuuggaguugaggagcuugauauguuagauuuucuuaaaauugagcaaaauuuuuuccauagcuugguucucagggguuauagaugcaagaaguuccuggaaagagcucuaaaccagaaaauaacagucugcuggucaaacucaaaacugucuugguugauauaugagcuggcugucuuuacuguuaccuccugucaugaucauuuugcuaauuuucugcuauaacuagaggggaaugucacucccuuucucauuuuugcuccacuaccuuccuuucucccuggccuccucucuacuuuguuaccuuaaguuuucaaaaaaauaaaaaauaauuccucaaaauaggauggaaaucucugucccaucauacauuuacaugcuaguaguaaacaccuuaaaauaauucuuagcuuuucuauauucauuuucuuaaaguugacaccaguagugaagcauucacuaucuguacuaggcacucaauggacuccuuuaauccugacaacauccuucugaggucuuuuuuuuguuuuguuuuuguuuuuugagauggagucucacuccgucucccaggccggagugcaguggugcaagcuugguucacugcaaccuccgccuccuggauucaagcaauucuccuaccucagccucccaaguagcugggauuacggacaugugcccccauacccagcuaauuuuuguauuuuuaguagagaugggguuuuaccauguuggccaggcugguuucaaacuccugaccucaggugauccacccaccucggccucccacagugcuaggauuauaggcaugagccaccccacccagccaugauucuuauuuuauagauaaggaaugugaauuuuacaacaguuaaguaccaaggccaaggccacauuguaaguaucagagcugcaagccaugagugaaucuaacaucugauuccaaagacagaguuagggccagagcauaaauaucuuuguuugccaugcuaaguuuagauuguauuguguaggucuauuuuuuuucagucuucuaaaauacacaucuucuuuugauaaaugaaaaauuuacuucccucaucuaguauuuuuauaaacaaaauauuuuugugugcaaagauggagggaagcauuugaggcauuuucaacaacagaaugacaugaucugauuuucacauuaggacacccacuuucuggcaacuuagaugaaagauuauaaggguacaaaucuguuggcaaaaaggcagcuaugccaacaacucaagucaagaguaauaaugagcuaaugaauucaauggcaggagugcaaggauggaaaggaggaaauggaucaagagauauauguagauaguaaaucuguaagauuuagacaccaacuguauguagccaaugaauguaaaagaaaaguuacagaugacuuccaaaguuuugcuggagucauguguguauggugguguauuaaaccacaauaagcauuauaggaagaaaggcaguuuuugaugaugauguuguuugggggcaguaguaguacaguuguuacaguaauacuuaguuuacaauacagaagaauauccagauagaaauauuaaguuggcaauuaaauagaauuaguuacaggaagaaaugugggaaauaguaauagaaaccaugggcaagguugaagcuucucagggaaaauauguaggaugaagagauguacaaacacuuggcuuucuaguccccaaccuaagguaaucuaucuuugcucaaaauacacacugcauaucuuugaaauucucuaaguaaguagagccccuauuggggaaaaaaagacucaucuuaacuucuggauagcaccuaguaaaguaaguguucauaguacagaguaaauguucaauaaauguggcugaauuaauuuacaaaguuaaucuaauauuauaggauguaucauucuguucaauuuaguggaaaguauaguuuaacauugaguaauuuuuuuuuuuuuuuuugaaaugggagucuugcucugucauccaggcuugcagugugguggugugagcucagcucaccacaacauccaccucccagguucaagcgauucuccugccucagccuccugaguagugccugccaccacgucccacuaauuuuuguauuuuuuaguagagaugggguuucaccacauuggccaggcuggucucaaucuccugaccucagaugauccaccccccgcuugccucagccuuccaaagugcugggauuacaggugugagccaccaugcauggccagcgcugaaucuuugcuauggugaauauucaguaaugcuguagacuaauuaaaaauuucaaauucacauuuuagaucuaauuuaccuuucaucacaauaagaaaauuucauauccaggcugugucgacugaggaaagucuugcuaucuaaaggaauuucaauauuugaugggugaggaauggguucacaaaucagcaccaagcaggucauaggugguuucuuauacccacacugagguugguuacuguugguaucauauacgugaauguggccugugcagugcaauaccuguguaugaagaacaaagcaguuaaaaaaaauauuuacaaugcuagggaaaaaaaaagcagagauaaguaguugagucugacauggccaguaagcuuugauaaaauuuacugucacuaguggauuaaucacguuuuugaaaaucaaugaacauuuuuccuaugauaccaccuaugaccuacuuccugcccagggccuauacauuacucuuuaaaaaauuccccucguauaaagucuaggcugcuuuuucauucaucucaucaucauggcuguuugauaguuauuucuugcacugaugacuauguuucaacauugaacaaagauauaaaaccaugauuaauagaaaauuaagcccuaucaggauucaaauauuguguggcuggcaaagccaacugauuaagccuggaacaccagugccacaauucacguaauuuaaguuugugccucaaauuggcaaauuacuacacgguucugcauuuuggagaucacaugcaaaugaguugaagauauaaauguuacauaaccaaacaccauggaacuguaaaccuucccucacaauucuaaaguuaucuuaauacuacaaugucuauguauaaauaaaguguauaaucaaucacaaauaauuuucacuuaccuuccauguugcagacuuuauguucauaguucuuccucggcuaguuaggguacacuucauucugagaaaaaagcuucgcuguguguuuuguucuuuacccuuuuucacaaggccuaaugaaagcaugaaauaaaguuuuaaagcaacuaaauauacaaauuuguuacaauaaaaguaacaaagugcccaucaccuagaucaacugaauacccguucaauuaagucucagcaugaacacaguaauucauuccccuuuuacucacuccagcacacccaagagaucugacacacacuacucaguagcugugauucccugaguuggcugaaagauaauccauauuugggauaacaguuaaucauugaagccaguaagcuuagucaaauacacagaaauauaaaaaugguaugaguuugcucuuuaacugugcuaucgguacacaagaaucccuaaagaaagaacuucagcaaacucuuccuauccuuuccugaauguguuagcucaauuucuaauaagcacucuaugucuuuauagaaccuuuaaaauaacaacuuucuuuuuaauaacaaauaacauuuuuacguaucuuauuuuuuuccccuuaauuuaucuaguaaagcaggcagaaaauuacuucuacuuuguuacuaugagaaaacaacaacaacagaucaaaugacuuaucaaaaguuacagaaauaggcagggcacgguggcucaugccuguaaucccagcacuuugggaggcugaggcaagaggaucacuugaggucaggaguucgaaaccggccuggccaacauggugaaacccugucucuacuaaaaauacaaaaauuagcugggugugauagugggugccuguaaucccagcuacuugggagacugaggcaggggaaucacucgaacgugggaggcagagguugcagugagcugagacugugccacugcacuccaaccugggauauagagcgagaauccaucucaaaaaaaaaaagcuacagaaauaaagucagaauuaaguaaagucuauucacuccaauuucaaaccuucuauaacuaaaaaugagauuauauuuaggugacugagaaaagagcaucuugcugggcgcaguggcuuaugccucaugccuguaaucccagcacuuugggaggcugaggcaggaagaucacuugaggacagaaguuugagaccaugcuggccaucauggcaaaaccccaucucuacuaaaaauauaaauaucagcuaggugugguggcacaugccuauaaucccagcuacuugggagguugaggcgugagaaucacuugaacccgggaggcagagguuguagugaacugagauugugccacugcacuccagccugggugacaaagugagacacugucucaaaaaaaaaaauuaaaaaaaauaaggaacuagccucuugauuucuuaucuucauuggucagugugcuucagaacacauauaaaaauauuuauuauucagaaccuggacuagauauuguaggcaauacaaagaugaguaagauacgccaccuuuccugaagaaguuaaaaauguaguagauauaguaaggucaacaaaaacacaauguagaguugguacuugagacuuauaaaaaugcuuuaaagaaggauagggagagcuuagaagauaauuucuagucaagggaaaucaagaagucuugcuuagaaaaagagacauuagaaugucaguaaguagagauggguuagaaggguauuccaaggagaaguaagagaaugaaaagcacagagguaggaaaaauaggacauguuugaaaaacagcauauaguaguuuguccacaauguagaguacacguagaagaguaguaaggcaaagcuagaagggaagguuagggcuguaccacggagggcuguggauguccacauggaguccugccuaaauauucaacaaggggcuuuaaaaaagcacaaucaguaacuuaaggaaaauuaacuuagcagcaauauauauguuagaauuaggugacuguaaugagagggcugagccaguagaguaugagggaaaagaaugguggcaaaagacaaaugaagagguagaaucuuaauagacuugaaaacugauggaaauaagacaggagagaaaucaaaucuggaaacuguaaugcuaguauauugaaaaaacacuguaaaguagaaaagaaaugagaguaaguuuaaauguaggcaugguuaacuagaaaugcuggacucuugaggaacaagaugaauuccagccuauacucuaugaauaauggaacuaggaaagaugggcaguccuggugcugaugcaugccauuuggguuuacuuagauuaagaagugaauuugcccucccuggaaggauuuaagaguauauuuuuaaaagaugccaugagagcaaaggagggggaagggaaggagugcgggagggagggggagagagagagagagagagagagagagagagaaugugugugugucguguguguguagguguugaugguugugguaguggcaguaaagauccacaugcaaaauccuuuggguauguucaguccuucauaaacuaagcuugaauuauacugaccuuugaaaggaacccaaggccuuugaauggggaccugcagauuaauuuaaaaaucaagguaacugaaaaguacuaguguuuuccuaaugaggaaaaaaaaaacaaaaaacaaacaaacaaaaacaaaccauuaaaaaaaccuaaauuuuaaacucucuaaaaauaagucauauuuuguauaauuuauaaauucuaaagcauuuuucuagaauuuauuuggaaaauaggacuauuuguauaaacacaccacuggcucucaguguaucacuaaaaugugaugcuuugcaauagucccugauuucuaaaagagaaaaaucugcauuuuaguuucccaauggaacaucaauaauucauuaaccacauuaguaaugauuucaaaauguuugugugcuuuaaaaaagaacauuugguucgaaacauacauuuaaacuauauuaagacuaucugauuuagaauaaugcauuaacaucauuaccaaaucagaacaagacuuccuaauauccauccauuuauagucuagccccagggaagcacugagcagucaauauaaaccucaacucugcacauuagaacucauauauuaaacucauugacaacccacuuagguccuuguucacagcauauuuacuccuccuuuauacagaauucuaaaaaguaugcauuuguuuuccaaauuaacaguaaaaacacaauaugaaauuuaaaaacaggagucagguccugcugacagagugaaaaaagacagaaugugagaauucaagaauaugaaaagcgcuccaaaggacuaaugagcguggacucugaagccagucuacugaaguucagcccaagcucugccauuuacuaaccaaauaauguugggaaaguuacuuaguaacucuguaccucaguuuccuaguaaaauagaaauugucuaacaguuaacuucacaggguuguugugaggaauaaaggaguuaaaagcauauaaaauaggaagaacaguguccuggcacacagcauucucucaauggagguuagcuauuauuauaauaaaugagaugaaaaagaaaaccucaaaaauuauacaaaaaguaaauuugagguuuuauaauauagaagcaaacaaacguaugcacuuaaauuggagagcaacaaagaacagcagaacauaagaaauuuuccuugugguaacuuuccaucaugaagaaaaguucaauuaugaucaguauacacugcuuaagaaggcacaaauguggaaagacuuucuuguuuuuguaauucaagagguacuuuccaaaaaucuuagaacacaugauuuuuuaaauaauuaugaucaguauacacuguuuaacaagauaaaaauguagaaagacuuuaauuuuuuaauucaagagguaguuuccaaaaaaucuuggaacacuugauuauuuuuaacaauuaauuccuaagaauuagaggucuuacucucuauuuuuguuaauaugugggcauccacaauguaauacuuuauaaucuaacuacacggucucgaauuauugagaacauccaaagaagucaaauaagcaguuguuugucuuaaaauucuggugaacuuuuuuuauugggccuuagacucaaacuggcaccucaacuuuaaugacugucuaaaguccuauuaucugccauuuguauuauaauuucuccuugccuuaaugguguauuuuaauuuuuaacuccaccaggugugguggcgcaugccuauaauccuagcacuuugggaggcugagccaggaggaucacuugaguccaggaguuuaagaccagccugggcaauacagcaagaaccccuaucacaauuuaaaaagaaaaggaaaaaaaagguagccugggcgugguggcucaugccuguaaucccaacacuuugagaggccgaggugagaggauggcuuaagcccaguaguucaagaccagccugagcagcauagugagacuuugucucuacaaauaauuuuuaaaaauuuagcugggcaugguagcacgcgucuguggucccagcuaacuugggagacugaggugggaggaucgcuugagucccagcggucaaggcugcagucagcugauugugccacugcacuccagcaugggcaaaagagcgagaccccaucuuaaaaaaaaaaaaaaaaaguuauuuguaacucucuuggucaugauuuuacuuuuccauuuuauuucucacacccacacaauuauuuaugcaauuaggugggcuuucaaaaugaaauuccuaaaaacuaaaauaauaguuuuaacaaagaauagacauuuuauuaaacaugaaauaacauuuugccuuggguaaguacaauagcaaaguuuaauaauuagcaauaguaucuuauuauguaaaaccaccugucacauuaaaucaaacaacagacuuuucuuaccauuucuguguguaagcauuucucucauuuccucauggucacauggaugaguaaaaucaaacacacuguguccaguuaguucaaacuguaaacacauuuuuaaaaauuagggcuagaucauaaaaucauaaaaacauauagaagagcucuuaauaugugugcauuuuaccugaguuaaucccauguauuuguucacauuaucagaaauguaaaucaugucaccaucaucugugagaaccauaacaaaaccauccaaggcuuucaaauaaaagcaauucaucugugcuuucaugucaucuucaauauccaaaucaccuaaaaagggcacaagaagaggaaaauaauuaguuaaaaaguuguacuuaaaugauauaauauuuagauguuuuuacaaaguuuucucgcagacacuuuauuuaauauauacagccauuucaacacagaaaagugcaggccagaagcuagaaaaacuauaauuagaugugccagcugcuuuucaugauuaaaguaaugcagcaaagcaaaccauagaagaagaaagaagaguaauguuuuuuauuuauuuauuuauuuuauuauuuuugagauggagucucacucugccgcccaggcuggagugcaguggcuugaucucggcuuacugcaagcuccgcccucugaguuuaagcaauucuccugccucagccucccuaguagcugagauuacaggcaccuaccagcgugcccaucuaauuuuuuauauuuuugguauauaugggguuucaccaucuuggccaggcuggucuugaacuccugaccucaugauccacccgccucagcaucccaaaguucugggauuacaggcgugagccaccgcgcccggccugagucauguuuuuuaaaggaagaaagguagauggaacaggagaaaaaggggggaggggaaaagccaguaucuuauuccugacuaaagcuuuaaaagcagguaauaaaaaggauguuauauuagaaaagaauugagaguauguuuaagagaauaaagcaaaacaaauuaugugcauaaagaaugauuauuucaaagaauaacugaugagaaaaaaaugaagcuugauaaaaauagugagaauuacagaaaaauuuuuaaacguguacauaucacaauauaaagagguauacaaaaucaaaacauugcgaccaccuucuaaaaauaauuucuauuuacuucuaacuucuaauuuucaggccuauuuauacccuuguaaaauaacucaccagcauccagaaguuuccucacacgcaaauagcugaugguaagccucaucacagaggccuuaucaagaugcgaacucacauuauguggaaguggcaacugaugagcaagcucauaaaaaacuucagauucuuuacuucgccgagaucuggcugcaucucgagacuuuucuuuucgacguucagaacuuauccuacuuaacaacaacaagaaaaacacgagauggaaaguguauacaaguuaguuugccuuaacuugaauaaaacuuuacauuucugcuuaucacagaaggauuagaagaugccauguaauuaaguuacauggagauuugucuacuagauuaauguacuuuuauaaagggcaacuauacaaauuuuggauuacugcacacauaaggaacucucacaaaaaguccaaaaccaagcuuuaaaccugucggaagcagguguuuccuccccagcauauguaauuggagagaauguuuuuauuuuaggcaaaaauuuaaaguagccuguacaucuaaggcuguacuucauagaauucaaaaguagucucaauacagagaaaccacgauuaaggcuagagaaacuaccuaaaguuguacauaauaacuugaaaacaggaguuguuagcagguagaacgguaauagcuacaaacugauuucuacuuguuucuuuagacuccaguacuuucucacccuuuuaccacaugaauaacacugacgauaagcuauaggaacugacauuagcagcuauaagccagugcagguugccuccucccuuagcagccccuuaucuauuacuggcacaacaggugccaaauaaaugcaggaauauggaagaaaaaaagcuguggcacacacaauauccagaauuuagagggauagguuagcaaaaauaaaggugucaauacaaugacauaucuucagggaacucuuccaagaaggaaaucagaaagauuuucauugucacaccaagcaaaagcugucuuccuuugcuuaacugccuagugacaucuaauagcuuguugaauagcaacaguuuauuaaagguuaccaugugccaacauuacccuguacuaggugccuaguucucucacaaccuguaaauagguuaaauauugucccuauuuuacaaaugagggaacuggcguucaauagguuaaaaguagccauuauguagcaaauaggauuugaacccagguguuuuaaagucuuugcucuuccacaguauuucucuucuuaauggggaaugcugcuucuacuuuaaacacucacaugaucuccuaugccccucaacucacuccuguuaaauagauucuucaccaaauguuaaaaacagcuauuaugauuuagugagcauugggcaguaugcuaaauaaggacuuuuagccagcauuauuuuacuuaauccuccuuacauccugugaaugaaguaccgaauugucuccaccccaaaucucuccuccuuccaaaugaucugcaaaguugaaagguacaaccauagaagcaacauucuggaguaacaagcacaguucucagcaaaugcucuuguuacaauauaacauguuguauugugacaauacugauacuaguuuuaguacuuacucaaguuuguguguuuauaggacuuuuauacuuuaauaaggaauguaagcauguuauugaacuuugauagaaaaauuucaacucaagcaucuagaucaauuuaacuugaguaccuugaaauuuacggugagcuauuaaaaacuauuaucuucaucugguuagaugguggaggaaaaaaaggaagaaacuauuaucacuuaaaacuaguuauaugaaucuauaugaacuauaacuaguuauaugaacuaggauuuucucaaugcuguacaauaaaaaaaaauuagucacugaggcuacaugaaaaugcaaaugccagcagucuguaauuuuuucauuucacugcauuguucucuguaaauguuuucaauuuaaacuuaaaaauaaaacguaagacuugaucuguauaagcagaagaguaaaauaaaaaaacaaguaugaugauaauaacuccagcauacacuggaguuccauacaccauucccaggauggggggguaucuagcaggucccuauuggcccuaacagaaaaucucucacuuccuccccaacccccuuaaguuguaggugacaggcagugauagcugugggaaauagauuucuaucugguucaaauaaagccucuaaaauagagugauggucaauuaucucuuguuaaaccugaauauuaguucaaaugccacaaucauuccaggcguucuuuguuaccuaggcuggucuugaacgccuaagcucaagcaauucuccugccucagccucacaaagggcucaaauuacaggcuugagccauugugccuggccaaaguguucagaauuuuauaagcaacuuacuguauuuuuucugaaccacucaacugauguaaacuaccaauaaaugacuacccaaaugaaacacuuggugaaaaaauugaaaaccuuauaauaugugcuauauaugcuuuuuuuuuuuuuuaauggaguucugcucuugucacccaggcuggagugcaauggcaagaucuugguucacugcaaccuccacuucccagguucaagcaauucuccugccucagccuccugaguagcugggauuacaggcaugugguaccaugccaggcuaauuuuuguauuuuuaguacagacagguuucaccauguuggccaggcuugucucaaacuccagaccucaagugauccacccgccucggccucccaaagugcugggauuacaggcgcgaguauaugcuuuuaaaggguauccaaucaagcuaacuauggugauggaaugucuccaguuccucuguaauacacguaucguccagaacuucaaagauagcaaugacuaucuaaggaguggcaauaagugucuaagacaaauccauuagaaauuugagguuagauaaagcaucuaaaggacaguauauuuaaaagcuaguguagacugaaaauaagacugaauuuuggaagaaaaccagccuucaagaaaacaacuaauauagaguugacaaaccuauauuagaugaaggugauaaaaauuauuauguccuuuaucacacaaugagucuagacagaaaccaaucaagggaucuauaauaaagauuuaauggaaaaaucuucaugauauucuucauaugugacuacuggaggucuuauaacauuucuaaguaagcuuaaagcuuaaagcuaaagcuucugaaguucuugugaguuucagcauuuaaacugcccggcuucuugucuagucacaggaaggcuaauuuuaucaguuuuauaccacagaauuacaguacugaccaagaauuauuuguuagaccagggggucuaggucccacagagaugaauccuguacuauuuguuuuacugcuuacauugcacaacagaagauauguagaucagaaagaaguacauuuuccacaugcaaauaaggucacuauauuucucuaaauuuuauaaauugcaucuguuuuguuuuuaaguacaggucaagugaaguucuucugcugauauguucugcuacugcauaagguacuauauuucaguuaagaguacaguuaaaacaguuuguuuacccauuucuacaacuguucuagaacuaaaguuggaguauacuacuggcaaaauagcucaaucuuugugguauuguaguuuuuacaugcuuaccauuuuauuauuuaacauacaguauuagacacaaaaguaacaauuauaucuugaaauuauuuuguauaggaaauauauuuagaaaaauaauuuugagcccgucuuauuaagcuucuuguguacaaaguucaugaauaagcaagaguuguuuuauagagaaugucuauuguucuucagauuaagaacauaaaauauuuagugcuuuguaguaggucaguaaaaauuaaaaaaaaauaaaaggacacaaaauaauuguaggcauuuaaagucaucuuuucguauugcacaaaaagccuguuagcauuccuaauuguaaaaauaugugacuucaagaacugaaguuaaaccauaacuauuuaaaaugugagcagauuaucagauuuacuucuaauaaaguuaauguaccucaauuauguuauuuggugaaauaacucuuucuggccuugaagguacaaguugguuuuuguuguuuuugcacuugcgucaguauuucuacaggacugacauucugaagugaaauuucaugauauaaaaaaugugcuacugaaauuuuuuaaaauacacaauagcuuuccaaaugguucugugcccauuuuugucucugccaguucaugaauguguauaucaauucccccaugcacucugcaauauuauauauuacgcaucuuuuuaaucuuauuaauuucugcugagcugauaggugagaauuauaucucaucauuuuaacugcccugcacuucuuaaagucucaggcccaagaaaaaugcaaagaaaaguucauguucacucuucaguuggcauuuuugccugcaguuuuauuuucauuuuauuuuagagacagagucuugcucugucacccaagcuggaguacaguggcaugaucauaagcucacugcagccucgaaaucgugggcucaagcaauccucccccucccuaccucagccucccaaguagcuacaggcacacgcuaccaugcccaacuaauucuguuaaauuuuuugcagagacggaaucuauguugccucgacugguccugaacuccugggcuaaagcgauccuucugccuuggccucccaaagugcgaggauuauaggugugagccacccaaccuggccuuugccaguauuuuuaaauccaaacaccuaugcauggugcuuacuaauaacacagugguauucuaaacauuuuucaccuauuauuuaaucuuuauuauuaucaccauguuacagauaaggacccuggcuaaauagcuuacccaacauuacuccguuaauaaaugguagaaccuguauuucacucaagcagucugguguccacgcgauuaacacuagacuauguugucucucaaaaacucauccugauuaccaaggcaaguauuuguaagucuaggcuauuauuauaaaguucgaaauuugccuacuucacaugccaaagacauaaagaaggaauuauaggaguuggcuucagaauuuaggacuugaccuaagcuauucagagaaacucagaaccaggcucuuucuuggaguuugcuuauaaauccaaaauccuaacugaaaggcaccuacaaugguaauagaugcucucugcucuacuguccagcagcucuucaaagcaagguaaucccuuccgguaaugccaaucauuauggcgaaagagucaaaagaugguaauucagucuauacucccaguagacuuuauuuguacagagcagcuauuucaauaucuaaguucaacauuguugguguuuuacuugcucaacauuugucuagcagucacagaaacuguuuuuuuuuuuccugagacggcauuucacccuuguugcccagacuggagugcaauggcgcgaucucggcucacugcaaccucugccuccuggguucaagcaauucuccugccucagccucccgaguagcugggauuacaggcgugugccaccacgcccagcuaauuuuuguauucuuaguagagaugggguuucauuauguuggccaggcuggucuggaacuccugaccucaggugaucugcccaccuuggccucccaaaguguucggauuacaggcguugagccacugcgccuggcccuuccuuguuguuuguacucauuuuuaaaguuauucuaacuuguauuaggccaaauuaaugaagaaaggcuuaaguuuuuaaaauauuaaaaauauuuuagaucuauaccuaaagcuaacacacauacuauaaugaugcagucuccuaacaugaggugauuuucugaaacuaacugguuuuuaagugggaaggguuuuguccuccagaauuuuguauaaugguggcauaaacacuggaagguaacucucaaggucuaauccucaagguuuuuaauuccaucauuucccacaggaaaacaaauggaaaauccaccaaguucuugguuuguauuuugcagcauauuugaaggaauuuuaggaacugaaauaccagcaaacgaauaaacaaaaaguauaacaccaucaguacuuacuaaaacaacaucucacauuuccauaagagaauucaguuacuguucuuuuuccuuaaauggcuuugagcauugucuugcuguuugcauaagacuguuuacuaaccugaguguuuucacagauuugggaagcuuagauuuuugaacguuccagcaaacauucaauuuggugucagcuugacauuaagauauacuccuuacacacagcucuacucuauauuucacaaugugcucaguuaaucuacuuugauucuauuuuuauaaaucuaaauaaucuccuauuguuuuggaaaaaacucuccaacagcuuuuuuccccccucugcucccacaccacagcaaucaacaacacagaagacaacuucugcaacccuaucgggagaggagggguucucuccaccaccaggugagcaaucaguucugcagcggacaccaacuggguguccuucaauucaauucuaacacuaucuaccuggagacagugucagguugagggcucaguccccaagacugcccccucaacaggaguugcaagucuggccucaggaacuucugacugacaggcuucaaaaguugggauucucacaaacccaucuuugcuggagcagcucacagaacucagggaaacauguuuaccaguuuauaauagaggauauuaauaaggauacacaugaagagauguguagggcgagguaugggagaaaggaugcaucuaucaaguaccaugcacugugcuagguacuagaaauauagugagaaguagaauagccuuugagcuuaaauggccucccacuccuuagucuacugaaauagucaccuaaugcuuuauucccaaaugcuugucuagcugcaucgugaaggacauucaacauuucaaauuccuaggccucacugggaauuugaaucuguaaauucugauucaguagaucuaagucaggaucccaaaaucugaguuuuuaaaaacuuccaagaugcauaugauacguaaguuugggaaccacuagcugaucauuauugcuaaccacuguuacucugcuuuaauuucuuucugaaaccaucaccauaaagauccuuccgaaguaaagaaauuuggcauuauggccugauuaaaaucccauuaaauguacacaggacaaggucuaauuauuuaaaaggaagcccucccuuaccuaguucccuguccaccucuuuauccucaucauuuuccacauucuucagccacacugcaguuacucaaaagcaccauaguauuuccuuucuggcuugcuuacucuacuccuucugccugggguaccauucccaauauguggcuugguaaauuuauaagagaaacuuuuaaagauuuaauucaaacaucauuuuguuucuguuuuuuuuuuuuuuccucuggcuuccaaaacugguccucucugguagaacugaucacucuaguuauuuggcuauauuaaucuuccuucacaaugcuuaaagauucuugggggcaggaaacugucacacauucaucuuugucuucucaguagugaugugcguaaguuugacuuugacauauuugccccaaaucugcuaugacuuugauuucuggcacaggaaaagcugacugcccuuucaacauucuuuuugggaaucccugauuugugcuuuauuagugcuccuaaucauaauuaaccagcauaucaauguuaguacuauuaaauaaacauaauauuugaauuuacuacaauuaucuggauaugcauuuucaaguauaagcaagcauacuagauauaaguuacagugaaaaucuuauauucuuuugucucccuguuucuuugcaccccuguaaucuuuuucuguaacagcaacuagaauaauccuuuuaacaagaaaucaagucauaucacuccucucugcuuaaaaugguuuuugccucauuuagaguaaaagccaaagcccuuccaauaguccauaugggccuccacaauggccucauuaccucuuugaucucaccuucuaccacuuugcccccuuugcucauucuguucuaaccauacuagccuccuuacuguucuuaaaacacuucaaacacauugccuccuagagccuuugcacuaguuguuccccuugccuggacuacugcuacccuaaauacccacaaggcuugcuucuccaccuuuuucaagucuuugucgcagucucacccucauugagauucccugaucacugccuccaucuugguccucuugcccugcuguauuuuuaugaaagccuaaguacauaucuuacuugauuauuuuauuuucuaucccaccaauccacaccuucacuggaaaguaaguuccauagaggcggagacuuuugucuauuuuguucaaugaacaucccaagcaccuagaacaguuucugacacauaagaaguauucaauuaugugcuggcugaauguaugaauuaauaaguugagauucgaucacuaguugaaguauaaauauauauuuuugcaagaauaaaugcuacaguaacugauuaugacagcuaauucuguguacaaaaacaaccauuuauuuaucuagccaaguuccuggcacagaaaagcagcuuaguaaauguuaacaaaugaaucguggaauaaaugugaacacaggcaaacacaggcauuagccacaagguaaacaucagagccagcagagccagcagugucaucuuccugaaguagaaaaaaacagcuaucaauuaaaacaaucacccaccaguauaacaaugaagaguaucaccauaaaccaaggcaaauaaaugaucuugccaggaaagagauuuagagguguaaagagagagcugagaaacuagaaagccaauuugcugaaaagagguucaguguuuaagauuaguucccuuaucgcuuucaucuacacucaugucuuuuacuguuuuguccuaagcaaauguggucaggaaaaugugugaguuauaguuaauguucuuaaccaaucaaauuacuagccgaguguaauggugcacuccuguaguuccagauacucaggaggcugaggcaggaggauuauuugagcccaggaguucaaggcugcagugagcugugauugugccacugcacuccagacagagcaagacacugucucaaaaaaaaaaaaaaaaaaaaaaaggaauacuuaaacaucuuuaucaucuuuauguuuuccgaacccaggcagaaacaggaguuuacuaacuuugguuuccacagucuuuuucaagaaagugcugucacgaaguuuucauuaaguugauaccuaauccuauugccuuuuuuuuuuuuuuuuuuugagacagagucucgcacuguugcccaaggcugaaguacaguggugcgaucuccgcucacugcaaccuccgccucccagguucaagcgauuuuccugaguagcugggguuacaggcgccugccaccacacccggcuaauuuuuuguauuuuuacuagagaugggguuucacuauguuggccaggcuggucuugaacuccugaccucuugauccgccugccucagccucccaaagugcugggauuacaggcgugagccaccgcgccuggccagcuuuguuuuuuuaaggaggguuacuuuuagacaaguauuuuauauguauuauuggaaguauuauuaauaggaucuguuguuacauuuucuaucuaguaauuguugcaaaaccagaauacuuaaaacaucacauguaauuuuuaaaaacccuaucucuacuuaauggaaaaaauagcaaaaaccugacauuucaaauuaaauauaaauuacauuuucaagacagcuagcaaucuauuauuuuaucugggaaaauaucuucugaauucuaaucaauaaacuuuaaaaauaaaccuuuaggauacccacauguuagagaauguuauugauguauucaaaaaauauuucuugaucaucuucuaugagucuaacacucuucccagaacaggacacggugcaauaaacaaaacagaccaagucucuaccuucacggagguuaucuuauggaacaaauguauuuuuacauugcuuguuguuauccagcaauauuuuaccagggucaaucccuaacugacaaaacacgucacagaaauugucuuuccauuaaaccagcuaccacaaaauuucaggauaaaagcaaagucuacaaaaauuaaucuuugcuuauacuagaugcuacaauauaguauuauaugaacagagcaggcuauacaaaaaaaauugaguaugauuccacuccuguguguaauguauguguauaaauauaaacauauguagcuauacacacauauaacucauagaugcacagauaaaaccagaauacagugauauacaguguuagcaaaguuuacaaauauuaacuaguuucaagauaccaggaucacaaauuuuuuguaauuuauuuuaacaaaaauucaccaugaacugacacuaucacuguaccugcauuugucaaaaaacucugaaagaaguaguaaucuaacuugaacuaucauauuucuuuccuacuguauauccuaaagaaaaguauagacugaacaggcaauauaauucaguaucuucaguuucucaugcuaaccuaauuuucaaauuuugaaaauucuguauaauuaauuugaaauucaaaaaaacagaugaaaugguuuguuucuaaagaaaaauguucagaaugcauacacuuauuuuauuuuugaaagcaacuaaauuucuugguuuagaucauuauuaucuaaacggcacaacaacaucucucuuaaauauccauaauuaaagaaaagauggauuuauucaccuuccaaaccucaccaaaaugcuuacuuuaaaugugauuuucuaaugcaguaaaauaaacggggaaaagaaucacuguuuuacauuggaggguuccuucugaaaaugaaaucuauaucacaucugaaauagccauaauguguaaauuuuucauuuacauguuaauuuauuaaguagcuaauacuuuuccauguguuuacauuaauguguauugaaauauuacuuguaagaagaaugugcuuuuuguuuuuagauuauuccugacuagugauauaaauaaaaucuuuccugguccagaauugguguugagccucucaacaaaucuuugagcccugauuauauauaagguauugugccaggugcaguggcucacgccuguaaucccagcacuuugggaggcugaggugggcggaucaccugaggucgggaguucgagaccagccugaccaacauggagaaaccccgucucuacuaaaaauacaaaauuagcuaggcauguugccacgugccuguaaccccagcuacucgggaggcugaggcaggagaaucaacugaaccugggagauggagguuguggugagcugagauuacaccauugcacuccagccugggcaacaagagcaaaacuccauuucaaaaaaaagaaguauugugcuagauaaauaaaacaacaaaaauguguauguaaaguuuuuacucuaagaugaagguucucaaacgucaguuuucaucacaguccccuggaagaauucucaaaacacagaaugcuugccaagucaauccuaagccaaaagaacaaagcuggaggcaucacacuaccugacuucaaacuauacuacaaggaugcaguaaccaaaacagcaugguacugguaccaaaacagagauauagaccaauggaacagaacagagcccucagaaauaaugccgcuuaucuacaaccaucugaucuuugacaaaccugacaaaaacaagaaauggggaaaggauucccuauuuaauaaauggugcugggaaaacuggcuagccauaugcagaaagcugaaacuggaucccuuccuuacaccuuaugcuaaaauuaauucaagauggauuaaagacuuaaauguuagaccuaaaaccauaaaaaccguagaauaaaaccuaggcaauaccauucaggacauaggcaugggcaaggacuucauguuuaaaacaccaaaagccauggcaacagaagccaaaauugacaaauaggaucuaauuaaacuaaagagcuucugcacagcaaaagaaacuaccaucagagugaacaggcaaccuacagaaugggagaaaauuuuugcaaucuacucaucugacaaagggcuaguauccagaaucuacaaugaacucaaacaaauuuacaagaaaaaaacaaccccaucaaaaagugggcaaacgauaugaacagacacuucucaaaagacgacauuuaugcugccaaaagacacaugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaacaggaacacuuuuacacuguuagugggacuguaaacuaguucaaccauuguggaagucaguguggcgauuccucagggaucuagaacuagaaauaccauuugacccagccaucccauuacuggguauauacccaaaggauuauaaaucaugcugcuauaaagacacaugcacacguauguuuauuguggcacuauucacaauagcaaagacuuggaaccaacccaaauguccaauaaugauagacuggauuaagaaaauguggcacauauacaccauggaauacuauucagccauaaaaaaggaugaguucauguccuuuguagggacauggaugaagccggaaaccaucauucucagcaaacuaucgcaaggacaaaaaaccaaacaccgcguguucucacucauagguaggaacugaacaaugagaacacauggacacaggaaggggaacaucacacgccggggccuguugugggguggggggagcggggagggauagcauuaggagauauaccuaauguuaaaugacgaguuacugggugcagcacaccaacauggcacauguauacauauguaacuaaccugcacguugugcacauguacccuaaaacuuaaaguauaauaaagaaaaaaaaaacacagaaugcugagccuuacuuccagaguuucugauuuaugaagucugaauggcgccugagaaugugcauuucuaacaaguuaguaaugcaccaacuagguguuaccaaugaugauaaucuggggaccacucugagccccucugcucuaagaagauacuuaacguguucuucaaaaaugcccaaagaaguaaaagagcaacgcucaaaacuaguuuguuacauacuuuucucuuuaaaaaaccuacccaaaugcuuuacaaauacaggaaauauauccaccuccuaagacauuaauacaccacauacuuagaacuuaguaauuauaaaauacacuaacuacacugacuagacuauucaaugguugaccugugguauauauccacaaucaucaauagaacuuuuuucccccaaauauagaaggccaaaucccaacccuggaaauucaaauuaaaggcuuggcacaucuguuuaaaaaauaauaucaacauaauccugaugagcacucuuagcuguuuaaagucuauguuucauuucugagugcuuguaaaauuuacagaucccugaguuccaucccaaaauuaccaaaucagaaucucuggcgaaugggucccugggaauccauagagcaacuagacacucaggugauuuaaccacagaaguuugagaaacauuagcaggucuuaaagcaaaagcuuaacagguaggccagcaaauuuugaaaaacgagaauaauuuauuuuuagcuauaacugaauacacauccuauaacauaccauguuugucaggcaaaacacugaauauagugaguuucacaauacuauguaaugugagguauaauugcuaagaauaagaagcuagcaguaaaagucaauaagccagcaagaacaagugugcguuuaguaaaacuuugccuuaaacacguaagugcaugaguagaguucaaagaugaccuaaggaagaauguggcaacugaauuuuuuuccaguucucugaaacaauuuuuuaaaagucagcuuuuaauaccuucaugaaugucacaaacauucaagagugaagaaucacuguucaugguuaagagcuguguaucacugacuuuccccaaauuaccuacucuaucacucuucuuucucugcauugcuuccuucucagcuuguaaauccuuuucuuucuguuucccuuauuuauaugcucuuagaugguaacagaucuaagacuagaaccuaagaaggucagugacccuaaacuuuguguguauguagaagaauguguccuugaaauaauuauuugcuuaacuuuaauagaagaugcauaaauaauaauaaaguacuuacauaacaggaaaaaacacauguauugaaauaaggguguacaauagaaagcauacccuaaagacuucuucuauuaaauauuuagcucuaaaccuugaccaugauuaagauucuggaaaugacaaaggagcagcucuccuaaagcaagagucucuguuuuccaacuauacuaauccauccuauccaauauuaccaaauaaauuuuccaaagugaccuucugauccuguuucuuugucuuuaaaaaggguuagguaacacuauuaguguguggcagaucucagauuccaccugagaaucuccacccuuuuccccauuuuaauaugaagccccauuuuuaauauggccuaugccuuuccacaaaucagaugcucaauauauaauuuuuaaauuaaaagauucaagaaauuugggacuauuuuuuaagaauagaaggaagaaacaugauagcuacccucagauauuugaaaaggauaucaaacaaaaggcggauuugguaauuuauacaacuccagagaguaauaaauaggaauuacaacauggcagugcuuuguuuaauagaguuaaagcaguguugaaguuacacucuaugagaauuuuuaaaaccguguuuucauuuugguggcauuguaaaaaaagaaaaggcauauucuacaucaucuaaaugaucucuccauaguucuguauacuugccucaagccuucuguguuugaggcugcauuuguuuaugaucaaacuguuaccaaaugaccacuaaaaggaacaagguuacauuuuuuaaugcaguauacauacucagacugaggucacuggguacaucucaaaaauucagaggauuauuuugcuccaaaagagaucugaacauuaauccuguguuaagaaacacaggaauaaaaaagaaaauaaguagauugucuugugagaauguuuuguguauguaugucugaaaauucuaaaagcagacuggccaaugcgccuguggugguugacauuaaauaacaaaacuuaaacccaaaagucuguacuucgcaagaaccucaaacuuuaaagugcaaugaacugaaaauuuaaaaauggaauaugcuaugaaugaaugaaugaacauaaaaaauggaauguucaacuguggccuaagccaucaacgauucaaugcuguacucaauaaauuagcugcacaaauaccuguugaauaaaugaaugcacaacaaucuguuacaggacauaguauaauaguuaggugccugagucaugguuaagcguugaagaaauuuuuugaaccacugaaauaagucaacuuaaauuauucaagaaaauaucccuucauccauucacagugaaggcuuugacuacugguuugacacuauaaccauuuaaauauuuuaacuauguuagcuacaaaggcaggcaauauccaacuuuccucugcuaacaaguuaaaagacauuuaaugagauucuggacacaaaggacauggaaauguaggcuuucuuaauuucccccuccuuuaacaucccaaauaaauagcuuugagaacauuuuucuuccuuuaguauuaccacuauggaaaauuauuuuagaauaacaugucuauacauaaaccaguauuuagucugcaaaggccagauguuuauggaaaaaaaaccaaguaaaggaaaagcaucaguaacuauucugccacuauuauuuacucacugguggugaauagccuucgucagauuaucacaaagaaggcuugagcgauucuaaacaauguugaaaacaacuuaaccaauacuauaauauuaugaauauauggauaguuucuacuuaauuaagcccuuacuuugugccaagagcuguucugaguguuucauaugaguugauguaucauuucauucucauaacaauccuauaaggcaauuauucuuaucaucccaauaaagcaauuuguguaagaucacacaguagagcuaaacgaucuagaaaaaugugugaucuuaacacauauuuaguagagaaaaggaucaucuuuuucuugagaugaaaacccuaacccauagaagaaauacucaacuucccaaaagucaugacaagaacagcuugcagaaugacuacacuugguagaaaacuauagaauaugaauucaaaugacuugcaacaaaaacucauggcccauuaauuacuggucaagaguucuguguauaguaagauaauauucuacaagaagaccaucaaauaugcuacaauaagacauauuugacucauguaaucagggaacuccauucacauggccaaguagggcaaaacguuuucuucuaggaaacugauauauagacacuagaagagagagggaguuuuuuuuacuuuuuuuuuuuuuauauuacaaacuguauggaugcagguauggggaugcuagccguccucuuccacaccauacagacagccugucaguggcagaguaaggccagcaugcaaauagagcaaagguauacaagccaaguaauaucaagacaaaagucagggauuauuacacucugagaucauuugagacucuagauuugucucuuaaaccaaaauuagauuguguuagccaaugacuacauuuuccccucuuaaacuagauugaguuguauuuugcuacuugcaauaagaagaauccuaauauacuuaucaaauugccaguguuccaaauuuaaaacuuuaaugaugauaaaguucaagaaaaugacacucuaaaauacaacuaggucaaacuuucuagaagauaaacaggcaauuacauugaaagcuuuaaaauggauacuuuuugacccuguaauucuacuucuucuaauuuauuauuaagaaagaaccaugaggccgggcaugguggcucacgccuguaaucucagcacuuuucucacuuuuuugagaauagguuugauaaaaaggcaguaaugguaaaacagacuauaucugaaaucuggagaguauuaagagccauauauuauguuaaguacccaacauuaauauuaucuaauuuaaccaucaccacaagccuacaaaauucugauacucuuccucacuauuuagaugggaaaaaauguagauguaaauuuuuuaaaagcagguuaaaaacaguacucagucccuaauccuacaguuauuaacauacagauguaacacagaauugagaaauaguagacaauggucucuacauagugaaaaagcaggugauuuuuauuucuuugugcaccuguguaguuuuuaaauuuuuuccuccaaaauuuuaaaauuucauuaacauuaaaauaguuuagccagaucaaaugauuguaaacacacucagggaacuccuauuuaaaugguauucuauuauaaagcaaagagaauaaucaaugcucuucuauuauaaagcaaagaaaauaaaccccaaccuuacuauaaaguaauagaauuuaaauaucuauaucaaaaaaagucaaaggagauucuuuaacuuucuucuuaccaaucagugaaucucagacagggaacuaaagaauuaaaacauucuuuuuaauuuuuuuuuuuuuuuuuuggagacagcaucucacacugucaucaggcuggagugcaguggcgcgaucuuggcucacugcaaccucugcuucccagguucaagcgauucuccugccucagccuccgaguagcugggauuacaggcaugugccaccacauccugcuauuuuuuuuuuuuuuuuuuuguauuuuuaguagagacgggguuucuccaaguuggucaggcuugucuugaacuccugaccucaggugauucaccugccccggccucccaaaauggugggauuacaggcaggagccaccgugccgggccgacaauauuucuaaagaaaccuuuuaaaaaccugcauucucuuuguucauccaauuauucaaucauugucucauuuguuaauucaaauacuuauuaagagcucacuguguacaccacguaccaguauucacaccacagauuucuuuuuuaauuuuuuugaaacacagucuugcucugucacccaggcuggagugcaauggggcgaucuuggcucaccgcaaccuccgccucccagguucaagcaauucuccugccucagccuccuaaguagcugggauuacaggcacccgccaccacgccuggcuaauuuugguauuuuuaguagagaugggguuucaccauguuggccaggcuggucucgaacuccugaccucaggugauccacccaccucggcaucccaaaguacugggauuacaagcaugagccaccgcgcccagcccacaaauuucaaauucagccuacuugggauuugguccacugaaacauauccaguuuuauaauggaaagggggaggguagaaaucauuuuaaagaaauuugcuuagcaucugaauuuacaagacucuuaagaacagaaacguaucccaacccucaaagacuucaacuuucgccuuuaaaccuuauuuuuaaccauaguauuuuucagcuggaaaaacaaauccucccaaacuacuuggaaaaaaaaaagggggaaacacgggggaccuguccuuaaugagugaaaauugcaauauuaaauacuagacacuuuuaaauuaauuugccuaaauauauugugacuuuucaaacaagugaagaacuacauacaguaaacuauguuccaucacuacauuuucccauuuacaagauaauaaauuuucaaaaucauauguugaaauaaucuuuaugguuaaaacuguaaccgguuaaggugaaauuuuaaaauaaagaaacacucauaaauaacaguugagaucaccagaacagcuaaaagcuaacaucuugggaacaguuuuuaauaaaaauacauuauuucaauuauuguuuuaaaucuuagagaacaaauuuccuaauuaaauugggcuuuaucaacaauagaacagguguacacuauuuuacccaaaaaguguuucugugaaaaaguacuggcauaacaaaucuaagucacuagaaaaauugaauucuccuuuuagagguacuuacucuccuuucaguuaaagcuuccacuggcaaacuguaguuagcuuucagcugguuaauuauccacaaacaagcccuuaaaaacaaucacuucaacauauuagauggcuaccacuuugccacauuagauggcuaagaaagaaagagaagagaaggaaggaaagaaagaaaacaaguguuuagaaggauguggagaaauaggaacccuugugcacuguuggugggaauguaaacuggugcaacugcuauagaaaacaauauggugguuccuugaaaauuaaaaaggguuaccauaugauccagcaucccucuucuggauauguauccaaaaaaagugaaagcuucaaagagagauuugcagacucauguucagagcagcacaauaaccaagauguggaagcaacccaaguguccguugcuggaugaauggagaaacaaaauauggaacauauaauggaauauugcucagacucaaaaaggaaggaaauucugacacaugcuacaacauggaugaaccuugaggacauuacacaaagugaaauaagcccaucacaaaaauauuaaaacccuauaauucuauuuauaugaggcaucuagaguaguuaaauuugcagaaacagaaaguaaaauggugguugccagaggcugaggagagggggaaauugggaguuguuuaauggguaagauuucagcuuugcaagaugaaaaaguucuggaaguuaguggcacaaugugaauauacuuaacacuacugaacaguacuuagaaaugguuaagaugguaaauuuuagguuaauguuuuugaacuacgauuuuaaaaaacaaucaaaagcuauaagaaaaaagccaugagguaaucacauuuuuguuuuuaugaaacaaaaauuuuaaauuuuguuuuaaaaauucagguuuuagauacuagauuucucuaaagggaucaugucuggcaaauaaauaaggguuuauaaauuucuacugcagaaaacaugaacauuaauacucaacgcauauacaaaacaguuaauucuugaugugucaagagaccaagagauauaauuauuuuuaaaauuccaaagccuauaguuaauuuaaacaaucugaccauauuuuuaccaaaaauacugagcaacaagaagcuuggcuugucuuaguuucaaauucucuuucuaaccuuccagaguuaagcagaaaacacauacacacacuggguaaaauccacccacuggauaacuagucacaaaguuuaaaaaaucaauuucuugauuggaaacucauccaacaucacauuuaaauuuagauuuuuuuauccugguuaagaaacagacuuauguuaaucuuagauaaagggauacaguauuuuaaguaucuaaauuuaaaaaauuauauacuaagagaaggcaucuaugaacacacaauuuaacccaaaucuuuaacauccaugcacaucaauuuuuauuucaccaccaaacauaauaaacugaguucuucagaaaaaaaaaaaaaaucagucaagagacuaaauaaucccccucagcuuucuauacaccacucuugacauacaagaauagaauguaaccacaaaaucuaaacccugagccgugacaccauuagagucacagacaauggcguuaaaaguaaagacaauggaaguuaacagguagaaaaguugacauucuccaaacugcacaaggugcucugcaguggaccguaggaaugaacuccaauacuuucucagucuaaaauaacucgauaguucaguaaauacacacguguggaagagugcauagacuucauacaaauugagccacaaaacagaccaguaagacaagcuugaagucuugccuucagauggaacccaauggucuuaacucuggagaaacucauaagcaaaggacaguuuuucuaccacguagcugcuuuacugagaauauuuuaucaacucauuaucuuuuacaaagguuaauuuuuauaaaauugucuaaacuuuggcaucaagacgaaaaauguuuuaacuuacugccaguacuaagaaugcagugucuugcacauaucuugcuuaaaugaacaguaagacuagaauacuguguauguuugacucuagaguccagaguaaacucaguauucuauuuggggagaaaacacaggggugagcaauugugaagcaggaggccuccacuagaguagagagcagaucagaugcucaagaaaaauaacugauacuaggugccaauauaacccaaggauguacucuuuugcccauuguaacaggaaaaaaacgcuuuucaagcucuggauccaauguuagucuuuucacuuucaggagauagaaaagaugcaugaagacacagaaaagaaacuaaaggaaacagcuggaaggacuagcaaaaaagaguuuuaagaguuguggaaguuuaaacaagaauuuuaacagguaacaucuauuuucaaguacacagugucaucaagacuccugcaaugggcuaagugcuucacaagcauuaucucauuuaaccuuuacaauaacugcucagauggcugcuauucuuaucaucauuucaaaaggaggaaagaggcucagaggcauucaguaacuugcucaagcucacaagugaagggcugggacccuuaacucagagguaucugccucuagauccuaugcucuuaaccaccauaugcugcuuccucaaacaaaaggacaaucaaaauagaaucauaaggagaaaaguuugcuaauaaaugagagagcuucuugacuuuuaauggccaaaguuaaugaaggaaauuaaggaauaucuauucucagaaauuuuacuuuaaugauucaguaauuauuuguuuuggaaaacucugaaggagucuggccugaagccugaaacagaaucauuacucucuugacauucccuuaaaaaucuaaaaaucaaaaugcacgugcuauuaaauaaguucagccccuauaacuaggaacaacaugaaauguccugcguuaaaucuacaguaucauaaccauacccauuuucuauucugauuucuuccaauucuucagguuuugaguuuccuagaccuucuuuuaaaaagacaaauuuguuuuccaaacuccgacauugggagcucauuuaaaaugaaaaaaaaaauugcuugaagaaaaucuccgucccucaaccucucaguuaucuuucaaaaaacuguaaauuaguuagaaaaggucaucuauuauaaacagcaucuaaaagugcugaguaaccaccacuuauuaaguguuuaacuuaauuuuucaguuauaucaagaacuucuauacuaagaaauaugaauccauccaauccaagguugccaaguuuucaaaugagaaaauuuugaaaguaacagaugggcugaggaaaaucuaagagcuuauuuagaauuggggcugaugaacaguagcuaauuuauuaauucguuucaaaacugcuucugauauucugaacggaugaauggcaaaacaaugaguucgauacuguauauaaaaaaagugguacauaauuuaaugcauuguauuaaguaugauucaauauauaauaaggauagaaaacuggcacuacacagagguaaucugccuuagguuuacaauauagcagcuuuaucauuucaucaaaagcacuguaaucaccuccgcaaaauaaacugcaauuaauuccugguaacucuuggaauuaaucuagaccuguuugcucacuuuuugaauuuuauaagugaccuucucugcuguauacaaacuaagaauuuaauauucuauugaagaaggaccaggagaagggaucuacaaaacagcaggaauauaaacaaguuuaucuucugcugauacugauuagggaaauuaaucucucugccagaagaguggaaggauuuaacagcaaagccagucuacuaaccaaaacucuuacucuaaaucuucaauuccuuaagugauuuccuuaaaaguuaaaaugccaaagugggcaaaauuguguguguguugggggaugggggaguccgcucuuaacaccacugguccaacucacaauucuuaaucucuaauguaccccuuagacucaaacuucaaggugauuuauaaaacuugcauuaaguucuaaccgagugauuacuuacuuuagauauauguugacgguuuuccuuuaauauacuucaauuucaggaaaaugagacagaguucgaaaauuuuugcaacauuuuagugccgcauuucauucacucaucauauacuuuuuucaguaucauuaaaacugccuaaauuuaaccagccccuacauuuucauuauuugaagaaugaaugaggcauauauucauuuauaauaucugcguucucgugacaggugauaugaacucaaguauccaauucugaaguucucuuuaaaauguugccauuucccuaaauucccauuacucugacucucagucuaggcaaguuuuucaaggcgauuaaaacgaaacaaaaccugcacgugcaaacuaaaaaguucgcaucuuaaggccaucgcggcaaaucccuaaugcacaaaggcaaagacacccgcgacggcuggacaacuacaggacaagaucgcauccgaccacgcgagucccucagucgggaacucaaggccccaaguccacuggaaagccaggaccagcgugcaggguccgccccagggccgaguuuucaauggaacuggagaggaugggggcgggaaggagcggaagcuccgggugcaaaccgcggcuaccgagcugcagcucauuucucuucccgggguuuucaggcuggguaaaguccccuccggauggggccacagagcaggcuggguuuuugaggcggguaggugggcggcgcgaggcccccacggccggcggggagggcaagcagggcucagaccccggccccugaaagcacuuucgaggcgucucccaccccccacgacaagauggcgacguggacagcgggggagcccggccggcgagguugggggaagagaggggaggggagcagcagcagaaacaaaaaggcugccccccccaaucccauuaacgccgaggccggcccaggagcccagggcgggcaggcgggcggggucgccgggggagaaggcggcgggccgagggaaugggcuuacuuuuucuugucguucgcgccgccggcgcccuccauggugaaucgguccccgcgaugucuucacggcgggcggcccccaggcucgcuccggccuaagcgcuggcucccuccacacgcggagaagagaaggaaaggcaaguccagaggugggggugcgaggcgggaaaccccucgugagacuagagagaagcgggcggcaaucgccgggguccgggcccggcuccgagccucuccucagguggcuugucagggcccagcccgacacacuggccgaagcgacgaagagggugauccuccugu

SEQ ID NO: 21291 - RNA, 3388 nt, Homo sapiens
gcagcgagcaucugagaagccaagacugagccggcggccgcggcgcagcgaacgagcagugaccgugcuccuacccagcucugcuccacagcgcccaccugucuccgccccucggccccucgcccggcuuugccuaaccgccacgaugauguucucgggcuucaacgcagacuacgaggcgucauccucccgcugcagcagcgcguccccggccggggauagccucucuuacuaccacucacccgcagacuccuucuccagcaugggcucgccugucaacgcgcagguaaggcuggcuucccgucgccgcggggccgggggcuuggggucgcggaggaggagacaccgggcgggacgcuccaguagaugaguagggggcucccuugugccuggagggaggcugccguggccggagcggugccggcucgggggcucgggacuugcucugagcgcacgcacgcuugccauaguaagaauugguucccccuucgggaggcagguucguucugagcaaccucuggucugcacuccaggacggaucucugacauuagcuggagcagacgugucccaagcacaaacucgcuaacuagagccuggcuucuccggggagguggcagaaagcggcaauccccccucccccggcagccuggagcacggaggagggaugagggaggagggugcagcgggcggguguguaaggcaguuucauugauaaaaagcgaguucauucuggagacuccggagcggcgccugcgucagcgcagacgucagggauauuuauaacaaacccccuuucaagcaagugaugcugaagggauaacgggaacgcagcggcaggauggaagagacaggcacugcgcugcggaaugccugggaggaaaagggggagaccuuucauccaggaugagggacauuuaagaugaaauguccguggcaggaucguuucucuucacugcugcaugcggcacugggaacucgccccaccuguguccggaaccugcucgcucacgucggcuuuccccuucuguuuuguucuaggacuucugcacggaccuggccgucuccagugccaacuucauucccacggucacugccaucucgaccaguccggaccugcaguggcuggugcagcccgcccucgucuccuccguggccccaucgcagaccagagccccucacccuuucggaguccccgcccccuccgcuggggcuuacuccagggcuggcguugugaagaccaugacaggaggccgagcgcagagcauuggcaggaggggcaagguggaacaggugaggaacucuagcguacucuuccugggaaugugggggcugggugggaagcagccccggagaugcaggagcccaguacagaggaugaagccacugauggggcuggcugcacauccguaacugggagcccuggcuccaagcccauuccaucccaacucagacucugagucucacccuaagaaguacucucauaguuucuucccuaaguuucuuaccgcaugcuuucagacugggcucuucuuuguucucuugcugaggaucuuauuuuaaaugcaagucacaccuagucugcaacugcaggucagaaaugguuucacaguggggugccaggaagcagggaagcugcaggagccaguucuacuggggugggugaauggaggugauggcagacacuuuuacugaaugucggucuuuuuuugugauuauucuaguuaucuccagaagaagaagagaaaaggagaauccgaagggaaaggaauaagauggcugcagccaaaugccgcaaccggaggagggagcugacugauacacuccaagcgguagguacucuguggguugcuccuuuuuaaaacuuaaggggaaaguuggagauugagcauaagggcccuugaguaagacugugucuuaugcuuuccuuuaucccucuguauacaggagacagaccaacuagaagaugagaagucugcuuugcagaccgagauugccaaccugcugaaggagaaggaaaaacuagaguucauccuggcagcucaccgaccugccugcaagaucccugaugaccugggcuucccagaagagaugucuguggcuucccuugaucugacugggggccugccagagguugccaccccggagucugaggaggccuucacccugccucuccucaaugacccugagcccaagcccucaguggaaccugucaagagcaucagcagcauggagcugaagaccgagcccuuugaugacuuccuguucccagcaucauccaggcccaguggcucugagacagcccgcuccgugccagacauggaccuaucuggguccuucuaugcagcagacugggagccucugcacaguggcucccuggggauggggcccauggccacagagcuggagccccugugcacuccgguggucaccuguacucccagcugcacugcuuacacgucuuccuucgucuucaccuaccccgaggcugacuccuuccccagcugugcagcugcccaccgcaagggcagcagcagcaaugagccuuccucugacucgcucagcucacccacgcugcuggcccugugagggggcagggaaggggaggcagccggcacccacaagugccacugcccgagcuggugcauuacagagaggagaaacacaucuucccuagaggguuccuguagaccuagggaggaccuuaucugugcgugaaacacaccaggcugugggccucaaggacuugaaagcauccauguguggacucaaguccuuaccucuuccggagauguagcaaaacgcauggaguguguauuguucccagugacacuucagagagcugguaguuaguagcauguugagccaggccugggucugugucucuuuucucuuucuccuuagucuucucauagcauuaacuaaucuauuggguucauuauuggaauuaaccuggugcuggauauuuucaaauuguaucuagugcagcugauuuuaacaauaacuacuguguuccuggcaauaguguguucugauuagaaaugaccaauauuauacuaagaaaagauacgacuuuauuuucugguagauagaaauaaauagcuauauccauguacuguaguuuuucuucaacaucaauguucauuguaauguuacugaucaugcauuguugagguggucugaauguucugacauuaacaguuuuccaugaaaacguuuuauuguguuuuuaauuuauuuauuaagauggauucucagauauuuauauuuuuauuuuauuuuuuucuaccuugaggucuuuugacauguggaaagugaauuugaaugaaaaauuuaagcauuguuugcuuauuguuccaagacauugucaauaaaagcauuuaaguugaa

SEQ ID NO: 21292 - RNA, 6076 nt, Homo sapiens
uaacucaucuguauuuguuacaacuuuaagcagaaugugacucgagcacuacauuuccauccacaagacugggucugaguuauuuuugaacagcuuuacgauaugcuuagguaggcuuuuaacuuugcuccuccaaacaauacuuuucuuuggaaaacaagcccuguggagagauccuuccaucaaguugcuucaguuuaaccuauuucuagaggacuaguacaugcagaauugucaacuacagggaaugaaaaguucaaaaaguagauccuacaagauguaacgaauacuuuucuaaacaucaagauacagcucagaacacuucaauaacaagauuuggucuacuuaggcauccggcuugacagcuaaacacuuuagaccacaaaguuaacaucauguuacauacgucuuacagugcacguuaccccaaucugugaaaauaaaccaacaugaaacucaaaaagcauuacuagcucugcuuuagugccuaagguaucacagcaucacuuaguagacagaaaucuuaucuuccccuuaaaguaguugucaugccauacagacuuuuuaauauuaacaaaaauaaagaaaaacauccuugaaaauauauuaucagaggaauuguagaguacugaacagguaagucaucccucagccagagauuagucuacuucuuccaugcgugaugugucgucaucuccuucaagggguggcauuucuucaguuacagcagcacugguaucaucagcaguagggucaucuucaucaauaccuguuuccaaaauaaaauccucauauuacaaagauuucuuaaagccagcuauuaggguaauacucuugguuucuaucugcuuucaagacaguauuacaggacauaugagucucaauuucauuucuuugcucuuguaagaccuuacuuaucccuaaaaaaaacauacuuuaauaccuccaagcagcaagcaggacaaggugcuccaaguuuggauaacugaaaguucaccauuuucuucaaugucacguguguuuauuuucuuuuuaacauuacauaguauaaggcuuacccagaccaaguuugaucauccuguagauccuguuagcaugugucuggggaucuuccagacugaagccagaagacaggagcgcaguuucauaaagcaagaugaccagauccuucacagacuugucguucuuaucagccucugccuuuugccuuaaggucucaauaauggaauggucaggguuuaucuccagguguuucuuugcugccauguaacccauuguugaguugucucuuagggcuugagcuuucaugauucucuccauguuugcuguccagccauaugugcuugugacaauacagcauggagaugucaccaaucgguuugacacaaccaccuguaaucaaaaagugaugacuaggaaccuagaaagauuaauuccuaaacuuucauugugaaaugaaaucuguagaacccaaauuucaauagauccaaaauacuaucuacugucaaauacaacuuaaaugucgcauuagguauccaaagagcacagguuauaauuucauguuuuacaugcacaauuuuuuuuuugagauagagucucgcuccaucacccaggcuggagugcaguggugcgaucuuggcucacugcaaccuccgccuccuggguucaggcgauucuccugccucagccucccaaguggcuaggauuacaggccgugccaccacgccugguuuauuuuuuucuauuuuuaguagagacugaguuucaccguguuagccaggauggucucgaucuccugaccuugugauccgcugccucagccucccaaagugcugggauugcaggcgugagccaccgcgcccagccacacacaacauaguuuucuguuuuaaguugaaaacaugcgaaaaugggcuauguaugacuaagcuugaaagcaccuuagaaguaucaaugaucaggaaaugcuguauucacauaccuuuucaacuuuuuucuccaauaugucuuucaugauuuugcagagguucucaaacuuuguuuuuuucucuuccugcuucuuuuucucuucuucauccucuggaaguuccaggccuucuuuggugacugacacuaaagucuuccccucaaauuccuucagcuguuggacacaguacucaucaaugggcucaaucauauagaucacuucuaagccauguuuccgaagacguuccacaaaggcugaguuagcuaccugguccuuggucucaccugagguauuacaaaguuacuuuuagaccuuuuaacaguuaagaaugguuucaucuagcucugacuuuucuugcuagccagauaccuaggcagaaccuaagacagaaaaugaccuaguucauguuaauuaucuugccuagaucaauaccaguuguaacagugcuaccugaguagaaaacacacccacagagccuacaagauuguaagaacgacguguaugacuguaacauaguguucucuuaccugugauauaauagauauguuucugguucuccuucauucuggugcaguaguccuugagagaaaccaucucaucaccagaggcagauguguaguaccuuaacagcucugaaagcuucuuccgauuuugagagucuucguguauuccaagcugaaacaaaguauguucuuuacaaagacuuucugaauuaaaaaaaaaaaaaaaaaacuaaagaggccaauuggaaaacuaaugguuauuuacaccaaccuuuauguuuuuagagaacugcucauagaauuucuuguaguucucuuuaucuuccgccaguucaguaaagaguucuaagcauuuuuugaccaaauucuuccugauaacuuucaaaauuuugcuuuguugcaacaucucacgggauauguuuagagggagauccuccgagucuaccaccccucuaaugaagucugaaaaaaauauaaaccaaaugcacugagucauuccaaggacaaaacugguacuauguaaacucccaaaaucaaagauaaccugaagaugaugggacguauuuuugagacagucucacucuguugcccaggcuggagggcaguggcgcaaucuccacucacugcaaccucugccucccggggggguucaagcuguuuucaugccucagccugccacuacauggggcuaauuuuuguaauuuaguagagaugggguuucaccauguugcccaggcuggucuugaacuccugaccucaagugaucugcccaccccggccucccaaagugcuaggauuauaggugugagccaccaugcccacccagaaaguacuucuuuaaucagugacagugauuauuuuuccuaucuauacuuacucagauauucagggauuagcuccucacaguuauccaugaugaaaacucugcguacauacaauuugauguuguucuuuuucuuucuguuuucaaacagaucaaaaggagcacgucgugggacaaauagaagggcucugaauuccaacuguccuucaacugaaaaaugcuguaauaaaacagauacacuaaguaccaaugaacaaugcauuauagaagauauuuggggugguggagaaagaugauaaucuaaggacaagcuugaagcacccaucagucacucaccuucacugccaagugaucuucccagucauuggucaagcucuuauagaauucuccguacuccucauuaguaauaucgucgggauuucugguccagaugggcuuuguuuuguugagcucuucuugaucgauguacuuuuccuuaaucuucuucuucuucuucuugucaccauccuucuuuucuucuuccucaucagaaccaacaucuucaauuucagguuugucuuccgacucuuucucuucuuuuucuuuuucuucuucuuugucuuccuuuucuucagccucaucaucgcuuacuucuuuaucacguuccuucuccaccuucaaaagaaaacacgaaaucacaucacugcugcacuccagaacuaagcgacagcgcugcaccacuauuuucaaccuaaggcccaagucuaaauuagccaacuugagaagcacccagcuuuucaucaauauuugauacauccacuuaauagcccgaggaacuuuuacagaguuagguaguagagcuuagguuccccaggcuucagacuaguugaacagaucuagggacuaaggauguaguacagucaccccaaucaccuacagacagaaauucacucugcaauuacauaaaaacuuacaaaaagaguaaugggauauccaauaaacugagaauguuucuucacaaucuccuuuauucuucguuccuccaaguacucaguuuggucuucuuucagguguaggauaacuuuuguuccacgacccauagguucaccugcaagagaagaaagaaaaauugacuuaauacauucaauuuagugcucaacgccaugccuaacacccuuauaacgugucuauaaagcaagguuugccguuacuacagaugcaaaggccaccacagcagaaccuuuugggcaaggugccucgcccaaaagaaccgcccaccaagucaugccauuacacuaauuaagugcucuagcuuguuccugaucguugggcaaacacaaauucuguaagcuucaccgcauccccagggguccaaggguugcagcaccccacccuuccaccgcucacuuaaccagugaauguucaggugccuaccugugucuguccucacugugaaugaucccccugcugaggacucccaagcguacugcucaucaucguuauguuuggugaucacaguuacuuucucagcaaccaaauaagcagaauaaaaaccaacaccgaacuggccaaucauagagauaucugcaccagccugcaaagcuuccaugaacgcuuuggucccagacuuggcgauaguaccaagguuauugaucaagucagccuuggucauuccaauuccaguauccacaauagugagaguucgaucuuguuuguucgguauaagguuaauaugcagcucuuucccagagucuaauuuacugggaucugucaagcuuucauaccggauuuuguccaaugccuguuaacaaaaaauauuaauuuaagcauacagcacccccaagaaguucacacugaaaccaaaauccgauucuggguuaauaagugacuuacaucugaugaauuugaaaugagcucucucagaaagaucucuuuguucgaguagaaaguauugaugaucaaugacaucaacugggcaauuucugccugaaaggcgaacgucucaaccuccuccuccuccaucgguuggucuugggucuggguuuccucaggcaucuggaacgacaccgcgccgguuuaaaaccuugcaggacgucuacagaggcaacacgaaauuccaucgcguucuccaaauauuuuuaaagccgaauuggagauuugcgaaguuuaaguaaaccgaaaauagaagggcggcugacaaaggaugaccucauuucggagcgcggcaacuaccacgagcgugugcgcgcuuccgggaggccgccgcaggcccgggcccagucccccgccgcgguccccaacgaacaccccgggugcccucccgcgcgggcugcggcuccgccacggcggccuccuccgccugcgcccccagcggggccgggcgggggacccccgcggcggggccgcucuguucgcgugcggcgccagcucuggcgcugcugcagagccucggggagcccgcggccgcccggcccauuccugaagcggggugcggaaaccgcagcggucccgaggccuccggaauagaaagcgcggccgcccgggagcgcggcccuggcugcuucagggaucugguccggcccccacagccuccgccccgcgccagccgcccccagucccgguccccaguccaccuccacaggcccccacaaccacccgucaccuuggcuaagugaccgcacaggaccaacggcacagccacaccgggacgcugaagcaacugacgcgccacccccgcgccugccuuauauagcgacgggcccgcccagcgcgcggcgcuuuuuccagaagccucccgaaccuucc

SEQ ID NO: 21293 - RNA, 26345 nt, Homo sapiens
aaaaauuugaaaagcaacuuuuauugaagaauuuggagggaagguuccauauuauauuauaauaguaaaaauacuaaaguugaauguuguaaaaaaacgccguggugcagcggcagcggcagcgucuggccaggaggcguggaggggcccagggauggccacccccacagggagucagggagggccuggggcgacagcggaaagguuaagcgucgaaaaggucaagugcuaccguggagagaucaucugagggggaggcucccggugggacagucaccaagaacugugacacagaaggggaagggggagggcuuuccugucacaaagauuaaaaacccccaaaaugcauuugaacaacauaauacacaauaacaaauuuaaaccuugcuccucugucccacuggguaaacccuggcccaucccccaucccuggucccaucccaggggcccagccuccgaugacguccucagagacacggccuuagugcuggggggcugcugugugccugccacccccaggagagggugcuggccagcauaccauagugagguugcaucuggugccaccagguugaacugaggcccagggccccagagagaugacagauagcuggugacagacagcccagggcggcuggcugacagagugaggggacacaugggcaggaccugcccggccccccaaugccacauugcgcauagcugcagaaguccuuaacauuucccuacgugaaucggauuguucugagggcugaggccacacccggagaacaaacuggaugaaauaaauuaaaacccgcaggauaguuuucuucccuaccccgcugcgggggagggugcugcccacagcacaaaaacgucuuuccaucugggcucgagaggacagcguggcuucucucaaaugcacccgagaaauaaaaaccauuaaauacagaucauggcacgaggccgccucuccaucccuccaagcuaucguccagcgcaguccaccgccgccucaggccgugccgcuggccgaguaggagaacugggggaaguggggccugcgcucgcuguccacacacuccaugcugucaucuguggguguagacagcucagaccccggugccccaccucccugccaccuccacccacccacagcuccaguaggaagccaaccucuuaaagcacggccagcacgcugccauacugccaggaaacugagacagggccccacagauugacacagggaccugggcccucagagcacugccucccacccugaucauuggcacucuccaaaaggaaccuuuuuaaauauuuagauuuuaaaacaucugaagccaaaaaagcugaacacugcaggccucucugaguguggagagaaaagggagugggcgggggcaggcaguggccccucaccuuggucagguggugugauggugaucaucugggccgugaacuccucaucaaaauaccuggugucagucuccgacgugaccuggggcuugaagggugggcugagcugcagaggugggcagacgggacagucaugagcuucgcuccccacucccagcacacccucaagugugcucaagaccuucaaagcaccuggaucuccaaggggucuccaggcaggacugaugucagagagcagcaagccaccagccccccacagaggcagcucugggagggagggacaugaggggugcaggagcacggagacaacccucaacagcugagacgcaaagcugcccucacagcagccccagcaggcgacaggagguagugcagcccagcucugagagacccucccugcuaccaggaggugauaacuuuauuuuuccuuuuucuuucuuguuuucuuauuuuucuuauuggucuucuuguaaauugggaaagagggagacuguggaacaaggugcacaggaugagcccacccugccuccauggcucagggacuacaggaccacagccugcuggcaucuggcugcagacaggacucucaaugacccaggaugaagggugacuauaaggugaugugcacacgugaggagcugccagagagccccucaggucccacagucaaggacccccucaagcacugccccaccccagagucugggcugggcaccagcauuguccauugucaauuagcaaggucucuggucaaggcugggcagagguugagcacugcccaggccccccauacccuuggagggcagggcaggaggguggcaggccucaaggcaggaacggggaccaggaccagggcacccuguguuaaugggagaacaggugcccagcugggucccagggcugcccagcccgaccagcugcacacagccuaggacaggcauucaggggaggggcaggcugggaacggggcagaagcacaccuggugacagggcacccagcaucucagagugcaggcuuccgaacccagcuggcagaccccaucagcuggggugauggccagggcuccuagggucccugaaagaugagcacccaggauggcgacucaugcagaaagagcugccucccuccagggcggacucccccaugugccagaaaaguaggugcugucccugucccugcacagccagaaauagggcugggcucuccuugcggcagaagggauugaggucaaacaggaggaacucguggaggccaaggggcagcaccccugguccaccaccagccagccuucacugcacagcgucagggaagggaaccccaaggcuggcacucagagugugacacaccuccgaggggaggaggaaacucagagugugacacaccuccgaggggaggaggaaaugaggaccaggccaguuuccugguggaacccggcagugccagagccucugagcaccaggcgcugagguuggugcagcaaggcccuccuuguaccaggacugcagcaggcuccugaggugagggcgagugugugggaaaucuggcgagcgugccacgugcaugcgugaguguggauauguggggagcaugcgugcgcgugaauaugcggggagcagccgcaccuucuucucguacacgugcugccacacgauaccggcaaagaagcgaugcugcaugaucuccuuggcguccucggagcccccgccaagccugcaggcaggaaacaaggccacagugucgguaccgccaccugcccaggcccuggguucaggccccuuccuccugugauguagggcccgccagacaggacguuccggggccagggaggggagccgguggugcagcgucccugagcagcuguggguagcaaagcaccacagagcucacggcagggcaggggcuuccugagugggugggugcaggcugcaggguuggggacagaggcccaacugaccccggccugcccgccacucugcuugggccugaggcuuuggagaucagcccuggccaaggacaucaagcuuuggcuaucaguguagucugggaggugccaggaccgccuggcgcaggggcaggugcagccuggggaugaggggauggagguguagccuguagcugggaugggcggcccucaccucugcuugggguccuucuugagcagcccugaaagcaaggacuuggccucgggaccaagcgugcgcgggaagcggaucuccuccaugaggaugagcucaaaaagcuucucaugguccugguuguagaagggcaggcgaccgcacaucaucucguacaugaccacgcccagcccccaccaguccacugcacggccguagucauuguccuccagcaccugcacggguggcagaugggcaggacucggcaucaagggguguccgggacacugccgggggaggugugacgugcuuggggcacagagaggacacagcauugcgugugcucaggacguggggacgcagcaacgcguaugcacgcagguggggcgcacaccucgggggccagguacucaggugugccgcaaaaggucuucaugguggcaccguccuugauccccuccuugcacagcccgaagucugugaucuuaaugugcccguccuuguccagcaugagguucuccagcuaggggaaagguggccucaggucagugccgccaggcccccagggcccugccccccugccugcccgccagcgcaccuugaggucccgguacaccacguucuucuccgagugcagguaguccagggcugacacaaucucagcgccauagaagcgggcccgguccucggagaacacacgcucccgggacagguggaagaacagcugcgggaggcgcaaccugaggcacagccguggcucgggccucugcccccauggccugcagggcugggguuucucagaccgggucucggcauugcacagggaagggaccagccaccagagggcacgggggccuggaaagucucagaagcccuaacucagcaggaacaagucaccccacagcaggcagcugccugggcaggcaucacaccacccacccagcagggagcaccgucuggugccauggagaguagccgaggcuccgggaaggaccggccccaccaugggcggcccacaggccgcgaaguccaucccccgcagccccagccccuaccucgcccccguuggcguacuccaugacaaagcagaggcggucgugggucuggaaagaguacuucagggccugcaaggaaggggagcuggaacugcggccccacaggcaggacggcagccccgcaccacgcugcccgacaccacgcugcuugauaccacgucgccugauaccacaccgcccguagccccacaccacacugcccgacaccacgcugccugauaccacaccgcccgauaccacacugccccacaccacacaccccaucacacugccccacaccauacacccccacaucacacugcccccaugccacgcugccccacaccacacugccccacaccacacugccucaugccacgccaccaucaggcugggccccggcagccccugaggugccaaggaguguuugaaaggugagcaagguggccugggcucagguccuccagggugaguugggaccucagcaggggacagugcucccagcaccagggccuucgcaaagggaggacacacccucccaggcgagacccacccucccgccuuccaccacaggcgacugugcuuuuaaagcaaaggccccaucugcaggagaaucguccccaaacacagugaccuggaacuaaccaaguggcuggacccuggcccccuucacaguaaauaccuccugggccaaguccccagaacagguucugcaggacagagcccgggccucaacaaaagccuggcaggcagggcugcagggcauggggagcuggggccuccuggagccucggcagagugcaaggaagaccagggccaccugccccacccaccugcccgcacacgggagcagcgagcacagccccuagcccacacugggcaccuccacagccugacccuccagggcaggccugucucaccagcggcggaguccacgguguguaaagcccucacgugcccaagaagacaggacaucguccccuagagacagccccaggagucgcuaccuggccccagcccuucagccccaucugggcucccacucacugugaggaaggggugccuggaguucugcaggacgcgguucucggugagugugugggccaccucguccuguaaagcagggcugggugagcugccaccccgcacccucaucuccacccugccccaccgccccggccccaccuuggccacgaugacuuccuucuugaggaucuucauggcguaguagcggccuguggccuucuccuucaccaggaucaccuugccgaaagugcccuugcccagcagcuucagguacucaaacucguucauggucuaugggcaggcaccagggucagcaagcggcgcugccaacagugcccagcuggucggcaugcgugggguggcaugaggggccccagagucggaggcagagccaggagaggcguccacuucacaccugguggccuacugggcucagcggggaguccaggcuuacagggaacacauggcugcggccccagcucagagcaugggguucagggaagggugggguaacauugcccaagccuggcagggcucagcaaccccaguuuuccucugacauggggaagaggacccaccugggaagcagcugcgcccuacauggaaaaccggccuagguggagaugccguggagugcugagugucuccugggccgagcugggaccccaugacccacccagcccuccacaguccaaggcagccccaggcacaggcagaaguggggacaggccucaccacgcggugcuugggcuuggccagggacaccuccaucucuucagccccugaguugucacugggugagcccgaccggaaguccaucuccuccuccuccugcuucuugaggccgucagccacagucuggauggcgguuguccacuccucccugcaggaggucaggugaggcugcaggccuguaccagaucaggagcuccaccccacgucuuucacccacccgccagccucacaagcgugguuccacagcugucgggguucccagagacagcccugaggaggccaccacuugaccuggucuggccacauacacucagggucacgaagcccucuuggacgugggggacacccaggcuuagccccccagcaggacucuguccccacaaccggacuccaacccccagcaggacuccgccccccagcaggacuccgccccccccaagcaggacuccgccucccaagcaggacuccgccccccaaggaggacuggcccucuccaccggguuuuucuuuuuuugagacggagucuugcucuaucgcccuggcuggagugcagugguaaaaucucggcuccugcagccucugccucucggguucaagcgauucuugugccucagccucccaaguagccgggauuacaggugugcaccaccacacccagcuaaguuuuauauuuuuaguagagacggggguuucaccauguuggcaggcuagucucaaacuccuggucucaagugaucugcgcaccucggccucccaaagugccgagauuauagacgugagccacugcacccggucccuagccaguuuuuaucuccagccucaguuuccccacccaaaccccacaggcaggacugggccaguuuccaaacugggcucugaggagggccugggagcacuggggagugaggauggcuacaggcagaggugccagcaccccgccauccccgugucccuccuaagcgcuggggcugcccaagugccuggccuggccgccacagcccacguaccgcuccucaggagucuccacauggaaggugcguucgaugacagugguccacugcaggcagcggaugaugaagguguugggccggggccgcuccgucuucaucagcuggcacucugcgggcaggcagagccucugucugcgugcaucccccugccccucccagggcccucaccacagcccccgcugcaccagccagcuccccuugcauaccacccaccagguccugggaagccccaucucuuccucucuccaagccucaguuucucgccucacagaguggggcuaggaccccuguuccagcucagacacucuacuccaggcugaggcagccacacagggcaucuggcccggcgucaggucaaacccccaccaucguccacuccuacaguccuuccuucagucucugagccccgccgugcgccaggccucagaggaugagggguauggagaucccacagaggggcuggcaugaggggggcaccccagaaaccugcuugucccaccuaguguagaaauguccugcuuuuuucccaaccucacccugaguaccugggaaauacagccaccuggagcacacccacaccuggggcacacccacaccuggggcacaggcacaccuggggcacagccacaccuggggcacaggcacaccuggggcacagccacaccuggggcacacauacaucuggggcacacacacacuggaggcaaagccacaccuggggcacacgcacaccugaggcacacaccuggggcacacgcacaccugggacacagccacacuggaauacacagacaucuagaacacaucuagacaccuagccacaucuggggcacacgaacaccuggggcacacgcacaccuggggcacagccacaccuggggcacaagcacaccuggggaacacauaccuggggcacagccacaccuacagcacguacacccugagggcugugggaacgugcggggcccugagaggugugagugaguggaguguguagccgcuggggcuccguggcaggcucuggcccagccugugcaaagcaggaggaggcugaggggccaguggggggccucugacauuccagcaucgaggcccuggcaaccacaagggggccuggccaggcagcaaggaagcugucuuccaggccugggggccaggagggggcucgggaccagccugguggggaggguggccugugucaacacaggccagagaaguggaaaccggugugaagccccggcacacccaccucccacucgcuccuggaugguccgaucugccccaguaugcaauccccagggccagagucucgagcccacugccccggaaccguuccccggagaaaagccccggacagaggcccagcacagccccuggccccugcccagcucugcuccuuggccaggcgcuccaggccacucaccuauggccuaaucugaaggccccagccuugccagcugcucaggcaacaccuccagcugguacccacccgugugccucuccagagagcuccccaccucguuccuucccaaugccucggccuggcgagcacacccacagcacccacccccagcaaggcccugucccaggugccaccaggcacgcugcuggcacccagccucucccugaucccugaagcccccagccccaaccgaggagacacuggggagggugugggacaagucacagugagucuccugcaugguuacgaggcugucaggagacaggggugucugccuuccuggucuccccucaccccuggggugcccuacucuaucaggcugcccugcuacugcuggcuugaggcuggaagagccagggaaggagaccucggcuuacaggaaccagguccugguaaaccccaccccaaccccagccccucagccuggggcuuugcagggcaaggccucugccccucccaacuagaagcuucagggcacgguuugcuggccacagaccaccuagcagccagggugccagacugaccccaccuccccuuauacgugcaggcaccaagggugggaguccuucccugcccagccuggggacggauucccugcauuuaaccuccucccagacccuggaccagaaccuggggguccagcaaguucaagggagucggaggaccgcaggccucaaagaaaggagggcagagcuacuuggaggggaggggccgaugcagcacauggggauggaaccuaaggccagccccuggugggcaccucgcucugcaccacagaccugccugagacagaucccagaggccugcaguuacccagcccugccacauacagauggcccacaacugggcccuaauuagccacucagucacaccugcaugcccaacccgugucucuggcugccacaggcagagcugggcuccaggacagggacacagaaaauggggaccaugcugggaggcccacguguccccagccucccaccuagcagggcgccugggucuccaugccaggguucccgucugacauggguagggucgcaccugcccccgcuacagguaaggaauaaagccacagcagggcggagcagggagcgucacaugucucucaucucugugggaugcuccggccaaggucccccgcuggccuuucugcaccugccccuccaugggcaaggaggcagccucacagaggggaagcaaaggcucugccauggggucuggaggcugagagccugugcagggagaggcacgagcucuuccucgagugauggaggcuucagagcuggagaccccaauggacucuugcccccucacccaagggguuucccaaggagaggcccugaugggcucuaucuaacccccuuggaggaggggcccccggggcagcuguccacccugagacugggcucugcugccacuuguccggacccuccagcuuccagagcaugggcaccagggaacugcuccagggucagccagccuugggacucggcccagagacccccgcccagccagccucggccucaggacucugcccagaaaccccugcccagccggccucggccucgggacucagcccagagaccccggcccagccagccucggccucgggacucggaccagagacccccgcccagccagccucaggacucagcucggagaccccugcccagccagccucggccucgggacuuggaccagagaccccugcccagccagccucggccuuaggacucagccuggagacucccacccagccagccucagcuuugggacucagcccggagaccccugcccagccagccucgggacucggcccagagacccccacccagccagugcuuguugcuugccagcccaggacuuggaggcuccaggggacccccaucguggggccuggugggcaaagagggcuccagccaaccccccaaaucugaaucccgagaggccaaggggauacuuacgcgccacagagaaguuguugaggggagccucacguugguccacauccugcggccgcuccuuguagccaaugaaggugccaucauucuugaggaggaaguagcguggccgccaggucuugauguacuccccuacagacgugcggguggugagagccacgcacacucuacccgucagacccucgccaggcagccaggcaggaacugggugugccaggacagaugugccugggaugccugagucccagggggcaggcgcgguacgggagcuguuucuuagggccagcgacagaaacggcccugggucaacgggaaggcagacucgccccaccacagcgccccucucagaagagccaccccgagcugugucugaaaacgggcugggccagcuggacgcaggggauggaguaccauggacaggaggcugggaagaggucugggccagucugcacagccuuccuggaggaggcagcccuaaaccagccaguccccagcaggcaccagcagcagcucgggccccagcuauggccacaggggcugcggggcugacagcauuccccaaucaaccagggucggccagguggcgacagcaggugacaguggcuugugugggcugcccagcauggccgccccccccgccccgccgccacccaccaggaggauggagcauggcguccacaguuagaggucagcaccacucagacugagggccgggcucgcgggacaggacugcccacugccgugggaucgcacucccugucuaggggccuggagcaccgucuuggggacugccgaugaagccagacacggagguggcccagccagcugggcaggggccccagggcacagagggugccaaguccccaggcugagacccacacucaggcccugccgccgucggcccugccgcgucccacccgugggucauucagguacacgggaacauucucccucaaguuuugcagcaucagccguacgcaggcguucacacuucagaaucagagcagcuguccucggugauagcccagcaaguaccauuuuucauacugacacucggaaaaaaauguuccacuuacauuuugccaagcaaggaguuugaacaacagggaacuuacuaauuaggcaacugcuucaucugaggggucacugggcagggguuagggagggggccaggguaagggguuggggucccugagcucuggggccuggguuuucaugccacacugagccccagacagggacaccuggagggaugugggggacaagcaauugucccaucaccagaccacccaccacccaguccugcugggucuucguggugagcccagacgcguccagcccucccuggugcacagggaagucccagcagggcagcagccccaggggagcucagaggacaugggucaugggcaucccagcaggcauucuacuuuccagggagccacgggggaguucuuuaauagaggugagccaccaaggcucgacacauggccaccccccggccaggugaccucucccuccuaccccggccccagcugcccaaugcccuucccaccagcaccacggggcguggucuccacaagaccagcccucucucugcccaagccagggcugcuggggggaugcugguggaggguggggacaccccacccagcagggccugagugugggaagaggcuguugucaggucugggguggaccaggaaggggacagccacagcccacucauagcugccugacaccucuggaggacggccaacacccaguugcagggaggaugauccagggcccagaaucugccccugugcccaagagcacucaucaggagaccccacccacuccgcaagcccuccaugccccugccagugggcugccgagcaggcgugguccugccacccuugggugccggcuccugucccugaccugggaucucgcacacccccgagugugcacauacacgcacauacgugccacgcagcuccaccccgccucccacguccccucccccagccacagggccccugcaggugcagcgggcaggcaggggcgcucagugagagcagagcaggcucagggggcugcaugcagcccaccccacccgucccccauccugggccaccccgcugcucacgcccacccgccugcaugccagucuggagcugucggccccugauggagugccucccauccugccagcugccacuccccgggacgcuaacugagcgggaagacugaugagcgcccaggcccggcaccccugaaacccaucuuauccaccaacugcugccagcccccaccgugcccagcauggccccgugcugcccccgagcacgcagcucccgugcccaaccccagccuugccccugacccugcugccacaagcccagccccagguucugugagcugcaucugggggguucugggagcuggaucugggggugcgggaggggcaggcccaggggcggcgcuuaccaggcguggggggugggagaggacaggugcccagccccgagcauuccuggggaguccugggaugggcagaggcccaaaugggcccugggcuuucagugccuuccccucgccuggccccacagacccagggaacagacggcgaucagggccuaccccaggagacgggugugagugaaggggccucacguggccuuugucuucggcaucccagcccagcacacagaccccuccaggggaggagcaggauccccagggacccgggguaagggguccagagacacacaguucucuuucuucaucucucgccuagagggucagcuagaggaucacuugggggggugccagcugcagccagggccguggcgcgcaucuuaacgaguucagcccagacaggaugcugggugggcggccagccccgacagcagaugcggcagggccccacuacucccugauccaggacuggggugacacaggacggggcagguggaggagacagccacccggggcccagcaucacuguccucauggccacaggacgccugcaggccugcaccugccuacuccgggucccucaggagggugggagcacagacacaucagccagggcugcccucccagaccccucacacaaagagaccaacccacauggagucuucuccuucacuauccugaggguccccaggggaacuggaaccugucauccaggacuuaacuugaguuccccacccuguugugguccucagaugccccccacucgaggcaggaguacaguccacuugaagaguggccucucaaucccugacaccccaggaaaagugcccugcauugcugggggaacuggaaccaggcaguagggaccucguccuccacaccgaccaugggaagcacccgccacagaggggccuuccaucuccccaccaucagccagcuggcauccccccaccccaccccagucacccccccaacaccaccccacccaccugccugcacagcugagggcaccaaacacagagugggcacagacccccagguugccacgccaggcccucacuccagacggguacaggcaggcaacaaauggggaggccagggcacgccccaccccacacacagccagagucaucuccugccagcagccacucccaagggcaauggagaccgcccagcauucaggcccagggggccucuucagucccuaacucucacacccccaugcugggcucaagaacccccaaguccccacccgcugcacauguuucagacccgggaccuggagcaggcagggucccagugcaaccccggccugggccucagggucuggcagggaagacggcuaggugccccuucagaaaugucagcaaguccggaugggggaccccacaccacugccagaagaccugaguggggggccgaguggaggacggcacuggggacuggucccaccuuccugccccauggcugguccccugggcaagggggaagcagcagcuccggucccacccuccugccccauggccgguucccucggcagcggggaagcagcaguuccagucucacccuccugcuggcccccugggcagugggaggcagcagcuccggucccacccuucaggguucucucaaggccagcccugggccaggugggagccacccugacccuuaacccugugacacugcaccuauccaagaccagguccugugaagccacaagggcaggggcuccugugccugaugaaacccguaacccuccccaccagccagcacauccauggcccagggcuccaggcaugggagguggcugcccucggugggggguaggcaguuggccagacuccugucccugcccggggggacagcggagaccaggcucccucgacuccuccugcaccuccugggccccacacaaccccagcccuggucccucuggcaucccgaugucccggguggcccuccggcaggagugaccuuccauccccaaccccgcucauccccaggaaggggcuggagcacccccagggaaagaggguuccuucccagaaguccuccuggaccaaauaccgggguucugagaggaagcugcuccugccuggccucccccaacccaccccaccaccaccacggggaccacauggacagucacaggcagcccacccucuccacgccucacacacgugucccaggccacacugugggucaggccccccaaagcggcacccacuuagacaugggggccaggacccacgcgccaugggcaggacugggugggccccugagggccagcugguggcccuccacgucccgggacugaccaccuccugagccaccaggugugucagccccccuaggccaccacguccucagcucccugaacauucucucaaaguccccaguucucaggaaacugcuggauaaacacuucgcagagacggugguggcagcggcuggcagggugccaggcggcaccgagcugcuucuccacagcaaagugagcccagcaggcccugggagcgggcgccagcugacagcggccaccgugguccccacugccgacacauccaucgccccgacagcugccgggggcccauuuaccuucuccagcacauugagcagacggcuccgcugacggcagcccaugaggggcccgcaacccacccuccccgccugccaggagaccgcacagcucaccgcgaagggcccggccugccaggccucugcccgggcccgggaguacacaccccuuuaccagcagcccucgaacccuguaaacaaccaggcuggggugggggcaggggaggggccacacaacggaggccagcugaccccacuuggcuggagcccccaggucugugggugaaauacauccacugcuccucccggcacaagcccuucugagggggcacaaguggccagucugcacaaggagaggugucuguucccgccaggcagaggacuggcgcuccaccugccugggccucgcccagcccaggacccauucugcucucccagaaagcccaccaggcaggcagggcgggcagggcucaucaugcccaucagcucccugggaaaacggagacuuaggggaggugacccucagaggcagaucaugaccagagagaccccagguccugccgccaaggcagggguuguaacuugacacaaacugcaaauucuucaccuccuuccgcuccaccauggagcaggccucagcccgacacacacaccccgggaggaacauggugcgggcaggcggcaccaccaugaccccguccaccucgcugaggcacagccggaggcgcuggggccucucuuccugccacuccagggaagcaccugggucucagcuuuccauucuccuggggcucuacugggugggguacugggccucccuggugcugccccugacagaccaccugggccuggauguccucccccacaggcacugcccgucacccaccccucgggccggcaaaggcaccccaccugccacacacccauccaucgcagagcccagcacaucccaagacccugucccugucccugucccccaccucauuuuuggucugccccaaacaagccccacccaugucauggcccacccugccuacucaggaccccugcagaugaggcugcagccccucccuggcgccuccuacucugcccccgcccacucuccccauaacuugcagcaggcuuugccaagugcccuccacccaguggguucccagggcccucacccucgcucccugcgugggaggaagcugggcauggggacagcacacagugccugcugcgagggagggcuggccacagugucccacguguagacacugcccucgggaaaggaagugggcacgggcacaggcuccuuccggggcucggccgggggcacgcagccaugcccacagccccucccuccucccgucucucuugggcagggccccuggcgguugaagggcuccagugcuggccucucaaucccugacaccccaggaaaagugcccugcauugcugggggaacuggaaccaggcaguagggaccucguccuccacaccgaccaugggaagcacccgccacagaggggccuuccaucuccccaccaucuuguuucugccccaacuuggagccacgccuggggcaggagggcccccagagcacggccagcuguggagggugcuccuucugaucccccggccugcugggacauuguggcccugacccccguggccucaccccacaccucaccaagcuugugcagcucagcgucuccgcgcccuacaccuggcugcugugccccuggccccagucuguggggaggccagccagacccuggccagccgaagggccucucugcauucuccaggcccagggagcagccaccuccccgccaggccugcccagggggugucuccaccccugagcuggacaaccagcugagggccugggcaggugggcccgccagguuacaggguauggguggggucugcagucaccgggcccgccuggggggugugugagcccaaacacagcgccccaaggaucccaccccaaagcccgcaacauuggcagcagagucacccaugaacucccaacccccucaauuccaacguuucugaaauccaaaccuaucauuccuuaagguucaaggaaaacacaccuaaaggcggcauggcagggaagggaacucccguuggagaugaggaaguaaggggccuaggguucgccuaacagccccauccuggccuggagccccagggcccucugccaaccugcccggggccccagcgcugggcugggggaaccuucuccugaggccaugggacuaggcacaaugguccaagcagacagaagcagcaggcagcugcccacccaggguggccuggggagcaggcccagagccacagccacagccaccagucucagcuaugggagggcccgagggcagggugcuggccccaagccgggccgggugugcccaggcagaggggacgccagcgggggccgcgccaguucccuccgcucagccucgugcaggacuucuaggaacccggccugaugcaacccggccaggcuucuccugagaguggaagguguacgggggucuaggccccagcacaggaaucauuccacccacauucuguccacucuccugggccucaguuucccuucccggaguccagccccccacagggcaucccugcccagagagggccagugaccaagaaacacacaggaagaagagcuguccacucaggagccaccaggcgugggggcuaagguccagggcuggggccagcagugaccccucacccccacucaaggccaccucggcuuccucuuuuguuguuuuugaagugagaacucaacaagcucccaaaacaggaaccucccugaugcuggcggccuccaccacagccaugccaugaccuccaccagccugugccuccugccccucucccggguaggcccagggcuguugggacccccacucucugcccagcccucccaccaggagccagcacacuugccuccccaucucugucccuggccugcccacgggggccguuccagacccucaacgcucccccaggggaggcagagcuuggcacuaaccagcccagggcccgcgggucucacacugaagccaccuagacgcagccugggguugacccucaccugacagccugggaaaaacugaggcccaggaggcacaggcagcccuggccuggagcccaaagguucccacaggcugaggggagagucugcgggcucccucccucaggguccugcugggccccucauccuggcgggguaaugagcagccuccaucugcacacaaacaauuagcccugcggggcccuccgcagcagcugcucucuggagugggcucagagucccccacagaccucuucucaaggguguuuacucagcaaagccaaggccuccuccaggaugaaggggaguggccuguacccucugaggucccccaccucacgcagggaccccaggaccagcuggauggcugagcagcagcuggggaugcagugagguucuaugucgcucaccaaagcgaaguaacacacugggguaggaaccacucucucccugccucagugcccccccgcagggacagccagugccaggacuucaaggcggggagagggggugggaaggaggcccagccuaggcaccugcuuggggucagagaccagccuccauacuccccaccgggacgccuggggcuaacucagcaggaguggugagggggcugcccugaggccuggacuggggggucuaugccaggcaugggcccgggguagggcauggcaaggacucagauguccggagacuggacccuccgugagccgcauggacacacggucccgugucacccgggcccggccaggcacccagauccguggcuuggacacgcugcccacacacucaggagcgucugccgcguaacccacgcgccccaggcagcuucccucgacccccgcccacucggccuuggccugcugggucacagccugccgaaggcagccaggccugcagcucuuccccggccccucucggacagcgaccagccugagggaguccagguggugccccugcggccggcacccacuccuggccuaggcccagcccuuucucgagagcccagagcaccucauccugggucccagcaucccggccacccgccucggcccucuccugacccacuugguccagccauguggacggggggacgcucaggaagacagccgcgaguggacaaaaacaggcuccaggccggggcugcaccagggcagcucuccacggggcuaggcugcagccaggcuggugcacggccccaggaguacuggggcaagcgggcaaggugagcaagcuguuuggggaaaguaccucaaaagagccacacagccucuggccaaagccuggcacggagcuaucaaaggaaggaaaacugcaggcuggaggccgaguucagccagaccugcgcccuggcccaggauugauuuuuuaaaauugucagccuucaaaaaucaggagacuucacacaacagaacaaaucuuugaaaaugcaaacgucugagcaacacugagcccaccagaccaccaauggccagagcugagcugggcugcuuauccagugagacagccgaaacaggaggggacaucuggcccccugucccuauaggccccaccagccuccucacuagcuccugcccuuaacagccuaagcucacccuccaggaaccaucucccuguuagaugugcagacccagaggccucgccuggguccagccacagguccacacaggccugcagccggaacuccuguguccccaugcccggucccuucugucccugaagcuccucugacucagagcacacacaucagaacaacagaaagcagccugggccacuucccagagaugacgcucaccucccaaggagcaggagaaggagccugcagacacugccaccccaccccucacacacagggcauacccguccccucucaucucaaugaccacaucaccccugaaggcaccaucacgccacguguggccagcccaaguagccguggugggacugucaccuggggauucagcugagaaccaaagugccccaggccacggucguggggagucccggcaaaggggacaggugcgggccagccucugagacaagcacccugaccugcaggagcaaggcugggggggaguggaacagggcgucugcaaggggcugcggccgggccuggaggacagucacugcgucccucccucccuccccacccccagccaggccugagcacugugaagcacggguggggucagcccagcacagcccugcuagggacaggaaggcagcuaguaccucuaaccaguguugcggguggggcuggcccugccaggaggguggcacagcacaucugcaagacacacaggggaccccagggacgggaguggcgaaaugcggcaggccccggaggacaggcuuuccuccgcaaggagcggccggccaugcggguggacgccaccugcucucggcaacaagaggggcuaugccugccaagggcauaugucauauccacgccaccucccauccucagcgcccacuacacuggggauggaggaggaagagccggggguagagguacaggacccucucuccuggccugaggcuaggggccagaugacagagcccagaggcugcugaggcuggccggaccccaacucagggccgcccacaagccauucuccacuccaccaggucucucucccaccaccgcucccugguguagauggggaaacugaggcccaaggagcucaaugaccuugcucuuggaaagggucauggcgauagaguggcuaaccaggguucaaacucagcucucuggacgccccacugggccugauguccugucccugccaggccccuccugaaggcacgacaucagcagcagccugaaaaucaccuggccucgggggagcacuccugccuaggcccagcuggcugaugggugccccaguaacuggggccugggccccugggcagucaaggcccuggcaucuccugggucagcccgagauccaacagucuaucaacaaacacacauuugccaaggauaaagaagcagcggccccaggcagcagacuaugugacacagagaggaacagggccagggucggggcagggggucccugacaccaaagagggcugugaggugaggagaggaccuccaggcacagguggcaggacuccuggggaacaagcaggggacagcacacggggaggggauggagaaggcaggaugcggcaggaggccuuggggggaagcagagccagaagcuccccaaggaccacaggcgucugcagccuccuugucuucaucucgaggccccgcgugccaucacugguagcugcccacucaaacacuccaaacacacagccagccacaccccugauucccccagcaucucaucucggucacuccuucaccccacccccaggcuccuguggcuccuuaggccugcucuucugugagcuccuauacaucccacaaugccccaucuugugacaccuacuuuugccacaccucccugucugcuccagcuguguuuggggucuccccacuaccagaugugaaacccaucugcuagaggguguacguaaagccggggggcugcuggcaugagaucacuagaacuuaggagggaacaagucuggaaaaagaagucaggagagggcggaccgauuccgccuggggcagaagagagugacuuggccagaggaccuggaccugaacaggaagcccacccuagcaggacagaggagcaaaacagccacccagacuccaccgcaccccgcugagcaacggagggugggugaggcagaagggccugcacaggguuggaagggguggggcuauguccccagcucccaucccacccagcugcuggccaggccccucgggcagcaccuccuccauaggcugcaaggccaaaugagugaggagggggacacaggggcugggggacuuggcucagccagcucugcagcuccaaggcaaacaugcccugugcccaggcgguacggauuccccccacccccaaagcucaggccugaagcaggcaccaggccaagccaagcagcccugcccugcccucaggagcccuugggcagugcccugggccgccagcgugccagacccuggaacagcccaguguccucgcugccuuccaggaaagccaggagagaggcuggcagcagcucccccgccugccagggcccacaccaggaagccacucagauggccggcccugcacagggccucauccuccuggccuccccgaggccgugcccuccaugccaugggaagacauggggcccaggacacucacccuaggccagcccaggagccccaggggaggcagccccucccacccagcagggcacaggcacucacagacccuggggcuacuacccccaucucucccuccccaggcccagcccuggcagcggguacuaaccucguuugugcagccaacccuccuucacaauagccacgucgcucauggugcccgaggcucccgcgacgcucacgcgcuccucucaggcuggcgcuccccgagcccagcuggccuggccacagccucugggagaagcaaaggaagcugaaugugaggccacgccuggcuaagggcagcuccucgcccugggugagccagagacccacugcacgugccugggggcuccacccgcaccugccuucccaggugggcugccaucccucuaagcucucugacccccaucugcccgccugccuucccucuccccaaaacacucagggcugccaagugucaaauccauguaauugaacacaguucccuggaccugggccucuccuuauucuaggcuuagagccuccagccccugccaccaccacccgcaacagccaggcccugagagcugcugccuugcucaccuccccauucccaccucccccagccguuggacaaaucacccccauccccaaaaggccuucccagccucccuaaccugaugcaccagcugacaggcugccuccuccaggcagccccuuugacuucuuugacccaggcuggcucggccuucccuaagccccuggugacagauggccccguuugcucucccuguccaugguguuccuacccauggauccugggacagggcacagggcuccucccugcuccccagacuaggaaagcaaagaaauucaaacaugaggaagacaggaccaggaugcaggccacuggcgcaaacgggaguccagagcccuccagcgcaagcccaaaaaccuccugggagaaaccccaggccccuccuaaaccacagcgccccugccggucugaaucugguucauucauuuggccaacauguaccgggcgucucagguuuugccaggcccagugcugggcgcuggagacaaagagagguucagacaaguccgucagugaggagcacccaguccagggugguuacagacccauaauuacagcagucgggaggcagcaaguaagugggggagcacuggacaggcccccgcccugcagcggcccaccagccaacccucaccugagcacacuuuauccauugauccugcauggcuuccucauuuccccucugauggaugaacuccuaggcaucccucaaaacccaguucccacaucaccaacuacaggcauccccagaaagagcacuucgcaugcucuuccugugagcaguccucugcuacccuuccagaugggccuuccugaggggaggaggguccucucugggaccuccaggccaggcagagaccccugacgaccucuguggaauggaucccaacaugggucuuuccacagccagcuuagacgcucuccccccaggccaccuuucuggccucccgaggcaagggcuggacacccacaaaggguugcuuugcacugauugucuuaagcuacacuuagaauggcaggaaggcccacugccuugugucuaaugccaggacagggaagaccacaccuuacccaaagagggaaaugccccaaguacuuagcaggauggaaagcaggccagacucgaggaaggcaccgcaggacuccgagggcagggcuccgagccgcgcacgccucaggcacagggggcucugacgacacugagugggcguggccuggaggcagagggcuggacucaaagaccucuggauguccccccacccccacacgggccugagccccuccaaggccugcugcugacagagucagacagcuguccagagccauguguaaaaauacaucugugcucacacagggugguguacgucugcacagaaacguauacaccaggccagcacagggcugccugugggggcggagggaccccgacuucccacagccuccguaccugccgccugccuuuaccauaagcacauauucuugcuacuauuauuaagucacaacuuaaaaaaaaauacucuguuuucgaaagggcuccuccaucugccuccagaacccugguguaugagaagucuacacagcucccgggagaggcaaccggacccccaccaacggacuccguccgcccuucgcucggaugagggacucaaagcagucaagaaguggccaccuggagcaaggccgagagacccaggagugaauguggggcggccucuggcugcagagcaggggcccaagcucacccgcugaccaaggcagcacucagaggccgucccgacaggaccaagcucgcuagcgccccaggauacucaaucuaaggggcaagccccagcugcccuccaagccuuggccucugggaugggcgggcaggaccuccagggcccacccaagacaggaagcaguuccggggcccaggagggucacaguccuuuguggcuagccuggguaccccgccaccacguacaacuuuucguccgugggaaacgaagucuccuuccggggcccucccacaaacuugaaggccggccgcggcgagucuuucuccaaccccggggcaccuccgccggcugccucgcuggcccagcgcccggggagccccacggcccgcaggggcaccccgagccccagcuccaggcccggcggcgucccuucucucgggucccggccucgcccggcggagcggccuccccaaggucaugagggaggcuggggccggcagccugcacccccggcgcccggcguggggccgcccucccuuggccgggcccgcgcgccccgcgcccuccccgcccaggcccgcucggccacuuccugcucccgcuccuccauucuggcggcgccgcggcucgcgccccggcccgaccggccgcgaacaaagcggcccggcccgcggggaggaaauccaggcccgggcggccacggcgggcggggacucaccgggccgccgcguccgggcgcgagcgcgggccuagccgggccgcggccuccggcgcccgccgcuccgcauccccgcgggccggcgcugggcggggccgggcuggaggccgcggcgggcgggggcgcugcucggggccgggccucgcgugccgccgccgcucggugcccggugcccagcgcucggugcucggccgccugcucccgu

SEQ ID NO: 21294 - RNA, 2760 nt, Homo sapiens
gccacgugaccuugcggccccgcccccucgcccucuagcccccucccgcgggagucgcggcgcugcggguaggagccggguugcgggagaccccagguucgguugggauucccagccagaacggagcuuaagccgggcaggcgagcgaaugacggaguagcgagcugcacggcggcgugcugcgcuguugaggacgcugucccgcgcgcucccaggccgccccgaggcuuggggucuucgaaggauaaucggcgcccggggccgaacagcgggggcacacggggcgcugccgaagugcaaggccacggccagagcucgagcccgacgcgcugucuggagucguagguuggcgccguuuggggucggggucugaggcuugggcgcugccugggccgagcggagaucgggguuugccucccguccccgcucaggacccugacguggcugaagcggccccgggagcaugagcgggcagcgcguggacgucaagguggugaugcugggcaaggaguacgugggcaagacuagccugguggagcgcuacgugcacgaccgcuuucugguggggccuuaucagaacgugagugcauccggaggggccaggcacggugggcgggggaguggggggccgguaaucugcaccuauggccccgaucucuucccucucguugcagaccaucggggccgccuucguggccaaggugaugucggucggagaccggacugugacauuagguauuuggguaagucccccggccaucuauucuugggagacucauuccugaggagguguagguccugccuauuacugguugauuuguggccucacagacccauuucucauagacccguuuccuuaucuggaaaauagcggggucuggagaacguggccuuaaguuugacucaggccuuacucuuuaggacacagcaggcucugagcgcuaugaggccaugaguagaaucuacuaucggggugccaaggcugccaucgucugcuaugguaagggggggggggguuugggcugucucacaagaaaagaugggugccaggcuagccagagaacagcccuugaccacuugguugucuccugcaugccgcacaccaagaccucacagacagcagcagcuuugagcgagcaaaguucugggugaaggaacugcgcagccuagaggagguaggugaacagaccucacuagaacacuaggggcugggguuuuguuggccuguggaggugacccuugucuucugccucagggcugccaaaucuacuuauguggcaccaagagugaccugcuggaagaagaccggaggcgucgacguguggacuuccacgacguccaggacuaugcagacaguagcugcuccucagcccuuugggggguggggguguguggcugucuggguggaucaaagaaaauagggacugccuuggcugccagggcaaggugcucuaggaggucuuccuggccuccuugaacugugggguccaggagacucccugaacugcuagcccucccuuuugucuguuuaucuaauucucagguaugaggcuuuagucacuucucuuuacagauaucaaagcucagcucuuugaaacauccagcaagacaggccagagugugggugagugcugugcuggagccucacagcaggaacaugcaggggcaccagaggaagcugaauagggcacagagggcugggucacugggagaucccagggcuacuggcauugggcccucgcugaucaucauuuuuccugccagacgagcucuuccagaaaguggcagaggauuacgucaguguggcugccuuccaggugaugacaggugugugcuuccccagccuuuauggagacuuacucuaggcccacagcaucuagccccuuuccugaguuaccugaucccaacagaauggugcugagcugccaccucucuuuuugacagaggacaagggcguggaucugggccagaagccaaaccccuacuucuacagcuguugucaucacugagucagcacucaccuggccugggggaauuaaaggaauuccccguaagggcuggacccagcuccuuucugggcuuggguagucaaaugucugagcuaccccagguccucaugucagcagaguggcgccugccugugcuggcccauggaacggagacagcauugggcugacugugggcaugaggagggauaaggcugauuuggaccccaggcuucugcccuggacagcacuugugucugcagauuauuuaaguggcuuuugaucuguaaauaaaaucagugcacugugcaucacacccagccccuuucccugcuguguggauuaggugucaagacaccuaguucuuccuggggccacccggcuggccucacugcuuauauuaaggcuccucccaacucucauuuuccuuuggaaaacaagacuuuuuuccccaugguuaccgcugagauacuggggcuguaguaguauaaaagcucacaguuccuucugagugcugaaaagagugcaugaguugcuucgaaauaaaagggucaagcauuccuaccugagacagguuggucugacuagcucuacugcaucugucauguuugggccccuaugucagaccugugacucagguccugagcuucccagugacauccuacaaugugguuuaaugguaggaaaguccuaaguucuguaagccagaaaggucuaauggauccagauuugguuccaauucagcugcuaauuuagaaaagggacuuaaauccuc

SEQ ID NO: 21295 - RNA, 6307 nt, Homo sapiens
cggcucgcgcccuccugccgcagccaccggugagugccgcgguccugagauccccgggccggaugcgcggcggccccagcucccgagcgucugccucccccgcccugggcugcccgggcucccugggcuccccggcggcugcacggagucaaggcgccccgucccgggcgucccccgcgggugccgauccaggcugcccggaguccggagcccagagaggagagagacagcuggggagccuggucaccgcgggcaucuccccugcgcugcagucgcccgccuggccugccuucccguuccuccgccucuugcccugacuucuccuuccuuugcagagccgccgucuagcgccccgaccucgccaccaugagagcccugcuggcgcgccugcuucucugcguccuggucgugagcgacuccaaagugagugcgcucuugcuuugacugaugcugcccaaggaccucugaucagcaccaggggagaggaggggcugcucagggagcugggguccuccggauuccauccacagcagggccagacucuccccaggaaaugggacaggguggcagcggaggcuugagaaccacggggguuggcacuggcuggcaagggaggaagaggccgccgggacugccccagccugcgggcaucugguagaugaagcuugcuugggucaauccauuucuccuggcuggaaacccauggucuuccauuugagaacuagauacgaacagggugaggcgagagggagagggaagaguggguuuugggauuggggccaguuuacccucacccuggagucccuggagcaugggaccuuugaugaagccuccucccgaaucucuuccagggcagcaaugaacuucaucaaguuccaugugaguauccaccccuacaacaguuggcugcacagacaaguugggaaggcuucaggggacauccccucccugcccucugcugcagggcugcgccaccccuuaccacuuccacucccccucgcuuaccccaccuuuguucucuccagcgaacugugacugucuaaauggaggaacauguguguccaacaaguacuucuccaacauucacuggugcaacugcccaaagaaauucggagggcagcacugugaaauagguauggggaucuccacugcaacugggagagaaauuuggggacagggagggaugggugggaggcaagagcaggcaggaguuaggagcuggagguagggugggugacaucuucaucccuaugugacaagcauaaacacacacacacgcucacgaaacaguggccacacaaaugugaggugggguuggaaggagacccuguccagucuucuggcaggucugaaacgacaucuuuaaaauguccguuggcagccgggcaugguggcucacgcuuguaaucccagcauuuugagaggucaaggugaguggaucauuugaggucaggaguucaagaccagccuggacaacaugguguaacccugccucuacuaaaaaugcaaaaaucagccuggcaugguaguggaugccuguagucccagcuacuugggaggcugaggcaggagaauugcuugaaccugggaggcagagaucucagugagcugagaucacaccacugcacuccaacugggcgacagagcaagacuccaucucaaaaaaaaaaaauaaaaguuaguuggaauguucuucucuuucucauauucucucauccuccuguccccuuguagauaagucaaaaaccugcuaugaggggaauggucacuuuuaccgaggaaaggccagcacugacaccaugggccggcccugccugcccuggaacucugccacuguccuucagcaaacguaccaugcccacagaucugaugcucuucagcugggccuggggaaacauaauuacugcaggugaggugggggcaacaaggaccaaaagcccucccuacagcuucccagaaaccuuguuaccauccccuucucccagagggcuggccauagcacaagagaagugcggccucugguugagucuucccugaggggaggaggcagggaaggcccucuggguuggaaugacauccccuaucuuucuguguugccaggaacccagacaaccggaggcgacccuggugcuaugugcaggugggccuaaagcugcuuguccaagagugcauggugcaugacugcgcagauggugagcaucacugaccugcugaugacagugggguggaaggggacaaacuuacauguccccuuauuccaucacaggaggacugaggagguggggggugcccgagagggaugcuuucuccuaccugccucccuaagacaucccucuguuuguccuccaggaaaaaagcccuccucuccuccagaagaauuaaaauuucaguguggccaaaagacucugaggccccgcuuuaagauuauugggggagaauucaccaccaucgagaaccagcccugguuugcggccaucuacaggaggcaccgggggggcucugucaccuacguguguggaggcagccucaucagcccuugcugggugaucagcgccacacacugcuucauguacggcccuggguuucuccucuucgacucuucugccccaccccaagcacaucccuuucuccuucccagcaaaguguuccgccucauuucucccucaucugccccuguccaugcagcccauggccuuggggacaagucgugcuuugaggccucuagggagggaaggaagaaguggcagauuucaugggacuaagcuguuugauggguaucuucucccacagugauuacccaaagaaggaggacuacaucgucuaccugggucgcucaaggcuuaacuccaacacgcaaggggagaugaaguuugagguggaaaaccucauccuacacaaggacuacagcgcugacacgcuugcucaccacaacgacauuggugagggggaaccccgcgacuacuguggccauaauggcuuggggagagugggacccagggagagacuggagcugagguugaagcugcccgguggggcagggguggggcgagggaccuugaagccucgauauacaugacaaagggaguggcagggaagaguuccaugaagucugaggggccuggugcuccucuggagagacccugaauuuccccaacaaguagccucuugcgaguggaaacagcccuguggguauauggcuugggcugggaaggcccuguuuauaugaauuagaaaaagacacaccuuccuuugugggaugcagccucugucugugcuaggauauagaacuuggagaauggagccuugggauggauuccagccuaacuaccucagcugggaguuuuugcagaaacgaccuguacagcuguaugcaguggcucuggccauccaagccuuuuucaacaccuggaacaaagcccuuggggcauggggcaggggagguuuccaggugauaagcgaccagcagaccucccuggaugacugaccuagggauaggcauagcuacuuccucggcacuuggaggggacagauggggaccgccuaaccaguagugaucuuucuccucugacccucuguccucccccagccuugcugaagauccguuccaaggagggcaggugugcgcagccaucccggacuauacagaccaucugccugcccucgauguauaacgauccccaguuuggcacaagcugugagaucacuggcuuuggaaaagagaauucuaguaagugacaauugcgacugacuuagaagguccugaggaguguuuugaccugaaaaugagcccagcgugaucaagggaagacugcagaguuagaggugggagcacugaggcgguggcagauggguccagggauggaugaagaguguuguuuagggagcgaugggcugcaaagguaaauagaugguaggggcuauagguggaguaaaggcucagauuugcauggaagagaauaagggccuucccugguagagauacuuuaugguuccccucucuggcagacucccaguggacagauaaaucuugaugcaaacgccucccuguuuucuccaccuagccgacuaucucuauccggagcagcugaaaaugacuguugugaagcugauuucccaccgggagugucagcagccccacuacuacggcucugaagucaccaccaaaaugcugugugcugcugacccacaguggaaaacagauuccugccaggugaguguuccaagcaucucucuccaccucuuccauaucuccccagagcuccugggcuuguuccagccagcuuaagggugucucucucuagccaaagcccuaaguagccagaaucaggagcucaggucuuugaggguuuaaaccaguccuuauguguuugccagacauuaccaaaaaaaucccagcucugcgcuagucacuucagacugggggcacgagauccuagaaagaggaaacaguaaaagacaauguaacucagugcccaggguguguugugaacuauaaaugaucagguguucaggagagggaggugagugccaaccugagggucagggaggggaggcuuuaaaggaaaugugacuugauaggcauuugaagaggcagagggaagaaaggaagguguuucaguugaaagauacaaaacugagaaggaggcuggcauauuccggguggggaggagaacuagggucugggaguguggauggaauaguggcagaugacagggcuuuuaaagccaagcaggggauuuuaaacuugaugugguagaaaauggggcugcgucaggcacaguggcucaugccuguaaucccagcacuuugggaggccgagguggauggaucacuugaggccaggaguuugagaccggccuggccaacauggugaaacccugugucuacuaaaaaugcaaaaaaaaauuagccaggugugguggugccugccuguaaucccagcuaaucaggaggcugagacaugggaaucgcuugagcacaggaggcaaguuugcagugagcugagaucacgucauugcacgccagccugggcgacagagcgagauucuguccuccccccgaaaaaaagaaagaaaaugggaagucgcuaaggacuuugacugggaaacucuucccucucucugguaugguugggugaugggaucagaaauccccuccucacuucucuagggcucaucuuuuguaucuuuggcgucacagggagacucagggggaccccucgucuguucccuccaaggccgcaugacuuugacuggaauugugagcuggggccguggaugugcccugaaggacaagccaggcgucuacacgagagucucacacuucuuacccuggauccgcagucacaccaaggaagagaauggccuggcccucugaggguccccagggaggaaacgggcaccacccgcuuucuugcugguugucauuuuugcaguagagucaucuccaucagcuguaagaagagacugggaagauaggcucugcacagauggauuugccugugccacccaccagggcgaacgacaauagcuuuacccucaggcauaggccugggugcuggcugcccagaccccucuggccaggauggaggggugguccugacucaacauguuacugaccagcaacuugucuuuuucuggacugaagccugcaggaguuaaaaagggcagggcaucuccugugcaugggugaagggagagccagcucccccgacggugggcauuugugaggcccaugguugagaaaugaauaauuucccaauuaggaaguguaacagcugaggucucuugagggagcuuagccaaugugggagcagcgguuuggggagcagagacacuaacgacuucagggcagggcucugauauuccaugaauguaucaggaaauauauauguguguguauguuugcacacuugugugugggcugugaguguaagugugaguaagagcuggugucugauuguuaagucuaaauauuuccuuaaacuguguggacugugaugccacacagaguggucuuucuggagagguuauaggucacuccuggggccucuugggucccccacgugacagugccugggaauguauuauucugcagcaugaccugugaccagcacugucucaguuucacuuucacauagaugucccuuucuuggccaguuaucccuuccuuuuagccuaguucauccaauccucacuggguggggugaggaccacuccuguacacugaauauuuauauuucacuauuuuuauuuauauuuuuguaauuuuaaauaaaagugaucaauaaaaugugauuuuucugaug

SEQ ID NO: 21296 - RNA, 25769 nt, Homo sapiens
ugugggaggaagauuguguugucgcgagaacucugccuuugggccguagguuaguguggggccgugucucaguccacccaaggucuccucggaucgccuggagaggcacucggaccugguaagaacgcugugggccggguggaggcucgaugaccgcuggcccgcugggcccgggcuuguccgccccuucccgacccgaccgacaccgggaccggucugccuucuccuucccuucccuccccuccacacgccaggcccgggcaccucuuccugccugcccgccgggcccgggccugucuucuccccuuccggccacacgccgggcccgggccuacguucucgccuucccgccacacgccgggcccgggcuugucuuuuccuccccgacccuccucgugcccggccgugggccuguccuuuccuccccgacccuccucacacccggcucggacaccuccugcuccccgccggccuuccccucucuuuaggugugacagcuccaaguuuccuguuucucucgccucuugcuuggauguggggcgaggcgaggucuguuuugccggacgggcacagaacauaauccauuucuagcuugucagguggaaaugcaaagaagauauuggguuuuuuuggcccucugugugccaaacacauacugucacauuuaauucucccaauaaucccgaaaaguagcuugauuaucucuguuuuacagcugagaagaguaaggcuugcucauucauugguucauuccaccagcaaucauuuauuuggugccuguauguucaggauguugaggauagcaaugaaaaaaauggacaccuaauucucauggaacuaaauucuuguuguggggaaaacaauaaucauaaucuuacguggcacgggauuuaacauggaaugaugccaucaagaauggcagaaguagaaugacagaagucagagugcugaauuuaucugaccccaaaggcagagcuuuuuuacuuuuaacugugccuuuuugugucacuuucuaaucagggucggguucaccacaguaauugccuuuuggauggacuuagcuuuccaccacgcacuugguaauuuggaacuaaguuuauagagacucuugaguuacuuauuggaaugaggauggcacaggaagucauaguuggcccauuuuuauaccgagauccuagugugacauuuccaaacuuuaaaguacuugagaccguuugagaaagacuuacccuaaggaugcaguggcuuaggcaauuuacuugguuuucucauuugaagauuugcuagcuugcagauuuguucagauaaguaaaugagauuauguauguaaaguccagcacaauaacguuccuuucauuuucuccuuuccugccuuccagggagccuuuguccuugggucucuaaggaaaauccuacucuuugaaaguuuugugguaguuuuuaucuaaauaaaucucuacaauuacauuauuaccuuugugcaaacaggcauuucggaaauggaaaaacauguugagcuauggaaggggaggaagauguccuucucaaagggagagaagauauuuuagaacuacauaguaccccucaccccccccuuuuuuuuuuuuuuauuaaaucaguauagcugugccagaaucucaggauccgguguagggguuucauaaaacuccauaggauauccugacacauaucccucccccgguugagagucccuaaguuaguguuuuauaauacuuucccucacauaguguuagcauucagagccagucauugcugcugcugauggacuuugaacucagucucuuauuucaaagaauuaguauuuucugcuugguuggugaaucuaugacacgaguucuccucuagguggcaagcucaccauuguguucucagggacuaucacaguagugucaguuuagguacucaauaaauaguuguuggaugaauacauaauaccuuaauacuuaaugauuccuucaacauaccaggugugguuagggacuuuggacucagaucugggauuaaaucuuggcucuucuacuugggaguuugugacuguagguaauauauuuaaccuugucaagucugcuuuuuuuuuuuuuuuaauuaauggugaugauaauagccacuuuaaugagggcuaauugagauagugaguuuuuuaaaaaaaggcucggcacauaguagacuagauguaaauacuuacugaauucauuuacucaguaauuaauuguugaacaccuacuauacaacagugaacaaaaagacaaaguccccgccauguggaacuuaccuucuaguauguuuucugaagggagaucagaaaauaaaugguugcuacgugccagacugugguuaguacuauggagaguaauaaagcauauuaagggggauuggaggcaagacuuuuaaaaauaaaagauggugaggaauggccucaaugagaagaugaccucugagcagacaccugaaggaagugaaggccugggcucgaggauaccuggaggaaagcgcaagggcccugaggcagaagcauccuuguuaagcuaaaggagcagcaggaggagaagaguaaggguagaggggaagaguagguagcagucaugagguuucugcaagaguccuggagagagaugaugguaaugaaauugaugaacuuuaugucuuucuuuguuauauccuguucuuugacuaaaaguaauaaaaauagguaauacuucuauagcucuuaaugugcaucaggcacuauuuuaagugcuuuacauauauuagucaucagaucuuuccaagaaaguauaccuagccucagaaaaugaagauuugucacucuuuaggauauacaguggaaugugcugcugguucagagagcacuuucucaagcaguacugaaaucagcagugaauucacugccucuguucacauacugguuagguugcaaaggcaagccuaaagugucgauaacagaccacccaaccaguauguaugcauuggguuaaguucaguuucauggaagaacuguagaaggccauggcauuuuuuauuacucuucuugcuacuuuuuaguccuuuuaaaauuuucauccaagguuuucaucuugacuuuguuuucauacaguuaugucuggacacauugcuucaacauagaacgcacaugaacaauguggaggucuaggcuggaaugggggcccaguugaccacuuuugcucuagcugguaggcauuaauacuaucuccaugcaugucaguuagaggagcugccauauuguccuuagcuuaucuucuuugauuguuaaaucauaacauugcaaugcuuaacuucugauaugaaugacuacagucuuaagucuuaaucauucuuuuuuuuuuuuuuuuuuuugagacggagucuugcucugucaggaggcuggagugcagugggcgaucuccgcucauugcaagcuccgccuuccggguucacgccauucuucugccucagccucccgaguagcugggacuacaggcacccgccacaacgcccagcuaauuuuuuguguuuuuuaguagagaugggguuucaccguguuagccaggauggucuugaucuccugaccugaccucgugauccgcccgccucggccuuccaaaguuuugggauuacaggcgugagccaccgcgcccggaccacucuuagucauucuuaucccaaguugucaucccuaauuuugcuuggcuugauuaaucaagauguuccucuuugggguuagcaguguguuugggggcaccuuuggggcuuaauauuccucuuaugcagcauuaccuaagugcucuacaaauauggcaguuugguucagugaaguagugaguagcucacaaaauagguuaaaagguuuuguugucaguuuggucaugggugagaaguuaagucuuuuaauacugagacaauuucagcuuucaaaagaagauaaucucagguguguuuugagcuuuauuuuggcauuauuguuaguccucuaggcuuuaaaggagggaaaauauuaauauuuuaucacuuguuggcuucuauggggagaaccacaaaguguuugccauauaaaaucaggauaaaauggcauuauuacugugauaguagguaaguuaacauauuuuccuauccuugacucuauuauggcaagaaguuucaaguugaauauaguccccccaauauucaacuugaaauucaguuagaauuucugugguacugccaacucugaagaaaaaauccagaguuggcuguaaaauacaguaaauguguccccuuuaacccacaaucuugcugcuauuugugugaauccaugaagcugagcuuugugguucuggcagcaggaaagacacuaucucagcacuuauucugggaucauacuuucaguggcaacacccuugccagcuuugucuuguuugaaaaaagccaaaaguaauaguugugcuagaaacauuuucuuucucugaaaaaaccuuccugcauuaauacaggccuuagugggacaucaaguugauuaucuauguuuaaagcagaacuauaccauacuuacuguggcuagucugaaccuaaacauuaauuuaucauauauucauccguuuguccaaaaugucuuaggccucuguugaauuuagggugaagcauuguacaauugccagggacauuuucucuuuaugucgauucaguggcacacauagaaugugaacgguugguaaugacaagguacugauaccagguugucugcuuaguauuaggauguacaaagcuauuaauucauaaauaagacaugguuucuucucucauggagcccucaggcuaaggaggcaggcauguaacaauaggguaacauauguuacaggcguccugccggaaacccauacagauuacagugguaaugcaggagggagcagccaacucuauuggccaaaaguauugaggagugaggugcucagucaggaaaggcuuuguaguuagugauggugacuugaaaagcagauagguagggagaagaggagagacuggcauugcugacagaacuggcauagccaagcugcacaagauaaaccaaacuauccuaugcauagaaaagcuguccaguagauuagggugugggagcuguucugggagacagcaggagagucagagugaggccaggaaauagacagcugugaugguuaauuuuaggugucaacuugacuggauuaaggacaucuagaaaccugguaaaauguuauuuuggggugugucuguuuccagaggauauuggggugugaauccaaguggauuagguggggaaaauccacccucagugugugugggcaccauccaaucugcuggggcccagagagaacaaaaacauugaaaaggcagaucuauuugcuggagcugggauacauucuuccucuccugucuuuggacaacagaacuccaggcuccccaggcuuugggcuucaggacuuguaucauuggcccccuggguucucaggccuuuggcuucagacugagaguuacaccaucugcuuuccugguucugaggccuuugcacuuggacugagccaugguacuggcaucccagggucuccagcuugcagacagccugucaugggaugucucagccugcuaaucacaugagccaguuccccuaauaaauccccucucauaucuauaucuguauauaucuuuaugucuauaucuaugucugucuauauaauguuccaucucucuggagaacccuaacucaggagccuuauugccuuuaaaagaaauuuggacuuuauccuguaggcaaauggggagccauaggagagcuacgcugcuuuagaugagaugaucuacuugggaugguugguuguuguuuugagacagcauagaaauucuugaagcagaagagagguaaaauaccuuaugcauuuuuccccuuuagaaccuaaacauuuuauaaagacacaagggcaaauacugaagcauaagggaguaaaaagcuacauguaaaguggucugagugcagaauuuuagauuuuugugauuuucuuucuccuuagucuuuuuauguuuauguaauauuuaauaaaucacaucauuauaguaacagcuacagcuggcuugaggagagaaacacaaaugaauauaacugugaaacucagugaacauauacauaggggaguagcugaagacuuuacugugcuggggcguuggucaggaucuuuuagagagagaacagagaccguugguuaaguaggugacggccaacaaaguuucuuuguauuuacauugugaucagccauuuuucagaggcacauaaaauagaugaaaguuccugacaugaguuauauuuuaauagaauuccuucuuuguugccauugauguaaauuaguacaaaggaccauaaaauuguaacuuuagucauucagaaguaugucuguuuuuuuugugucuuuacgaaauguauuauccaaggagggcuuuuggaauuagggagaaauuuucuuauuuuugauaaugaaugccuggauuggggucccagaaauuguaugcaucacagacaaagcaggcacuuccacucuguucaucugaaaucuaagggauacuuaauuuaggguaauggcuccuuaguguuccccuuugguguuucucaugugauuuugcuuuacucuuaauauuaacaaaaacagcuuuauaugcauagacaacagcaaguauuuuacauucaaaaaaucgacugaaagguaauagaauuacaacauugucuagauuucaucuuuuggccugauugcauaugcaggcuaugaggauuaucuuggagaaaagggaaagcuagaaguaccauaagcaugauagucacagguagguagggcuauauugccaggcacuguccuaaacauuuuaauucauguaauucauuauaguucauauauaauucucauugaguugggcccauuaucggguggagcaaguggggagaggagaggcuggagaggagccccaggugccauccgagguccuucuagcuggccuuacccugggggccgggcgggggcagcaggcgucuagcagggaggcccagcggggagggagcugcaggggggccgcgagcgccagcggggacuggcugggagcagggcaacaaugggcggaguuuuccgcuccuccccgcccuuggcuugagcgcuccagcucgcuaguggcccgggcgaacuggaguugccgugugacgcgugggcgggacgaggcccgggcucggggaccuuucgcacucgggucagggguaaagcagccugucgcuugccgggcagcuggugagucggugaccuggccugugagguacgucuggcagcccaggggccguagcgggagcccuugaggccgguagccuugcagggcuggcgccgggcaggagccgggucgcagcggcugacugcacaacugcgugcgaaucggcgaccggggcgagggcaagggcuccugaggccgcuuggaaagggcuuuugggaagucuagaaagccgcaugagucacuguugcuuucguauuagaaaugccuuguuuucgaauuagaaaugccuugcggucgguuuucaguuacuacuuuagaaaauugaugugcugggauuuauugcccucaguugcuuguauaaagguggacaaaucugagccuaguaaacucugaaguguuaaaucuuaaaauguucaauagugaauuuauuauuaucuuauuuuaaaucuguugcgauauuaacguuuguuugugugguuuuaaaaagauuacagagaaccagauucuggauuucagaaacugcuugucuugauaaggaauuuaaaaugggcuggggcuaagguaagauguauauaauccuugaguuaaugaguuguauaaaaaacaaccuuuaggccgggcgcgguggcucacgcuuguaaucccagcacuuugggaggccgaggcgggcggaucacgaggucaggagaucgagaccauccuggcuaacacggugaaaccccgucucuacuaaaaauacaaaaaaauuagccgggcguggcggcgggcgccuguagucagucccagcuaccugggaggcugagacaggagaaugguaugaagccgggagguggagcuugcagugagaucgcgccacugcacuccagccugggcggcagagcuagacuccgucucaaaacaaaaaaaaaacccaaaaccaaccuuuaaaaaaaagacggaagaaagaacgugugaagugaaaaaagucucaagguaaaauugcaaaauauuuuuuaacauaauuuuuuuaaacuaaaagcuuuacagacggucuaaugcagguugucucaucaaagauaaccaaauuguucaguuaguauuucgaguguaguacucauagaacacauagguauccuguggauagaugcugcgcuuggccuuuuagcaaugacuaggaugccaggcaaauaaguaaaaaguagaggucuuuggaggggcaggggcagguggcaaggggggcagagaaugugagaguuggaaggugagguuacagaugaucuagucugagcuuucauucuuacagacgaaugaagccuggaguggcugugauacagacguugaaucaaaacuauuugcauugguauuuggcaguguuuugguuuuucugagccuaucaugacauacaaggguacuguuuauuuauuuauuuauuuauuuugagauggaauuucgcuccuguugcccaggcuggagugcaauggcugcgaccuuggcccacugcaaccuccgccucccagguucaagcgauucuccugccucagccucccgauuagcuggaauuacaggcaugcgccaccacgcccggcuaauuuuguauuuuuauuagagacaggguuucuccauguuggucaggcuggucucgaacuccugaccucaggugauccgcccaccuuggccucccaaagugcugggauuacaggcgugagucaccgcgcccggccaguacuauuuuuguuaguguuauccaaggcagaagauucugaacaauugugguuauaauuuacugaggacuaugaaaauugacugaaaaucuuaacggaaguuauuucaauaguaauccauuggaauguuaauuuuaaucacuaguguuggcaaguaaaaauacuuuacaggugauaauacacuaaaggaagaacaagcucaucugggagagagaacccaggacuagaccuuggaaacuguaguucuaaacccaaaucuuaccccuucuggcuguggcccuucagaugggucacuuaaacuaucugggcuuuuguggcuucauauguagaaugagaguguuauauuaaagagaugaccaagauuuuuuccagcuuuauuuuuuauuuuuuuaaagaggcuugugaggagcuauuuuucagcuuuaaauuguaguuugugugggucacaagaguuaaagcucuuuggaaauuuuaugguuaagccauacaguaaugacuuagcuucauuacauaaccacuucauuugugguuaguugcucaauucuggugccaugaucuucagacuucacaaauagauuugugcaaagcauuguguaagcauggcauauauaguuuaaagaauuccuuguugcggaaacuccagguuuuguuauucguuugaaggguauguguguuuccuccuccuuuacuuccuccacccccaaauuuaggacagggauacuagaggcagggaaguuuuagaaagcacuuaaacuuuuaauguugucucaaaacauaaacauuuaaggcaguccucuuuugaagauggcaaggcaauauuuuggauuauaauggugaagauaaaaagacauuuuuaguaaucuuuuauugauuugaauauuaggaucagagcugauuugguccaaucuuucuacacguaagaaaacagucaaaaauauccauacuugguauauauuagaggauuuagacuauugaguuuuuggaguaaauaaaagauugccuuuugcugugcuguauagugaaagacuagauggaaaucuaauauuuauuaaauaagcacgaccuccuuaccccuaagucugugagucuauauuccucacauaugaauuaggaaguuagguuccacaagggcaaauggugcaaggucauagcccugauaaauggcuaaaggauucugucagguccuguucacagccugucagcuaaaccugauaacaauaaccacugcaauguggagggcuuacggugugcaggugcuaggcuaagugccgguagacauauaauaucucacuuuaaccuuacugcagccccucuguagcaaccauccuugucucccuuuuuccugaggaaguugaggcccagagagauuauguuacuagcucaggggucucaagcuuggagacacagccauaacucagguuugucagacuccagagugaccucuuaacggucaugcuugcuacucuggcucuugaaccugaaacaaauggugaauaacuguugaaaauggccaugugaacuaguuaccucauacaagucucuuuggauguaacauuucguacagcuggcuuaggcucauugugauuugaauucacccaugguuggggcucuucauuuccgcucugaaggcuuccucuucaucacagugcaagagggcaagccuuugcauagcuccuuucuuggcaucugggcucugaaagcugacagugcucuaacugcgccacagggaggaggagggacagagagagccaaaggcagcaaaggggcaagcauccugggacuuaccauaaagaaaugaaacagauuuucuucguggcugacagaugaguucucaagaugacuuuugaaggauaacacuccuuuuaauuugaaaaaaaugugauaacuguguguggaaaaaucaguuuuguaacuuuuaaaucucauccuacauucugucuauagcugauaagggcaaaguccaaugugugaacucuugcuguagucuacucuuauuguguaauauuaauacuugugauugaauugagaggacuugcuuuaggaaucuaguaauacagucagcacuguauguauuugaguuugucucccguauguuccggaauucuggaguuuugacauugugaagcaacaauuuaauuuuauugauucaauuuuacacugugccaggcauuguggcauuccacacaaauggugagaagcuaaaagugagaaauuuggcacaggugaagaaggcuggguaacacauuugaaagacugcuaaacaggucuugcaugacuggccuaagugcaaagugaagcagcccaucacgcuccagcucuccaaaucggagccggcauuucacccaugugauacagguauuuuucauagucccugcagugaguuccaagugcacacuaaugcuucugccuaacacaggcagcuuauggcaugcaaaaggaggcugcaaaguaaccacuguugguguguccaggguuagaaaaauuuccacagggauuucugugaaauccaauuaaggcagcccuuucuuuuuaauagaugauuauggagaaaagagacugacgaaacaaaaucagcaaggggaaguuaaaaaauuuccugaauuguucaguuucuuguggaaacucuaguuccugaaucugagucuuuugcugagauaguguacagaaaguuuguuuugcugcucuucccacuucccucagaauacauuauuucugagggaagaacucaccacuuuugucucuagccagcuuucaguuaggcaccuggcccuaaacuuagucuuaaagaugcagucaaggccuggcaaaguuccuuugucugaaaugggcagucaagccacuuggaggacucuacacuggguaggccacuuuucaccccaaagcuggcuucuccaagaaagucauugcuuucaggacuguuaggaaguuauuugauauauugccuaacaugccuccuauuaauguuuuuuacccccuugugucuguuccaaacaaauuuaguucuucuaguugacaggucuccacauacuugagaaugguaaucauguccuccuggagacgucucuuaucuaggcuaaacagccuuccuuccuggagaaguguuucaugguuuugaggccucucucccuuuucuaaguguccucuucuaaaguguguuacucagaaauaaguuuugaauuuagucuaauaaacauggaacaggcuaauccugugacaaacacuauacuuuugguaaauguagucaaauaguguguaaguuauuuuuucccacagacccagcacacugcgaauucauagagaauuuacuuucgguuaaaaauuuccacccuuuaaaaaggaauuauucucuuccuugcccucccuaauuaaagugaaaaaacuuacauuuuguuuuguaaaauugaacagcuauguagagauuguuuugggaucuguuucugucacagccccauguuaccuccagcuuuaauguuugucuuguguguuuucauacagguaauuaggaaaaacagggaugugccucucaaaacuuuacaaacuggccuuagucugucauccuuugaguauuuuguaaaaaauaaucuuauuauucaguuuaauugugcuucucuuuagcuaauauucacuuuuuccacagugauaacauauagucuugccacaagucuucugucaucccuuugugucuacagcauuaccuugacuugccaguuuaguaaaacaauccaaaaggaaauaacugguaucacaaggcuuagugaaccuauucugagcucuaguaaucacugcugucauuuucucaguguuuaaaaaucaugucauuguucuugcaguagcuuuugucaaguuuuacguuauggcuuuacugacacucauguguuacagucucauuuuaucauuauaugcuguucuucccauuuguguuuccuuucgcuccuaaacccaagcuucuuagagaacucuguauuuacccacaccaauuucugugucuccuuuauaugagaaucaugaaaucauuuugucacauauaaucuguuacauauaaugcacauucuuuuauauauuauauauuacauauauucucucuauauaaaacauguaucucuauaucuguuauauucuuuuuuguuguuguuuugagacagaguuucacccucuuacccaggguggagugcaggugcaaucacggcucacugcagcugcgaacuccugggcucaggugaucuucccaucucagccugccaaguagcugggacuacagaugcacaccaccacauguggcuaauuuuuauauuuuguagagacggggucuggcuauuuugcccaggcuggucccgaacuccuggaaucaagugauccacccaccuuggccucccaaaguacuagaauuacaggugugagccaccgugcccggcccuauguuauauuuuugagaacuuccuagcugugaagucauucuuaaguucuuccuaaauaaaaaaaaaaguucuaccuaaaagggggaaauuaaaaauuccgucuucuaaacaaaguguucuaaacuugauuguuugcagcuuauuuugaaaguaaucaaagauccuucuguaccuuuuagucuucaucucuaaaucuacaaagaggaacacaugccucauaugacuauauguguguuauaaauagaaaaugauauucuaauguucuuuuaacuuuucaggacacuguaugcucuuugauucaggacaauuaguguauuuuuccagaaauagcuauucacauguaaagugucacuaaaguagauuauagaguuuuauggcaggaacagugguagagggaagggaggagacaauauuuauuaagaguaucuuaugugcuagguuugguguuggaaaguaaucuaaguaguuaguaaugggaguuggcuggaaugaucauuugagggaugauucaaaggugguuuuugguuguaauuauggugcuauuuauauauauuuuuuucuuuuaaaggagcagugaggagaaugaauaccuuccaagaccagaguggcagcuccaguaauagagaaccccuuuugagguguagugaugcacggagggacuuggagcuugcuauugguggaguucuccgggcugaacagcaaauuaaagauaacuugcgagaggugugacaugugcuuuucucuucuguugucuggacucuugacacagggcugauuugagcauggccaaggacuuggucucuccgugccagcaaaaaauuucaccccaugccuugcguggucuacuugguccccgucaguugccugauauacuggugccuuucaucccaaggggaaauaaggcagaugcuagaagagucuggaaaacccugugccauucuagaaaauucuauucagcuuacuuagauuacuaacuacuuagauuuuugauuacuccucugugugauuccucaggcacugugaccaguaaaaauaugaaaugagugagcaguauccucucagcugcauccucuugauugcaugaaggaugcacuugagcauccuccccaucaucuuuuagcugguuaauggcauuguucuguaaaugacuaucuguuagggcaagccagagugaaaucuguuguugguuccaguaguauuuuguuguuguguguguuagaccaaguauuacaugacuuugaaacacaacuuuauuaaacagaaaaaaauguguuuuaaaauacaguuucuuauguauauugucacggauaauuuauggccuguuuugacuuuuucccuugggauuuuuauauuuagcccuguuugaaucacuguuuaugcuuccagaaauauuaguuuauaauuuuacuuaaauugucuacccuaauggucuuuuagcuguugacaugugguggcacaucucuuuacuaaauuggccuccuguaaauggaccgcucauucuguggggugagaaaagagauaaggggcuagcuauuaaguuaauacucugucuuuauucugcugauaaacuuguaaaaccguagguuuuuaaauuauguggaaaacugagggggucaguauuuccugguacauucuuguauuuucucuugauuaggacacccaaauuaaaccuaauccucuuagaaggcuggguauugaagaaggauuuuagaguuuagguaugccuuuauggcuaggauucuuaaauugggguccauagggcuuuaguggguccuugggugggcuuuggaacacuaaacccugaaauuauagguaaaaucuugaaaauauacauuuuuucuggggagauacuucauagaugucauuggauaauuaaaaggauuugugguccccccaaccccacccccccaaaaaaaguuuuagaaacucacuauucuuugggaaacaucauucuuugggauuaacacuaggaagcuaacauguauguguuuccuaggucaaagcucagauucacaguugcauaagccgucaccuggaaugucuuagaagccgugagguauggcuguaugaacagguggaccuuauuuaucagcuuaaagaggagacacuucaacagcaggcucagcagcucuacucgguaaggugacugcauggcuagaauugguuugagcauggcuucugguugccagagaguaucuuccuuguaaugcaguguuaauauagaucagauagaaguuuaaucucaagugcuguuugguaacuugaguauaucuggugcuuuuggugucauuguggcuaguugguuucauuuuucuuuuaguuauugggccaguucaauugucuuacucaucaacuggaguguacccaaaacaaagaucuagccaaucaagucucugugugccuggagagguaaugacccuuuuugcguauuuuaacuuuugacucuugaacuuugguauacuaaaagaaagucgauuuuguaacucauugcuuguguuauauuuaacuucuguguugcuaggauaagaucauucugcuucauguauuuaauauuauacuugcugauacaugaauaagccaucuaucuuugguugaguuucuuagagaaguguaaucauuuaaaauuacucacaauuuggcuuuuguuuuagaugaaguugaugaaacagauauuccuuaaaaauagccaauuuuguuuuuuuuuccccagacugggcaguuugacccuuaagccugaagauucaacuguccugcucuuugaagcugacacaauuacucugcgccagaccaucaccacauuugggucucucaaaaccauugugaguaaucucauaugcuucacugggcacuucucauaucuguggccucacagcuggucuuaaaaaaaauugcuaugaauagugacuuucuugagaauuugauuagcuucaaaaauuucauguucucagcugggcgugguggcucacgccuguaauccuagcacuuugggaggccgaggagggcggaucacuugaggucagaaguucaagaccagccuggccaacauggugaaaacccaucucuauuaaaaauacaaaaaaauuagcugggcgccuauaaucccagcuacuuggaaggcugaggcaggaggaucgcuucaagcugggaggcggagguugcagugaccugagaucgugccacugcauuccaaccugggcgacaaacagugagacuccgccuaaaaaaaaaaaaauucauauucugauuaaguugccuagguugguaguucuuggaauguaguacagacucagugauacucuuuggaaugccucauguaucucucuaaauacuuuugaaauauuuuuuguaaaauuuauggcuugaauaguuuuuaauaaagaacgaaacguuugggucuuguuaaaagugguaauacaaccaauucugguaaagauuuuuuauauaauaguuaugugguagaguauucucaaauuugauaacuacuuuguaagucauggaauuuagugugaacaguauuucuaaugaaaugguaaugcuuuaacauuuuugaaauuuggaauuauaauuucacuuuuuuggcagcauagcauaaauaacaugauuaaauuaucucuauuuuguagcaaauuccugagcacuugauggcucaugcuaguucagcaaauauugggcccuuccuggagaagagaggcuguaucuccaugccagagcagguaaaauaucauuuuguuuuugguaauugagucauuacuuggcuuauacuuccuuuggguuuuauauagcauuaaaaaaaugcuacuauuuguaaaaaggcaccaguggcaaugaguuaguuuaugaaauugaaugcuucccuugagaccuaaugccaaauagaaauuuagaugucuugucggggcugauuaacagaaaaaguaauuaucaaucaguucacaggaaauuaucauuagcugucuuacugauacugguucucugugagcgauccucuuuauaauuuguagagaugauuuauuucuaaaggaauggcaaugugaauaaagguuucuauauguuuuaguugagaagagcccuagagaucagcugugugucucuuguuuuauaauugugaaaauugaggcucuuggaaggcacaugauuugcccagggucaguggcaagccaagauuagagaguggcucuucucuuuuucuggugaacuuucuacugcauuugacauuccuuguuuugugauuaacagaagucagcauccgguauuguagcugucccuuucagcgaauggcuccuuggaagcaaaccugccagugguuaucaagcuccuuacauacccagcaccgacccccaggacuggcuuacccaaaagcagaccuuggagaacagucaggucuguugcugcuuuuauuguuucuacaguagacacagcaguagguggaguuaguuacuaaucaguaguacuaugugucauuguuaacuuuuugguugcagucuggaaacauauuuauuaauagucucuucaucauagaaaguuuagaaaauaaggaacucuuuaucauagaaaauuuuaaaaauaaagaauuuuauauuaaaaaagcccacaaacccauaaucucaacacaaagagaaaaacacuguaacaauaaaagugaaguauuuauauacuucaguuuucuauacauacauauuuuaaaagaaccauucuguaaguccuguuucgguagguagauuuuuuuuuucaccaggauaacauuaacauauuucucugucauuuaauuucuucuguaaaguauuuaguaguauauaauugauuggcuguaauuuaaauucaaguuuuucuggauauaaaaaaggauucccuaaacauccaggagccaauuauuugugugcauucuugauuaguuccuuaggaguacauuuauagaaauugcauuccuagauuauaauucugcuuacgcuuuaagacuuuggauacauauugccaauuuggcuucccaggaaguugccaacaguuuauagucucaccagcagaauauucaggguaccugcuucccugaaaccuaagaguaauagucauuuagguuuuuugcucugaauuugacacaaaauagcaauuuugcuuuuguuuuuucuuccauuaguaaggagguugaguauuuucuuuuuucguuuuuuuuuuuuuuuuuuuuuuuuuuuuuuuuucuuucuuuuugagaccgagucuugcucugucucccaggcuggaguguaguagugggaucucggcucacugcaagcuccguccugcggguucaugccauucuccugccucagccuccugaguagcugggauuacaggcgcuugccaccacacccugcuaauuuuuugcauauuuuuuauuuuuuaguagauacgggguuucacccguguuagccaggauggucucuaucugaccuugugaucugccugccucggccucccaaagugcugggauuacaggcgugaaccaccguacccggccaaguauuuucauguuuauuaggcuucuuugaugacuugccugaucauauccuuugcuuauuuuuugugcuuuauuuguaaaggcauauuacacccuuuucuaucagauaagaguaucuaaauagagaaaucccuugccuuuuggcuuuguguacuuaaauuucaaaacacugggcaagacaguaaauaugcagacagggccgggcgugguggcucacgccuguaaucccaguacuuugggaggcugaggugggcggaucacgaggucaggagaucgagaccauccuggcuaacacggugaaaccccgucucuacuaaaaauacaaaaaaaaaaaaaauuagcugggcgugguggugggcgccuauagucccagcuacucggaaggcugaggcaggagaauggcgugaagcugggaggcagagcuugcagugagcugagauugugccaccgcacuccagccugggcgacagagugagacugucucaaaaaaagaaaaagugcagacagaaucuccaaagcagucauaauuguucuggcaaacuaauacuguguacuuuuuguguagacuucuuccagagccugcaauuucuucaauaaugucgggggaaaccuaaagggcuuagaaaacuggcuccucaagagugaaaaaucaaguuaucaaaaguguaacagccauuccacuacuaguucuuucuccauugaaauggaaaagguuggagaucaagagcuuccugaucaagaugagauggaccuaucagauuggcuagugacuccccaggaaucccauaagcugcggaagccugagaauggcagucgugaaaccagugagaaguuuaagcucuuauuccaguccuauaaugugaaugauuggcuugucaagacugacuccuguaccaacugucagggaaaccagcccaaagguguggagauugaaaaccugggcaaucugaagugccugaaugaccacuuggaggccaagaaaccauuguccacccccagcaugguuacagaggauuggcuuguccagaaccaucaggacccauguaagguagaggaggugugcagagccaaugagcccugcacaagcuuugcagagugugugugugaugagaauugugagaaggaggcucuguauaaguggcuucugaagaaagaaggaaaggauaaaaaugggaugccuguggaacccaaaccugagccugagaagcauaaagauucccugaauauguggcucuguccuagaaaagaaguaauagaacaaacuaaagcaccaaaggcaaugacuccuucuagaauugcugauuccuuccaagucauaaagaacagccccuugucggaguggcuuaucaggcccccauacaaagaaggaagucccaaggaagugccugguacugaagacagagcuggcaaacagaaguuuaaaagccccaugaauacuuccugguguuccuuuaacacagcugacuggguccugccaggaaagaagaugggcaaccucagccaguuaucuucuggagaagacaaguggcugcuucgaaagaaggcccaggugagcauaaacaucaaaauagcacugguuugaguuuuauuuauuuauucauuuauuuugagauggggucucugucacucaggcuggagugcaguggugcgaucucagcucauugcaaccuccccuuccgaggcuccagccaucccccugcccgcacuacagccuccugaguagcugggaccauaggugugcaccaccaugccuggcuaauuuuuuguauuuuugguagagaugggguuuuggccugggcuggucucugaacuccugagcuuaagcgaucugcccgucuuggucuccuaaacugcugggauuacaggcgugauccaccacacccagccuagaguuucauauuucauaaucccaaaccuugcaaaccggccagccagauccuuaaauauguuaaauacuaaauuuggaauggaggauuuaugauuuuuuugugcauuuuccaggccuaagccccauccuucaggaaagaaaagaaucuagccuguuuuauugcuauuuauggaaaauauuugggguagaaauaacaauugucaccuuuguuuuugguuguuacagagaauggccaacauuuaaauuauucucuguagacccuauuuggaagauaaguuggucucaugccuccuuguuuucaugaagcaaccuacucuuuucuuuuauugcaggaaguauuacuuaauucaccucuacaggaggaacauaacuuccccccagaccauuauggccucccugcaguuugugaucucuuugccuguaugcagcuuaaaguugauaaagagaagugguuauaucgaacuccucuacagguggguacaugccaccagcaugaaaauuagauuauagcuauuuauaaaauaaauguuuugucuuacauaugaagucauacuuggcucacugaaccauaucccuuuuaauaguauguauauuaggcaagugagggugggacgggggagcucauaaaaaguugauguauuuuaauugaauuugcuuuauuaacuaacuaggcauacuucaaaaugaacuuucaagauguaaccguugggaauuuucagaucccauguggauucuaguaguuuauauaccuaccucgaagguggguuugguuccaggccacugcaauaaagcaaauaucccaauaaagagagcuacacaaauacuuugguuucccauugcauauaaaaguuguauauaauacacuauaguuaagucugcaauaacauuaugucuuaagaagaaaccaauguacauaccucaauuaaaaaguauuuuauuacuacaaaaugcugauggucaucugagccauuaacacauaaucguuuugcuguuggagguucuugccuugauguugauuacugcugacugauuaggaugguagcugcuugaagguugggauggcucugucaguuucuuuaaauaagauaaugaaguuugcugcaucgauugacuuuuccuuucacgaaauauuucuaacaugugaugcugugugauagcauuuuauccacaguagaacuuucaaaauuggagucaaaccauguugcugcuuuauccacuaaguuuauuuaauauucuaaauccuuuguugucacuucaacaauacacagcaucuucuccaggaguagauucuaucucaagaaaucacuuucuuugcucauccguaagaagcaacugcucauccguuuaaguuugaucaugagauugcagcaauucagucacauauucaggcuccacuucuaauucuacuucucuugcuguuuccaccacaucugcaguuacuuccuccacugaaguccugaguuccuccaagccauccaugagggugggaauccguuucuuccaaacuccuguuaauguugauauuuugacuuccucucaugaaucaugaaugaucuuaguggcacccagaauggugaauccuuuccagguuuucaguuuacuuugcccagaucuaucagaggaaccuagguagcuagggccuuaaaaaauguauuucuuaaauaauacuugaaaguugaaauuacucuuugauccauaggcugcagaauggauguuuuauuagcaaacaugaaaacauuaaucuccuucugcaucuccaucagagcuuuugggugaccaagugcacugucaauggguguaguauuuugaaaggaauguuuuuuucugagcaguaguucucaacagagggcuuaaaauauucaguaaaccaugcugugaacaggugcgcugucauccaagcuuuguuguuccauuucuagagcacaggcagaguagauuuagcauaauucucaagggcucuaggauugaagcacuggcuucaacuuagccaccaguggccaggugcaguggcucaggccugcaauuccagcacuuugggaggcagagguaggaagauugcuugagccaaggaguuuaacaccagccugggcaacauacagagacccugucuguacaaaaauuaacaaauuagcuggguaugguggagcgugcuauagucccagcuacucaggaggcugaggugggagaaucuugugucugggaggucaaggcugcagugugcuauaauagcucugcugcggucuugccugguugacagagggagacccugucucaaaaaaaaaaaaaaaaaaaaaaaaaaaaagagucacuggcuguguuagucccuaacaagagaguccaucuguccuuugaagccaggcauucacuuaucucucuagcuaucaguucuagaugacuacuucuuccaauaggaaguuguuuugucugcacugaaaauguugaguguagccaacuucauuuacgaucuuggcuagauauucuggauaacuugcuacuucaccuugcauuuuugcuauggagauggcuucuuuccuuaaaccucaugaaccaaccacugcuagcuucaaacaugacuucugguuccugaccucucucagccuucauaaaauugaagagaauuagggccuuacucugggguuacgcuuuggccuaagggaauguuguggcuaguuugaucuccuauagagaccacuaaaacuuucuccauaucagaaauaaggcuguuugcuuuuuaaauuauucaucuguucacuggaguagcaccucuaguuuuuuucaagaacuuuucagccagagaaugagaagcugaaaaacaacaaaaaacuuugcuuuugugcucacagcuuggcugguccaaaaggccugcccagcuuucagccucucguggccuucaacaugacuuucucgcuaaguuuaaucauuucuggcuuuugauuuaaagaagagugagagauggggacuauuccuuuuaguugaacacuuagaugcaauuguaggguuaauaauuggccuaauuucaaucuuguuuugucucagggaacagggaggccugaggagagagaagagaaauagggaaaggcuguuuggugggcauucaggacauuuauugaugaaaaguuuaccaucuuuaaugggcauaguucaugacacaaaugcuuaauuuguaaaaaauacaauguaacaaggguauaccuguauugggaaaugagucggagcuuuaaggcagggaaaauuugcuuuuauucuucauugaaguaacuuaucaucugugggugucucuuuacagaugugaaggaauggacaagaguugagcagccuuucugcugauuaucacacaucaugagcugagugacugcagcuugccaaaucuuuguguuucugggucugaccaauuagcuuaguucuucuccugccuaauuuugaacuaguaaagcaaagugagucaucagauuaugaguuacuguuuaaaagaaaaaugcuguuuauucaugcugaggugauucaguucccuccuucuuacagaaguauuuuaauucaccccacacuagaaaugcagcaucuuuguggacgucuuuuucacaagccuccaaggcuccuuagauugggucguuacuaaaaguacauuaaaacacucuuguuuaucgaaguauauugauguauucuaaagcuaguaaacuucccuaacguuuaauugcccuacagaugcuucucuugcuguggguuuucuuuuguuaguggucugaaauaauuauuuuccuguucuauuaauacauaguguauuuugcacaaaaaaauuaaccuggucaauagugauuaccaaaauauauauuaauaaucuuggcaauuuuugacauuaauuaugaaacauuuuagcccacguuaguucuacauuauucuucacuuaaacucagcuacugcaaauuuugucuuucuguaaauguuauuaaaauauccagugagcucuuuagaaggacucaguauuauuucaagacuauuuuugagguaauucuagccuuuuaaaauauucuacagaccuacggggcuuaaaagaaccccaguaccgacuaagcaaauaggcaaaagacauguuggaaauguaguauaguacuugaaacagucacuaucauagggauaauuggugcauccuguguaaauggaagcugagcuugacaccuggugcuuuuaaguagggauaaagucauccucucacugcaagcacagcauaccuguaccuccaaaagugacguuuuagugaacaggccguuuucaacacuugugccuugggguguucauugaagcuuugugaaaacuacugauguuuucucagucuccuuaaaguuacguccaugcuuuaaaaugucuguguaggagagaagugggguuuauaauguuuucucuaagauaucuuugcugcuuuccagacuuugaaacuauuaagcuucuuaacugccucuuaccggaaauacuucuggggaaacuucauggucccaaaaugucauugccauacagcuucacuagaguucuuugaaccacagcugaaaagagcuuuguauuauuuuuuaauucccuccccagauaucauuuaggaguauuauauaaagguggugggcaaaaacaauguaaggagccuuuccaguuaucuugaguugcagcucuguaguuucuugaggccaaacacacuguauuuuacaagucaaaauauaauuuacauuaaucacuauguuaaugaguauguaaaacauucuuuugcauugaugaauuuuguaucugcuuccauuaaaagcauaacagccauaguuguugcguguuauuuuuaaaacuauuugucacaaaguguggugugguaccacauaacgugguaacuuuugguuaguaauccagcugagaaacagcuugaacauaaaaauaacaucaguguauuuuaugaaaaauuagcaaacaauagguauauuaaccuccauuuucagucuuuuauaaaaacuauucacaucuauuaaaaaaaaaccuau

SEQ ID NO: 21297 - RNA, 14159 nt, Homo sapiens
ucuuugaggccgacgcuaggggcccggaagggaaacugcgaggcgaaggugaccggggaccgagguacugcuccggcuggccggcgggcgcccgggauccccggugguccugacagccgcccucacgggaccgcugggugcggggggaagggcuggaagcagcggugcugcuggcugcgucagggccggccugcgcguuggggucgcaguccugugggugaccugguggagagggcggcggcacaaggcccuggucaggcgggcaagggcucaguguagcugugcuucuguccucgggcaacaaggugcugagucauccuugcggcgaggccguacagccgcugcgcugguagcggcaccuggggcaggggcagagguguuguggguugacagggaaguuugcugccggguucucaucugaaucuagcgggcugggugaacuuucucggggaccaggcacccaaacucaucaaugcucacggaggcauaagcccuuggauuagggucgguaguauuuuccccauuuuauagcaacgacaucugagucuuagagauccacacuccucacaaggucacuucuaaccugucagaagcgggauucccacucugggcuguuacgccacauggaggucacucugagcuggaccucuucggccccaaccaguggacugaguacugaggaagauacaggacagccauagguugagaugauguaauggcacgaaaguuccaaaagcgcuggguguuuucccaaaggccgggugccgaauuuuaagacccuuaauaguucaguugcagagcucggaggacgcucggguaucuuaaagcaauaguucuuagcuuuuggaguguucguuaaaacacacguucuuggucuuauuccuagggguagaaucauuaggagcaaagaaagacccaggagccuacauuuuaagaugcauccggggcacuuucaagcagguagucuaagggucaacgcuguagucugaacacggaauccuuauguuacagauggggaaaugggcccagaaguauaucacuugccuagaauucacuacaaaucauuggcagagaugggcugguagccccaguugguuuacacucgucauuucauucugaccuauuguagucaccucaccuuagcauuacagaaacacugucugcugacuucugguugaccacccaucuaguauaaugugcccuggagcuaagauaauccaguuuuuagcaugcuuuucuuuugaagacaccaucgagggagucuaauguaagggaaaccugguugguaacugaguuuacuuguuuacuuugaaagacuaaauguccuuuacgcauuauaguaggacauauagaauagguuaacuuagaauauuuuuauaucucauguugaaggaaaguaauauuugguaugauuagcugaaauucauauaguuggcuucuuuuaauaccuuuuagcuuuguaaugcaguauaaccuugaagagcuauucaugucuucuuuggaugacacuauuccuuugcccaaaaguuauguagauucuuuuaaauuuucccacuggaugcugguauaaaucuuaagccaaaacuacauuuguaaaaaccaucacagacucuguaaucacguccaguuauuaacagccguucuguguuacacauaauuuuugcagucaucuauuuugauuggucaaacugggacuuaaaccuaguuuguuccuccaucuucagcuguguucucugggauggguuucuugcauuacaguggaugguugggcaaagaauucaucgcugaaaauuaaaaaggucgcuuuauuuccuguucuacuaaaaaauaguuuguuccuugacucugacucucauauguccuucucuuaauugguuaguagguuguuuuacuuauguuuuuuugguugguuuugccuuuuuuuuaaacuagcauuucagaucugcucgguagaccuggugcaccaccaccauguuggcugcaaggcuggugugucuccggacacuaccuucuaggguuuuccacccagcuuucaccaaggccuccccuguugugaagaauuccaucacgaagaaucaauggcuguuaacaccuagcaggguaaagauaaucugaauguuuuuauauugcuucuuuuuccauuugugcccuuucuuuuuggcagaguauggcugcucugccuuuaguguguuauacgucaguuagcccugauaauauccccaaucagcucuuucuccccauuaguuuguaucauucuggucccuccuuaucccauaugaaauagaaaaugaguuucuguaacucugucuucgcuuacagcuucuggaguuucucauuuagaaaauuuagaguacauugugagggauugagaguuacauaguguaacggagauccuggagcacauagucagaaguuuaagaacccagggauauuaccaguuggccaauagcuuauuaauaaauuacuaaauauauuaucucuuauuuagagguugauaauaucugucagguuagaaagaaacccauuuuuauaauagauuuaucuucuggcauucagauuauaagguuugaagugugagguaaugaggacaauauaaagaagcuaggagacauuuucucuuuuaaauuaacuguuccacuguugaaaaagagccacaauggaaguaguagucuucccucuucuuggcuucauguuaaggaaagaugcuguucuugaguccauaucccagaugacaaaauauagcuaauaaugcuuguagaaugcauaucuuaaaaaugcuaacagauucucacccugguauuugguuaggauuuaaaauauaacaauucuagguauguaaaucuauaguuugugaaagaaacaauuuuucugaaauugaaacuaagaauaauauaaugaauuacuaacuuccaaagguggagcacagggaaggucuacauuuauuuauuuauuuuuacauuuaguuuuuuaaguuggcuaauaaauuuccauagugaaguuagguauauagaaaguaccaaguuucuuuaacuagaguuuucuaguguaaagggaucuugcauuuuauuuuauuaacguucuguuuucaugugggugguacgugucuuuguuugcaugugugucaggaauaugccaccaaaacaagaauugggauccggcgugggagaacuggccaagaacucaaagaggcagcauuggaaccaucgauggaaaaaauauuuaaaaguagguggcuaucuuuaguuuuuaaccuagaaucuauggauauguuuuaagagguccaugaacaacuuccuaaaaauauauguguauuugugcauuuucugggaagaccacauuauuauucugagaucugacgacccagaaaagauugguacuuugcacuggauucagugguuaucaaucauauuucuuccaguggaaauuuuacuuuccuuuuuuuuaaagaaaaggauuauuaauaugccaugguccaaaagguauacucuguugagaaaguucauuuuaaguguguagaauccucauucaagcauauaauauuuguguauguuucagauuaagaauaaaucaccaacacauagauguuaauaaaagccuagcuguccaagaagaauccuuuaacucacugcucacauagggccucaggagggcaguacuuuaauauauugccaguuugguucaguuuggauaucaacuuugcaaguucagaaacuagauuguuaaucauccuaaagcuauucaaagaauaccacugcuccuuaauaaucuugcaaaaugucuuuacagugggagagagcccuaaucaguauccuucaggucauuucuuucugauuugacccuagagaccaaaucaugcaaauuauguagugacagccuaguaauauucuuaguaaacgaauuagacuaaaagaauaagaugcccuuuaugaauaccucuauugaguuagaguugauuaguugccucucaguacccuaaaacgggagccuccucucacuugauucugcugcauaaacacugauuauauuuucucuuuuuucuugauuuccacguaaagcaucauuuguguuaauaccaugcaguaugguaugacuguuaacauuuccuucucauuuuuuacuuuccaugaaugucaugugaauauacuucaaccucuuauuaguaaaauaauagguaucacagaaguagcuccacgucuacagguauacugcucccucaaauauuguuggagggagguugaagauucaccaagccugauccuuucuuuuuuguacugauuuuuacaccuuuguuucaggaguguuuuuuucuacugguuaccuaacauugaggcaauuucuguaccccauaugcacugauuauggcuucuauuaaauaugguacaugauuugauucccuugauaaauauuuuaaaggcuuuguccagaugugccaguacuaaccugcauuuccuucuguguucugcaguugaucagaugggaagaugguuuguugcuggaggggcugcuguuggucuuggagcauugugcuacuauggcuugggacugucuaaugagauuggagcuauugaaaaggcuguguaaguaaauuguuuuaaguaaacuguuccuaaacaacuccagccuuaaaacaaaaauucaaauuuucuucucauuccuaucuuuagucacuuuggaauguuuugugucuagucuuuguguauacacacaaauagagaaucucuuuuugcuucuuugacauuuauuuauucaaaucuaaauaaaaaucuuuuagcaagguuauauguguuuaagcaaagagaaaauaugaaauauguuuuuuguuuguuuguuuguuuguuuuuuuggagagagagucuugcucuaucucccaggcuggggugcaguggcgcgaucuuggcucacugcaaccuccgccuccuggguucaggcaauucuccugccucaggcuccuguaggugggauuacaggcacaugccaccaugcccggcuauuuuuuguauuuuuaguagagacgggguuucaccauuuuggccaggcuggucucgaucuccugaccucaggugauccacccaccucagccucccaaagugcugggauuacaggcaugagccaccgcacccagccaaaaauauguuguuuuuuauaugugcuuguauguuuuaucucauuuaguccuuacaguaacucccaaguaugcauaauuaucauaauuauuuccaugauaaaugaagugaauaagauuuaaaguguaaaaugauuuaucccgaggucgcccagcuagugugugacucaaccagaaaucaaaucuguaauuucauagauuaaucaugucauguuucuuacagaauuuggccucaguaugucaaggauagaauucauuccaccuauauguacuuagcagggaguauugguuuaacagcuuugucugccauagcaaucagcagaacgccuguucucaugaacuucaugaugagaggcucuugggugguaagucagcuguuuuuguuuuccuuuuucaucuaaagaucaaaagauuagauaaaauauauuggagggaaggguuauuaaauggaaagaauacuguauugaacaaguuuuuguucaaauaauguaugaauuacagguugagcaucccuaauuuaaaauccagaaaugcuccaaaauccaaaacauuuguagugucaacaugaugcucaaagaaaauuguagcauuucacauguuggguuuuugaauuagggauccugaacccuaacaacaaugaaguguaaugauaaauaguccgaaaucugaagucugaaacacuucuggucccagacauuucugaugagaguuacucaaccuguauuagugcagcugagauaaaaguaggaaguucauucuagguaggucagcuauuauucuuuauuaaacauguauucgaauaauaccagaggaguuagaaaucaaacuuacagagacaacauuuuugucuagcagcagauaucagacagccucuaauuuguagcaguuuacuaaaaaaauaaagcaaaugcaaaaucaucuuagaagucagagggaaaugccuaugcaguuaagagcagaauagugcugcuacuauuauuccuaagauucuugaccuuauagaagauuuuauauuuaaucgguuucucuggagcccuuguuauuuugcuagauaagagaauuugaauauguguccccuauucuccugcuauuugguagaagagaugaacuggaauaaguggcacagauacgcaauaagaaagugcaaagucaguugagaguuucugucuuggacuguuaggcaaguuccgugaaggagacauuuauuucaucaggguuguugaaggcuaacaugucucauuuauuuuagaaguagacaagagggccaggugcaguggcucacaccuguaaucucagcguuuuaggaggcugaggcaggaagauugcuugagcccaggaauuugagaccaaccugagcaacauagugagacacugucuguaauuuuuaaagaaauagaaaauuuuaaaaauuaaaaaaaaauuuuuuuaaguagacaagggcgguccaauuuuaccaaacaguuuaagggaagaggagguaggaaaaccuaauuucagaggugacuuacaaucccauuagagggaaauucaaguguuugaggucuggaggguaaagaagacgugguuagaaaggauacaguugucaagcugaggagagaaccuaagcagucggaggccauuggagauacuggaacaacaaaagcgugauuuauauuugaguuuuuagaaccaauguggaagagacauggagcagguguaccagcugugccuuuguaagaucugaaaugagggaugauaagaaccugaacuagagcagagugugauacuggaggggaaggagaguucauguaacacugauuccccacauagggacgaaaaccauauuauuuucacuguguuguacuuuacuaaaggauaaccauuuacaguagcagccauuuggauauuuauauauucuuaggaucaugcuuuuucacauagacgucaugaaucucccagcccagagguucacaaaggcacagaauguuucacuggggaugucaguuuuaaucagaagcaaauaauuuaaaacaauacuuuuguaauaaacaugacaauauuuaccuaaaauuuuaggcccuaaaaugaggcuucaaagaaguuuuguguuugggccauauccucagucccuucugggcaaaagauuacccucuuccacuguuaguaauacagaaaauaggaaagccaaagacaaguguuacagagaugaagauguaaccuuuugggugugacagacauauauauacaaacacacacauagacacacagauaaugucaaaguuugucccaagugcaucugaggagagguaucugaucuugcucuugggcagccaggguaccuacuagaaaaagcuuuugagaugagacaguaccagaguaagucgaccagauauggaaggagauauucuuaggcaugauggauugaauuaaggaggccugaaauuuuggggcauguuggcagcugugccaguuccguaugguuggaaugcagaguuuggagugagacuggaucauagaagaucuuaaaaaaauuuaauugcugcuguccacagaggaugugugaaauaguuuguaguaauuauuucucguuagaaaaugguggaguggagcucgauaugcuuuucuuuucuuuuuaauguuuuuuaaaaauagagacuagaucucuauguuugccuaggcuuggcuuaaauucccaggcucaagugguccuuucaccucagccacccaaguaacugacauuacagguccauaccacuacacccagcucaguaugcuuuuucauguuaagguuuucccauucuuggcaaaaccagcuauuugguuuaccuguacuuuauauuagagguugaauauuuugauguucauaggugagacagauaauacagaugagugaggaggccuagugugucacacaggagauuguugacaucuagagguuacugacaucuagaguuaaccuuuucaacuaaaaccauucaccauguucuuuuuuuuuguuuguuuuuuuaaacauaguuugccaaacaaaacaucuguggccugauuccaagggcuacaaguuugcaaucucugauuuaaauuucuuggagauuagcaccaucuuauuuccauuacauguuaauacauucuucuugucauacacaagcaauauuuaauuauaacacuggaaaucuaagauaggcaaagaaaaggaaugaggaccaaauuagccauaaaccuggaaggguagaaguguagaaucuuauuucucauuuuucuuuuccaugugcugugauaaucuacuuucuauuuuucaagucuucauuuagcaaauauggaguucaaagugaugugcuauauauauuuuuuuuaaaaauuacuaauuuguaagcaucacugauuuuaaagaaaaugcuauuugugcuauacaaaaauauauuuuuuaauuaagaguuaauuaucuugggaucccuaaaggguuuuuguuucaccucuguccaacaagaguaaaauuguuaaaagauguguugccaguucaagcuuaagacaugcauuugaagcugucugcaaaaccucauauauggcaguagggggcacucgugcuaacuuagccaaaacucugaaauaaacccagagcuuuuaaugugccagaaaaauuaaaguuuuuauuuuuuauuuuuuauuuuuuauuuuuuuauuuugagauggagucucgcucugucacccaggcuagagugcaguggcacgaucuugccucauugcaaccuccaccucccggguucaagugauuuucccaccucacucagccucccaaguagcugggacuacaggcgcgcaccacugcgccuggcuaauuuuuguauuuguaguagagacaggguuucaccaguuagccaggcuggucucaaacuucugaccucaggugauccaccugccccagccucccaaagugcugggauugcaggcgugagccaccacgccuggccuuaagcuuugauuuauuaucuuuaauauuuuuacaacuaguuuauuagaaguaacuaauuguacuucaaaccuguggguuucugcuuuguuuucauauaaagaucaguuuuucuuaauaguacuugucuuucagacaauuggugugaccuuugcagccaugguuggagcuggaaugcugguacgaucaauaccauaugaccagagcccaggcccaaagcaucuugcuugguugcuacauucugguauguucuguuuuaaauuguuacgagacaaccuugacuaccaccuuuuuuggguggcucuucacaguuguaaaugaccuacauggaauuuaagccucauguuuagaaaacaccauuuucuucagucauuacuggcugcauuauugccagaccuuugcuuugaaaaguugauuuugcuaagaccauggacaucuucaauacgaaacuuguaucuucugacagucuaguauaugcagagauuuacuuuuguguauuuuguucgauaccaggaggguuuuauaucuaguacgcaucauuugagaguuguuuuugucugguauguuuagaaaaauuaaaaacugaggauagagaaaguugugcuaaaaauguugcugcgaaauaacaaaaaacugagaggaguccuaauagaaguguucuguguagaaauuucacccacuguuuugccuagagcaaaaaguauuuuuaaauuauucaucaucaugagauaguauaccuuauuaaccauauaacuugaucuagaaauguuauucuuuaagcuaguauugaaaauucaguauaaagauagcuuugugccuagucuaugagguaaacgacauuuaagaaaaagguaacuuauucuucuuagcacugaaauaaugcauuaucuaaguuuuuuuucaauuaaggaguuccauuuaccuuuguugaauuacugguaaauuuuuuacgaaauuguuuauaaauaucugacaacuaaaauuacuuauuuauaagcuguuagcaguccuuauuacauaaagaaacagcagugucugucuuagaaguucccacauuuuaaguuuaucaucauaugcuuucccuuuugacagcaguagguuugaccuugaguuauuuguuuuaagcuuguuuaucucaauuauuauaugaauguuguagaaacuagugguaagcucagauucaaauagcuacauggaauuugaugguuacuaaauaaguagauuaguguuugcuugugagugugauugauuaggaauaguguuaauguugugauauagaauuugaguagucaccaauuugggcuguagaauuugguggggguaguauuaucuaaaggcagaacuuuuugaaucauagugcuuaaacaguaagguauaauauaaaguggcauguuagaagugauauuuuccuuuugcuuguuauuuaguaaauacuuaaugagcacuuccucuuucuccaggugugaugggugcagugguggcuccucugacaauauuaggggguccucuucucaucagagcugcaugguacacagcuggcauugugggaggccucuccacuguggccaugugugcgcccagugaaaaguuucugaacaugggugcaccccugggagugggccugggucucgucuuuguguccucauuggguaagcugcuguguuuuaacacuuaauucuuggugcauaguuuccuguaaccugaaauacuccaauauccuaauugauugagucauuuauuuuaaaaguuuuuuuaaagauuuaugcuaauuugacuggauuuuacuaccugacaucauauaaaaaucauggcaacauggucaaccauuauuacuggcuuuaccaaacacaucuaaaaugggaaaguuggucuggagaacaugaauauugcucugaugcaagaaccuuccugugaaaugggcaaguggcucauuggaggaaugaguaucauggauuuugaacuaaugcaaauaagauuagacaguacauguacccagaugucgucuuaccuacacaguauaccaaggagauuuuuuuuuaaguaauauaaaucauaaacucaguuaucggaaauccuuuuuuaaaaaaaaucuuguuuucgcauuuugauuucaggaucuauguuucuuccaccuaccaccguggcuggugccacucuuuacucaguggcaauguacgguggauuaguucuuuucagcauguuccuucuguaugauacccagaaaguaaucaagcgugcagaaguaucaccaauguauggaguucaaaaauaugaucccauuaacucguaaguaaugcuuuuuauuuaacacuguuacucugucacauaaggaugcuuguguguauuugaccuguuuugguuuauggcuguauuaguuuucuagggauacuguuaacaaaguaucgcagacuggguggcuuaaaacaaaacuugauucucuuguaguucuggaggccagaaaucuaaaaucaagguguuagcagaguuguacuucugagggcccugagggaaaaucuguucccugccucucagcuucuuguuacugcuggcaguccuugacauuccuuggcuuguagauggaucauuccagucucugucuccaucuucacauggugcucuuccuguguaccagggauuaggauuucauuauauuuuguuggggggcagaggagggucacagcucaaaccacaccaauggcuuugucagauuuccuguuuuacuucuguugcaguuuugucuguucucucuuuaguaaacuauccaaaaaaaccucuugauuuuauugcaacuuaguguaauacuuagguauucauuccauuaucagaauauuuugucuauuuuugugagccagugucagggugcaauaaauaaugugcucuuacugcucaguuaauuuuuuugguaguguauuuugcagacuuuaaaacugaagaaauguauuaaucaaguauuauuuauuggaaaauguauauaauugacauggaauuuuuaauagaaaagccuauuuuauacuucuagaaauuagaaacucuucaguauaaagagucuaguuucagagauaugcaacuuuaguugguauuaauuguuauuauguuuuuuucuuuuuucuuggagucgaccaaaguggguuauuuuauuuaaacaauuuucuugaguuucauugugucugucacauuuuuuuaaaguaauuugauuuuaucuaaaaauaaaacuuaauguaaugguuuagggggaagaaaaaguugcuguacuguaaagcuuacagauuuguagaaguuuucuuuagaggggugaagugggucuuuuauauuaaaaaaugcuagacuugugucuaacagguuuuuauaaagguguuucuuuggucuuguuuugauuauuucauugucugccaccuaguuuucuuugcaaguugauauaugcagagugucagagaauaaaauaaugauuuuuuuaaacugcucuuuaacauuuaaaagaugagucugccaaaaggaagaccuuaacuauuuucuagucuaguacuucauuaguuggcaguuaaacaucuuauuuuuaauuuccauuuuauaucacuaagacaaauaguauuuuucuucuuuucuauauuaagaauucaacaucacuauuagaauugcaucauauauaaugggcauaauuuucuuuucuaggaugcugaguaucuacauggauacauuaaauauauuuaugcgaguugcaacuaugcuggcaacuggaggcaacagaaagaaaugaagugacucagcuucuggcuucucugcuacaucaaauaucuuguuuaauggggcagauaugcauuaaauaguuuguacaagcagcuuucguugaaguuuagaagauaagaaacaugucaucauauuuaaauguuccgguaaugugaugccucaggucugccuuuuuuucuggagaauaaaugcaguaauccucucccaaauaagcacacacauuuucaauucucauguuugagugauuuuaaaauguuuuggugaaugugaaaacuaaaguuugugucaugagaauguaagucuuuuuucuacuuuaaaauuuaguagguucacugaguaacuaaaauuuagcaaaccuguguuugcauauuuuuuuggagugcagaauauuguaauuaaugucauaagugauuuggagcuuugguaaagggaccagagagaaggagucaccugcagucuuuuguuuuuuuaaauacuuagaacuuagcacuuguguuauugauuagugaggagccaguaagaaacaucuggguauuuggaaacaaguggucauuguuacauucaucugcugaacuuaacaaaacuguucauccugaaacaggcacaggugaugcauucuccugcuguugcuucucagugcucucuuuccaauauagauguggucauguuugacuuguacagaauguuaaucauacagagaauccuugauggaauuauauauguguguuuuacuuuugaauguuacaaaaggaaauaacuuuaaaacuauucucaagagaaaauauucaaagcaugaaauauguugcuuuuuccagaauacaaacaguauacucaugauugcuaaguguuuuuuuauuuuugcauauuuauugaacugucuaauugaauacagcuugcucuugucaccucuucaagcuuucaagccuuuauagaaaagcuucuuuguggcuuacacuggaaauuaugaaagcaguuuuucuccuaagacuuuugguuucucgcauugccucucagacuaagcacuaaaaagcaaagcaaaacagaacuaguucugucuuaaugaaauauaucaacccaaaaguguaaugaggaaaaugcuucauuaguuuccccuagcagacuuuuacuucucuuacacugcuacaccauuacuuucuugagacauuuguaaguucuuugauacagaagaguuauauuuagaagucuuuaaugaagggaaagaagucuguaugaugacugaggugauugcucuuuuugacaaauguuuauuacaguaaugcagaaauacuguuaaucaucucaaaguacauaggaggcuuauuucugaaacaaagguuucagccagauguu

SEQ ID NO: 21298 - RNA, 4573 nt, Homo sapiens
cagguuuaucuggucuccuuccauccccucuaguuccagagcagcuggggguggggguggggauggggguggggggagugucugcaaguccuuuaaaagccucugccucgccuaguccgugcucuuuuuaaguuagugcuggaacguggaagagcugcugccuccgaagcaguaaaccagccccucuguuuguuuguuugcuuugcccuuaguuccacugcuccaaacccacccaccaaggacucugaaccuguccaccccgggcgcaucaagaucuuccagcuggguacccccgauuugggccgacuuugcaccuccaaacaaccuuagcaugaugucuuaucuuaagcaaccgccuuacgcagucaaugggcugagucugaccacuucggguauggacuugcugcaccccuccgugggcuacccggguaagugagcccugcugcacucccgcaccccucuuccccaugcccacccuccggggaugcaacacccuguucccauggaacacggggguuggcagucacacuguccccacccagcuucaggcuuggucuccucuagguuugccuucugaggaagcagucccagggcauuuacugaccaagcagagaacagggguugggaaaagugaguaggugggucugcaaccguuacaaucacaucacuuuauucuuaauucgaguaaauaaggauuggcaucagagugggaugaggaagguuacuguccuugucauuugggcaaaagaccccuacccauaucucaaugaccaauuccucagaaguguccucuuggagaagcugaguuuucccuccguaaguccuuagcacucucgggcuucgcaguuguucccuccaugcccaggccuuccccuaugaccuccagagccugcuuuaaucccaagaggcgugacuuccuccaaaugcgggugcuuuccuuuccaaucagauauguuuaaaaauccucccaggaguaugaacuauguccccauuuuaaagauggaggaacaaaggcccauggugugcuaaaaaccaugggaacaggauccagauuucccccaucaauucgagcugccagucuguccucggagauccuuugacuucuuggaauagccuuuuuguguugugguuuggggguugaucuuggagaacuuuuuugugugucuuuuaaaaaauguuucauuuguuaacuuuccaagugaugcucugauuggagcaaucucaacaccaagaagaguagggaaagaagcagcguguguccuggguccccggggagcaaggcuggggagacgguggggagagcauugguaggcucccggcugaagggcugugaggaacgggggacugcugcgggguggagggcaggggcgucggagaacccgcggaaacgccuaugacugagaaacugcucccccacccuaaagggcccugggcuucuugucccgcagccaccccccggaaacagcgccgggagaggacgacguucacucgggcgcagcuagaugugcuggaagcacuguuugccaagacccgguacccagacaucuucaugcgagaggagguggcacugaaaaucaacuugcccgagucgagggugcagguagggcagaugcaggcagaaccauccuuccugaucaugccacccuucccgaguaugggacuguggagagccccaggucuuucagaggacugaaggaaggcuugaaauucuccuucacucacuaaggggccaggaaacuauucuccuucugcccuuuuuugccugcccgucaccacuuaaucccguaagcaagggucuucaaggcccggguugcugguggagagagacccauccuugagcagguuucaagaguagucacgugguguuguaacccuucccuuccucuguauagaaauccucuccuauucucauggacuuguacgugugaaagcagcuuagcucuuggacaguccaaguauuuuuacagaugaaaaaauagaguaaaugacuugcucaaggucauaacuaaguuugguggcagagucaggguauagacgcagcuggugcuuuuaccaaauaaaucaacacaaaaagaauguauuuuccuugacuucuuagggauugaagagaauuuucuaguucugagccauuuaacagauaaaauaucuacauaaugucucuagugacaccccucuuguuuuaguuccccuaaacuugaccuuaaacuggagagggaaggucaacuccagcuugccuugugagugagcccuguacagaauucucugcaaaguguuuagcacauaaaccacauacacaccugggccucuccuucggcuagaauauguuuaugaaagcgacagacaucagugucagcugcaaauugggaaaggggcuuuuucaaaguagguuagaggaaguuuuagcacuugcaaggcuugaaccaaaguccucacuaggagaaaacaaauggcuccaaaugguugguggucuugagcuuggccuugguggccucacuuuuaccacaguuacggcacccauacagagagcucauucaaaaguucagcuaaggauuuguccuccagaaaaugccaguaguuccucuucuaagcccccucguacaccaaucauagcuccuucauugcagaacaugaacagggcugguaaagagaauugucaagauugcagcaggggguugaagugguaagucaguaaacacagcacaggagacugagucuaugugcugaguggcacuacucuaacaacacagacucgagucccagagacuagcaggucugugcuccagcucaaagcagagugcauguaagucacuccuuuuaccacaaagaagcuuuuagcaaauaguggcuuucagaccucuuucuucaacaagaucaugucuuccccuuggagcuuuguucugugagucuuucuaagagagacagaagggugauggaaccaaccaaccucuauauuagcaguugcuuccuggaagaugaacuguaaaugaauuuaggcuguuccuguuagccuguaacaacagaauugcuuucucucacuucucauguauuucccuccaaaagacagagauacauucuauuccucugugagaguguuccaaaauauagcugggucuauguguauguguguguuagaggcgaaauaagauaggaaagugauguggagaguuuuuagcuauaugauuugggggauuaucuuaaauguuauucugggcaagaaauaagacagugucaaguguuuuuagacagagccuccccaacuuucuuacaaguccaggaguuuauaugagaguaccacauaauaggucuucaguggcaggggaaauuguguguuuagcugaucugcccauguaggauagauuuauaauacgggagccauucuuguccuuaaggaacuaucaaaaccgaguuaaagaauuuucuuucccuuccaagguaugguuuaagaaucgaagagcuaagugccgccaacaacagcaacaacagcagaauggaggucaaaacaaagugagaccugccaaaaagaagacaucuccagcucgggaagugaguucagagaguggaacaaguggccaauucacuccccccucuagcaccucagucccgaccauugccagcagcagugcuccugugucuaucuggagcccagcuuccaucuccccacugucagaucccuuguccaccuccucuuccugcaugcagagguccuaucccaugaccuauacucaggcuucagguuauagucaaggauaugcuggcucaacuuccuacuuugggggcauggacuguggaucauauuugaccccuaugcaucaccagcuucccggaccaggggccacacucagucccauggguaccaaugcagucaccagccaucucaaucaguccccagcuucucuuuccacccagggauauggagcuucaagcuuggguuuuaacucaaccacugauugcuuggauuauaaggaccaaacugccuccuggaagcuuaacuucaaugcugacugcuuggauuauaaagaucagacauccucguggaaauuccagguuuugugaagaccuguagaaccucuuuuugugggugauuuuuaaauauacugggcuggacauuccaguuuuagccaggcauugguuaaaagaguuagaugggaugaugcucagacucaucugaucaaaguuccgagaggcauagaaggaaaaacgaagggccuuagaggggccuacaaaccagcaacaugaaauggacaaaccaaucugcuuaagauccugucauaguuuuagaucauugguuauccugauuugcaaagugaucaaaagcauucuagccaugugcaaccaaacaccaccaaaaauaaaaucaaacaaaacuaaguugugaaggaagggagggaaggucauagccuucuuaagcagagguguuccauuguuuuagccaauccuugguugaaucuuaggaaugaacagugucucaagcucauucacguuucaugaccaacugguaguuggcacugaaaaaacuuuucagggcugugugaauugugugacugauuguccuagaugcacuacuuuauuuaaa

SEQ ID NO: 21299 - RNA, 33820 nt, Homo sapiens
ugcgggcccgcggcucgggcggcaccagcggcucccggucucucucucugcucgcccucagucccacccggugccuacggggccgcaucgccgcccggcucggcccggcccaugcccagggccgcugcucccucaguugccgccgccgccgccggcgcccagggggccgccgcggcugugaggugggggcggcagcgggaggcggcggggcgggccgccggggccggggcugggggcgcagcgcggccggcguaggucuaugucgcgggcggcggcggcggcggcggccgcggagggacgaugcgcgaguacaaagugguggugcugggcucgggcgggguaggcaaauccgcccugaccgugcaguucgugaccggcaccuucaucgagaaauacgaccccaccaucgaggacuucuaccgcaaggagaucgagguggauucgucgccgucggugcuggagauccuggacacggcgggcaccgagcaguucgcguccaugcgggaccuguacaucaagaacggccagggcuucauccucgucuacagccucgucaaccagcagagcuuccaggacaucaagcccaugcgggaccagaucauccgcgugaagcggugagcgagggcacacgggggcuuggcggcugcaccccggagucaccgucccggggcuggaacuccccgcgcggggcuccggggaaggggcuuucugggggguggcuccaagcuggaggcuuuacuauugucauucugcuccuccuccucaaucucaaauuugagugcuuuguuucacaacuaaaauuuggcaucguguuagcccacagaacagcucuuugucucuuggacguuguuagcauugcuuguuacagagcccccaaggaaacaaaguuuaaaacuugcaggggggaaagggguggauagauuugucuugggaagagaggaacugugcagguauagucgagacauuugcagacugaacaacaacaaucugccuuggcaauguuugacaguaaaaaucgcucacacaccuauacaguaaagucaaguccagaggaaggagaccuuucucaucucguuaaagguuuaugguuccaaggcguuuuacaaaaauuaagucucuaauuuagugcaaaacuuuaaagacagauuauuaaauuauuugaagacaucauaagcuaaaugggguuucgagaauauuaacagaggaguacaaauaagccauucacaggaaaagaaugcagcuuaacuguuuguuuuuguuuuuuuguuuuuaauauagccgccuuaaccccuuccaaaaaaaaaaaaaaaaaaaaaacaccaccacaccaccaccaccaguuccuggaaacaaaacagaagcuucuucaaaagugugacacaaguauuagcuaauuuaaaguuaauguuaauaagccuuuauauauauauauaaauucuuuucuaaaguauacauuuuggaaauauggcugauaaaugauuuaaaauguuuguuuucucuuaaauucacugaauauauuuuuccguguaauuuuaagcauuagaaaugugauaauaucuuaguucaaaguuuuggcaaauuuuucuaauuaucauuuaauuacacauuacuguuucaucuaguucuuguuaguuaaugccugcugauaauuuugguguccuuuuuuuccugccuuauucuaccuagagccuaaaucugaagaccuuuacugaaagaugguuguaagugcaccguagacacagucacauuguaagucaguuugaguccacucauuuugaaagagcaaggaccaaguuauguguacccaggggaugaucaaaaauucauuacgaguagugaguuuuuaaugcaaccuaugagaucaaagagaaggcucucucucuauugcuccacccccccuuaacugaguaugcacuuuaaucgcugaacuaaaaucgugcauguuauucauccuuguguuaaauuccaaacuagaauaaagcagauauuuucguggucucugcugcuaagauuuguaaauuugauagcuuuguacuucuccaguaucauuuuccuaaaguuaaauguuuauaguuaagagaugaacaauucugguguuaaacuuaguaugaggauggcauuuaaggggcuacauuuaaguuacuuaaauucuuauuacccccucccccaaccacucaauuaaaaagaaacaaaccaaaccaacugcaggguagucugauacauugccacaugucaauguuaggccaaaugcauacaucaaaaaauaaucuaaguaaaugccccaacagccucacccuucacauuuagauauauaugcuuaaagauaugaagaugcacauauacacugauaaagccacauacccauggcuaacuucuugacacaagccuagggaacaaauauggcaaaauauuauuggauaauaugguccacauaauuuuguaguuucuuguaauuuagugcagauuacuuuucucaguuauaauaauagguuagucuaaacucagcauauuggagcaauuuguuuauuuucacuaugacccagaggaaaaacauagaguaaaauucugcaugcccaguaucauuuuacucacuagucucaguucuugauauaaaaagaucauugaucagcugaaguagaguucauaaauucucuucaccagaauucaaccguuguauacauaagaaccucuuggacccucacuugugugucuuuguaauaugguaguaguaagguauuuuacaccucauccuaaccccagcgucuggcuucccaucauugauggagaggacaugugaaugcagguggccucuucuuuaccagucuuucaguauuugauaucuacugucaaauucaguauucagcuuuaggucuaggucagcacuuuucaauagagauauaacgugagccacauauguaauuuuaacauuccuaguagcugauuuuuuaaaaauaacauaaauauauggaauuaauuuuaauguauuuuauuuaacccaccauauuuaaaauagaaucauuuugacaugucaguauucaaaaauuauuaauaagguacuuuacuucuuuauacugugucuucaaaguuugguauguguuugaccuaccacaucucaauucaaacaagucacauuucaagugcucaguagccguauguggccacaggcugccauauuggacaacagaggucuaagguguauaugauuuggggaaaugcuugcuuauuucucuaagcuucaguuuccuuaucugugaaauagagauuagcaugcaccuuccagaguccuuguuagaauuaaaugagauaauguauuuuaacauucccaaaacaauaccaguacacagaaauugcucaaaaaauucuagcugucauucuuacuuuaauaacuuugucauuuaucuuccuuaaauguuacccuugauauaaauguaauuuuagaagaaauaaauuuguaauugcauuuuggaauucauuacuuaguauauucaagaugagacuaaaaagcaaugagguuaaaauaauccuuggaagaauuguguugguauucucuugaaauuauuuccccuuaugaaggaucugauggaaaagggcaugagaaugaacauuuaacuucaaguacaguauagcaauaaugcauagcacuaaugcauagccaaacaacgaauggagcuuuucauuuuucauuuucauuucaaauaauagcagucauuuucaaggauugcuauuacuugaaauguuucacuuuuaagaaaugugaaacugacccauacucccuuaagugucuguaaguguacauaccuccguauacauacaugaccucuugucaaagccaaguggaccaacugaaaauggcuauauuuguaaauucauaugcuuucuuuucuuaacuugauuuugggugagaugacacacacaaagaagaguaacagggauauaggaaauguuuuucaguugaaauaaaacuagaauuuuuuucugauuuuguaauugcuuuuuucauuguuacccaugccaggaucagccaugguccugacaugaaguucuuggaacaugauauacaaggccucuuugcuguuaggaaaaaguccagaaaucuucaacaugaccuuucacaguccagcuugcucuuaucccucccugccugugcagccucaccucuugcacccauccuuuuauucuagcacccagaccuuaaguccuugaaaguaccuuucucugggcucuccuuuggccuguggaaaucuaccuuuuugcagaguuaauuccuacuccgucuuucacccucaccccugcuuaacccauuuauaccggagguugcaaauguuuuuugugaaauaucagaccuuagcaaugaccuugaacaguaggauauaaauaacucccacaagcuuaguguuccaauaauggaacacuaggcauagaugaguuaaaagauuuuuccccacugagggaagauguccucucaaaccaaaguaaccccuuuccugucuucccuuacuaaacuuuaugccucaccucuuugcucaaucacacauacccuguccuuucccuuuucuuugaagcacucauccaaauuuaauuauuugugugauaauuuauggguagccagccuuucucacaaaacuccaagcccacguaggugacacagcuccuacuagcacauaggaaacaagaaaaaauguugaaaaaaugaauguucagaaagaaaaguauuuguauuguuguuuggccucaguuucccuaaacauuuugauuucauagauggaggagaugaucuuuuaaaguucauuuugcagauggagaugaucuuccuucagcucgaacuuucugugagaacacuuccaguuggggcaguguuuaauacgaaccucaaagaaucagaaacaugauguauuccagauggaggaaauggcacaggaaaugcauagaauauguuuuuuggauguuaaauagagcagacuggccaaauggggaauguauauagaagugugaggggagguaaggugaaaauuuuuaaagcuaaauuacugaagguuaaagacuuaggaguugaucauguagucaaggaccauaaucacaauugucauagguauagcaauauguagugauaugguagaugucuuagugguaauagacuacucuguuucauaacaggaagaauagucauaaauguugugauaauccaguuuuuacgugaagugugaaaauccugaauuagcauggugucuguaguaacaggagagaaaggaugcaaggaauguuguaaagaaugaaguaaucaaacucagugguagaggaagaggaaaaggucagaaguaaccuugacauuuugaaaugaacaaauaggauuauggaggaauagcugggggagauuauuuucaguuuuggagaugguaauuauccagauagccagccuaauaaguaauuagaacauuugaauaaagccugaaaggucagguuauguaugaauaugaagacucaggaucaucugcguaguucagauugggagaguagaugaaaccuacuggguagaguauagagacagaaaugaauggauauggcuaacaauagaaaugaggaaugaaugaauauagccaaggauagaacucgagaguuguaagauacacaguggagacuuccuauauugcaguaggcgagaaggcgugggguguuuuaagauugggaaaaagauaguugacuagcacuacccaaggugaguaaguuguuuuuuuuuaagauuauuauuaauuuucuauaucacuuaaguggucacuuucaagugagcuggcugauuguuuacacuuucccccuuaccauaaguagcuauuaaagccuacucuaaaacagaagcauauuaccaauuguuacacauagaucuuuggcccaugacaguuuggugcuggagagccgaaacgagaguauacaucaaaagaugucugucccaaguaagugaaacuucuggagcucugcuaccguuuuucccucuaaaaauaccugcuuccccaguaccaaaacuuaauucaaagcuggaccucccagguacagagccuaauagcugugggucacuuuuuuuuuguuuuguuuugguacuggugaauuaguaggaaaaauuuuuaauaauaaauauauauaacaugaagaauugaugacuaaauccugaaagucagacauaaauccaaacaaagaauuuggguaugaagauaaggacugauggugaaaccucuauccacuuaaauacaaaacuaagauaaaagaauugugagaauuauggcugccaaacagaauauuaaaguuaaaaagacugacaauaugaaacaaacaauauaacuaguaagucaggaugagaggagggaaauaguuaugagugcucacuucaucuuucaugagagggauuuaaauggucaaaaaauugaaauuuguuuugaaaaugacucgaagagcucaguguuuuucaugaucuuuuuuucuuuaaaaaccacuuuauugagguaugauugauguacaaaaagccagacauauuuaauguguacaacucagugaguuuagagauaagcauacacuugugaaaucaccacaaucaaugcuguaaaacuauccaucaccuccaaaaguuucccccugcuuuauuuaucuauccauucauucauucauucauucauuuuuuuuguaguaagaacacaacauaaguucugucuucuuagcaaauguuuauacaauacaguauuguuaacuagaaguacuauuaccauacagaugucugggacuuacuuaucuugcauaacugaacuucauacagugaaucacuuuauguggcccagaaguuuuuccugaaaaggaaacuuuuguuuuggcugcauuguaaaauuacagguuacaguauauaguuuucuuuuugccacuccaggauuguaauuuuuaaagcucaauuuggaguuggaggagaugaugucucuuccucucuaacauucugugagagcacuuuugucuggccggggugaugagggaaggggucaaguuuaauaugaaccuuaaagaaucagcagccugugacccacaauuuugucuaguuaagauuugauaauuguaucaauaaaaucuacaauaaggaauaauuauacuaauacuuauuuuuuaauggagggcaaaaauaauuuaaauuauuaaacauuaaggaagagguagaggaacuaagaaaaaucacuggauuucacagccaacaggaagagccaacaaaguuggaaucuauuugcuaaaguuucaguagcaauauacuugagugauuuaauuucugugugugaaguucugggaaauuacauauggcacaauaaggugcauauauuaugcauguauauguacauauuuuuaagcaaggaucuuuacauaaaaccaaguacacuguacuuaagggaauuuuuuuucagggguauuuuuuucuuuucaguucucuuuuagucauugucuuuagaaccuuacugccuaggggagcauguaugccuuacucugggguuuucuuugcuucuguuuugauuuuucccuguuuucuguuucucuccaucuauucuuaccuacuguuuuuuuacacacuuauauuuuucaggccuauguuguaaaaagaguuuuaaguacucuaaguuuuuuuggaguaauaagaguuugaauacgagcagacuuucaaacaagguaaaacugauggugacugaauaguuacuaaaggaaauguauagauauuguguuuauguaggaaauuuaucuugaaauuuuaauggugugcagaaauaugccauauauuauauauugccauuucauuuguuacuuugacacuugugguucauaucauuaaaaauuauucucagccugacagagagaaguuuaauuucuuaaacauccuuucugcuuuaccagaucaaacucagccuuuuaguagaguaauaucaauaauaguaaugcuguaauuguggacaucugcauuucagucaaguauguuaaauaaagcauaaauauauuaguaaaauuuaaaguaaucaaaauaacuaaaaacaauauuugaagauucuaauacauaaucuagcuaagauuuugucaugguauguauuaaauucuuucucuggcauaauuguauagauggggauuuguuuuuguuuuuuauuucucuaauacauuuaagauuuuaaaacauaccaaaauuuauauuuagggagaaauaaggugacuuauaauuuuuauuuuuaaauuguuaucugucaaaaagccaaauauuggaaaaaauuaauaacuaucucuauuuuuauagauccacucagcaggggauuucacauuuucuuaaccagggcccucaguaagaaguacauuuuauauugugacuuagugcacacauaggaauaaauacaucuagccgaaaucaacauuucauaagacaguaaacuugcuauguugcuuguauuacuuuuucuauuuauuuuuuucuauuuuauuucguuguuuuuaagugcuuuucaugacccaccaaauugauuuuaucacacauagcuuggaaacugcuauccuaggacauuuuuacucuaagaaaacuaaauguaacuaucuguuuaauauuucaucuucucucuccugcuuuucugguucccagcaaugcuguguaagauuacgaaaaugaaguacuucccaaugugaguuaguaaauacuaccuguaauucagagaaagauagcauuuagucacugaacaaaaagauauagcauaucuuuugagaaagcauuuaucucuguugugcauauuagaaauaugagaauguauuucucauguaauguuguucauucuaguaauucaagauaacuuuugccuugugaaaacuuagaacagagaaagggagguugugguaguauucagacuugaauacaugagugcgggauuaucuauuucaagaacaguugcugaggagguucagaaaacucaaaauagaggucugcugcaucuauccaggauaacacugauucaccucucccuguaagacaguaaaacuauaaauaucuuaaaaucacuuaguaaaguuacccaagagaaacauugaaaaaccuuuauuuaaaacauuuaggaguguucucaugcuuuccugacccuuagaaauuaauaauucaaauguggaaauacuauauuaauaauucaaugcauauuaguauuuucucuacuaaguaucuuuacagcucucucucuguaaaugaaaucuuagaguauuuuaagagacagggucuuguucuguugcccaggcuggagugcagcggcgccaucagagcuuacugcagccucuaacuccugggcucaagcaacccuucugccucagccaucugaauagcuaggacuacagagcaggcaccaccgcauccaaguaauucuuuaaaaauuuuuucuagagaugggaucuuguuauuuugcccaggcuggucucaaacuccuggccucaaguguuccgacuaccucaacugcccaaagcacugggauuacaggccugagccacugccccugguccuaaauuaauucaucuuuagguuuccaaugaacauuaugaauacuguauguauuauaauucucgaauggaguauuuuauuguauauacuuaucuucucauccaugaagacagcgaauguuaaucucauuaaagcugagauccagcacuuauuaguuauguaauuaggagcaaguugacauuccuugcauuuuaauuuccucauuuguaauaugaguaugauguaguaacucgugagauaacgaacguaaaguguuucuuuacauagugaaccuaaaauauuaauaauaaaguuucaccaagaaucacagaaauaggaaugaaacccagccuuuuaucuguauacugccacgugacuucuuaggaauuaggcucaauugucuuacuauauugagaugaauuauauaccuaguauaguauaacauuucuguuuuucccauugcuuucuccucuguguuuuaagugcucuaacacuacguuauagaacuuauagcauagaccuugagugcuuuguguuuuugccuuccccuagagaccuaaauauauuggcuauaaaugguggcgguaaauuuuuugacucaugaggaauugugaugauuuuuaguacacauauuuuaaauauuaauaugugacauaaaaagcaaucagcauauuaguauuuguuaacacuucucuuuuuaaaaaaguuaauaaugacaguagaccucuuuaugaauaccaaauaugcauggggugaagauaauuuuaacagucuuuauggcuaguuauauauaguaacaugcuggcauagcuuuuuaauaaucaaauugagaaaaguuuugucuuuguauaaaagucaucacuaucaacuaauaucauuuaagccaccucauuugcauagcauugccuugggcauuauacagaauaagaacaagauacuaucuuuguccuucuggugugccaaaauguccuauaaauggguauauauuuugcaguauugaguuauacagaaauauauuuuuaaagacacuuucauuucuaaguuucaaaauauuuuugcaccaaaaacauugcucuuauuaggccaccuuuucuaaggaaguuuuuauucauuuuauggaaauucagaauuuugucuacaagacuaaugacaacaauuguauauuuauauauaaucgccuuuuuguauaugucuuagucucuucaggcugcuauaacaaaauuccuucgacuguguaauuuauaaacaauagaaauguauugcugacaguucuagaugccaggaaauccaaagucaagacaccagcaaaauucgugucacaaauggugccucuugcugcaucuucauaugguguaaagggcaaaauggcucccacaaaccuccuuuauaagggcacuaaucccauucaugaggguggagccaucaugaccgaaucacuuccuaaaguccccaccucuucauucuaucacauuggggauuaaauuucaacauaugaauuuuagggagacaagcauucagaccacagcaguauauuuaguacauuuuuauccucccuaucuaaaauauaauuucuccuucccucaaugauccacuuacacuccacugcuuucuuuuucuacuucgugaaccaacagucccaacaaacuuugacaaucaguaauguugacugguaaagugaagcacugaaauccuauuguuaaguagccacauacauacauacaugcauacauacauagauacaugaaagcuaaccagaaaaugaacuaaacuuaauuauuuuuaguuuauuuuuuaugagcaagugaugagaaaauaauuucuaaugguuaauccaguuuaugcauaauaccaaugauauaaaacuuuuuuacaauggucuagcauuaaggaacuauaauguuugcauaaacccuaugucuguucuugcuggauggucaacuaguuuuggagugcuguuaccuuuauugaagaaggauguaaacagagcauuaucucaauaggugcagcugcuguguggagcucugugcagggagagucccccagcugugugugagcucagucaugggaauacugugauccaccagcagcauuuguccugagagaggcagccaggauguuguauguuuaccaucccugcugaacaaaucaguaucuuaauuaugguaggaugccucccagagguauauacauuuuaaaaggcuacucuugaugacagaaaauguuuauuccuaaggccacccugagcacaucaucugguuuuauugaaggaaauacuuguacauuuauggagggaaggaaauuuauuuuauugcuugcaucagcauauccuacuaaguaaugaguccugaagcuuuucuuuauaggccacagugaguggcuucuuaacaaucacauaucuauuuuccuuugaauaaguaccauugcuucaaucuauucccuuuucuccaaaggugacuguaugucucuuuuaucugggacaguucaggucuaugcuuguuguucucuacauuuauuuacaguaccccuuuccaucuugaaaguaucucagugugggcaauaaauuuuauggucacuauagacuguuaccucaaacucucucuuuuuuuuuaaaucaugacaauucaaaucccauuugugcauauauuuuugagauaccuuguuuaaauaaacaguaucuuucuuugaccuggccagcuuccuuuuuuaaagcuuuuguuaauuuggguaaacaaauccucaugaacuggaaauguugcucaguuuugaaagaugacaucuuuuuuacuaaaugcucuugauuaaagauggcugcagauucuuugacacaacuuccauugagaaguaggaucuguuuccucucccuuugagucugugcugccuguuaagacuguguugauccauagaguaugcuggaagugauaaccaagccaguuuggggccuaaucucugagaagacuaacagcuuccgccuuacuuucuugaagcccugagcuaccacauaggaaguccagcuaugcugcuggaaaauucacggagaggcccggaggcuagauagagaggaggagggagcucccuuccagccauuccuaccaacgugccaggccucaagugaggccaucuuugacucgccagcccagccuugcucacuauaacuaaagaccucugaguggccccagucaauaugauguagaacagaagaacugcccaacugaguucugcccaaauuguugacccacagcaucaugcaauauaguaaaauggcuauuuuaagccccuaaguuuugggauaguuuuaugcagcaguaguuaucuggaacaauaacacauuuuuagauaaacauguuauuuuagaaauuauuuugguaagaguacuauugauccuuuugguuucuuugugaagaucuuuaaaaaaaauuuauugaagaugauugaauaaauuuuaacucuuaaaauaacagcaaauuuauggagcaccuaccaacugcccuugcaauugaucuacccgaugucauuugaccacucucacccaugcaugauuaacuguacuuugaagaucacauuuaaucguauuaagaauguaguguauuauggcuuaauuucagcagaaaauucaaauguauguaugugcccuuugcaacuguuuauacucauagucugaacugccgucucccccuucacucuacccacaggguguacuguuuauaaaaguaauugauguaaaccaucuaauuucuguugaugaagaaagagucuauuauuugguggugcucugccucaauuuugauaucuagcaccugacacauagaaaauaucuaguaaauauuuguugaauuuauaaguaaagaucccugcauucuguauuuugacaguuucccuccagaucccagaucucuggagaccccuuaugcaucaaaucaauuuaagcauuucagugucuaacacaaggcaugauaaagaaaaauaauaaagcauuuuagauaguguacauccaaaaaugcguuuuuagccugguggccauggacauguuugcauugauuuugugacauuuuuguuacuccagacaccauggacuacuuaaggaaagugucagauuugaagaccaucacuucauuaucucauucuacuuugugugucuauaagugucaagaacugauuccagcacuggggauacagcugcauauaaaacauucauugcccuugccuuccucaggucccagauguaacuuuaaagguagcacaccuggcuucaggcagaaacaagacuuuagcucaaaacuccuuauacuacucagaguucuuggguuuuuuuuuuuuuucuuuuuucuuuuuuuauuaacccaccuugucuuagcuaggccuucagagccaugguucacagcuagugacuugacuuaguauuuacugcaggaagaugaacagaauaaggaaagcuacuucuguuuggaaaagaugguauuagauauuagagggaaagguaucuauccuguuuuucucaaaucuuuuccacaagaauaaugguuuucagacuagaugguuaguuuuggccauccuuggccagaggaauggaagccagagauaggagauaaaacauaaauaacaguuuugguacauuuuuacagcuauaucaccauuaagauucuagaacugccuuacuaacagacgauuugagagaacuuagagaaggauaauucucauuucuguaguauuuuacaauauccacaguacuuauuaauucacguauggcuguagggcgggaggcuguaaaacaggcugauugcccaagugugguguguaacaccacacuaagcuguuaguaaagucaucaucaucaucuuccuuaacauuacaccuaaguaucaauuaauguuuguuucacaaauaaggaaccugaggcucagaaagcucaugacguauccaaggaggcagagcugggacuuauuucuagguccucuaacucuagauccagcucucucuugugguacacuucaucuuaauuuuccccagugaccaaauugugguuggccuggacuguuaaucuagaaauaauuuacccagaaaaaaacucagguucgcucacuugaugaguaacaaagaacuccccaugagaauguggguuuugaucaauaggaguuuuauuacuuggugcuaggaaguaggacacuguaaggauucuucaaggcacugccucccuaaggaaaagcaacaggagggcuuuauggggcaauggagaggagagaagggugcagccuugaauauggaggagggaucccaggugcacagaugcagugagccaucaugccagcacauaggucgcauguuaugguaaugaagcuguugccucucccacaguggagacuuuagcauaguaaguugcaggggucugucaggagcuaguuuaagccaacaaagugaccgcauuccacacaggcuguagggcaggagguuguaaaacaggcugauugcccaaguugaugaaauuccuauaaacccuggaaaccuccuugucugcuuacagauaggcuuuuagcuagucgcuguagaucugcuacauauuuuuaugggauaguugguugggggaaucacugaaaaagcaauguuuuaagguaauuauuacggaaguagcauaggauagaguagaagagugagaaauuggaggcaagaccaguuaggagacuguugcagugucuuagguaugaguuacuuuggaaaugaaagcguuuuuguagugggagugaaaaugaugggacagauuuccucacauccaguaauuccuguucuguccaucccuguaaucacuacuggacuagaccuguuguugcggccucucauuacaccugaucaugcuuagagacuauuggacacucuguugcuuaccauccacucucccuugccccacagugaauucuuaaaacuaucuuucugacuucuuucauuucaguguuggcuugaacccugucaaaauguaacucuucauucuccauuggcugcuguugagggccauaaccucugccaacaaugauaguuuucagcuccuuucuucauugugcauuuguuuuauuuuuuuuuuccaugucaucuguuacuucuccugguucaagugaaaagaccuuuuuaauaggcaucgccaauaaaucucaugccaguugaaccaaccaguuacaacaagccaugaauaaugaagguacuccucuuccucuucugaguuguuuauugcugggcagaagaaaugcuaauucuguuggccucauaaccugaguuuucuagaaagcuguauuauagagauucaguguuugggguuuuuuuuuuuuaaguuuuauuuaguguuauguguacugagugauuuagaaaugauaaauauucuaagaucuuacuacaacaauagaaaaaucuugcaggauaaauacucuucuguucauaauuuaaaaguuccuaaaaaucuuagcucuucauagcuuucaagcuucuuuauuuaaaucuucuucauucagagguagcuuuaaaaaaguaguguaauugaacuuuguguacugaauuuucauucaaaacauuuugccaaagaugcugaaaaugaagagguguugaaaagauauauacuauaauuuaauccagauguaaauuuagguagcaguuucaaauaacuugccuauuccugaguaacugacucaauuuaaucuuuucaaguacaauagucaggccuguuuuuuaaugcacagguuucagauuucaguucucaaaaagauaaaauggauguuguauguccgaauaccucuuccccuucgagagaugaaagcuguguguucuccauauaugugcccgagcuucaguuuuccuuacuauuuaaauuauguaaaaaagcaugcuuuguugacagauuuuuaaaugacauauuuuuuauuaaaauguacacucuagcuacacauucaaguaucaaauacagaucaaugaccacuuucguccaccuuauuuugaaugacuuagauauuacgcuuaaaaaaaaaaaagaaucaauuaguuuauucagauagguuuuuuacauuugguuucuaaaugauaagguuuggggcuucuauuugcaaacacuuccucacagauaacacauuacuggcacuuuacaguggaaaaucuccauuucuaauuaaaaaaacagauuaaauguaguuuuauuauauuccuuuuucuuaacauggauuuuugagguacugugacaucuugauaugccugaagagcacuguggucaauuggaugcaauauauagaucuaauagugaaggaaauguuuagaacuauuguuuuuauuuccaauaacauguuguacuucaguguuaauauucauuaugcuuucagucuuuagccaguuuuggauauaaauuaaacaguacugcauuguacagaaguuuaaaauugguuagugauauucugcugaguaagaaacugacugugaucagcuuaaucaugugccuuccgugauguaaacacacagccaacaggcaugugcaugcaauuugucuugaagguuauauuacuuuuccuguuuuaaugaagaaauuguuuauaaucuuacugauuuuuuuuguuuuuuuuuauugagguagaaauuuuaugcaguaaagugcacaaauuguagguuuacagcugggauguguacaccuguaaccaaaucccaaaugaagauggacagacauuucaggcaacaaagcaggcugccucauguuccauuucagccacuuccauacucagagaccaccauaaaugagucaugccuaguaaugaacuucuggcuuccaucauucagcauccucuaugggauucauccguguuguugcauggaccaguaguuaauucuuuuuaauggaggugcaggaugccccuugcaugaauauaccaggauuucauuaauuguucugucgauggggcaucuggauaguuucuagguagggguuaugaaugaugcuacuaagaacauucuaguacauaucuuuuggugaaugaauauguguauacuuucuuuugguguagcauuauuggaucauaaguacauguguucaguacuaauguauacugccaagugauuuuucaaaguaguuguaaacagcaagaguaacaauuauuccacauccuaaccaacauuugaucaagucagucuuuuuaauuuuaaucaauccgauaggauucuaggaaccucagugugauuuuuaucuuuguuuucuugguguauaaugauguggaguaccuuuucauaugcuuuaugaccauuuggguauuuucuuuggagaaauacccauucaggucuuuuguccauuuuaaaaauuggauuaucuuuuuuuauaauuuguagaaauucuuuauacauucuggacacaaguucuuuauuagauguauguauugcacauaccuuuccccaaucuuuggcuuaccuuuucacucacuuaauaguuuccuugagugagcauaaauucuuaauuuuauugaagucaaauuuuaaauucuuuuuaugguuaguuccuuuuuguguccuguuuaauauaucuuuuucuaccucaagguucugaggauccauucugcauauuuacuucuagaaguauuauaaccuaacuuuaguuucuaugauccaucucuaauuuguacggguggugugagauagggggucaggggauuuguuuguuuuguuuugcauauggcuauucaguugacccaacaucauuuauauaaaggaccaucuccccaguaaauuguagccguaccuuugucauaaaucaggcaaaucuaucugugugagucuguuucuaggcuauuuucucuuuugcauuucucccuucuuaugccuaaaccacaaucuuaauuuuuguaacuuuauaguaaguauugauaucuggugucuaauccuccagcuuuguuuuucagauuugcuuuggcucuucuagguauuuugcauuucuguagaauccuuugcauuuucaagaaucagucacacacacacacacgcacacacacacacacacacaaccaacggaaccuucuggcauuuugauugggauugcauagaauccauaagucaauuaguagagaaauuauguguuaauaauauugcaucuuccaguaaguaaauguuauauaucuuucauuuuauuuagauauuuuuacauuucuguaagcauugguuuguaauucuuguugugaaggucuuuuacaucuuuaacuagauuauuuucaguauuugcuguucuuuggugcuacuguaaaugguucauuuuaaauggauuuucuaauuguuuucuaauucuaauauguuugaauucuaaguguagauuaaccugguauccacaacccuuacuuuuuaaaacacuuuauaaguuauguuuauaguuuuuguuugugucuuuuuuuucuuugccuuuuugcacugucugggaacuuaauuguacauaacauuuccuuuuuuauacuuaaauauucuuuuaaucauuuugauuauaaagcauaaauuacauauguaauuaccuuuuuaaauuaaguguuuauaauuacaugcaguuuuaugaaauaaucaauuccauguacucuuuacccaguuuuucccagugagguaacaucuugcaaaacuguaguacaauaucacaaacagaauauuggccuugauacagaacauuucuaucaccacaggaucucucggguugcccuuauagucacacuuacuccccuccuuccuuccauuccccuuccccauccuuagucccugccaaccauuggucuguucuccuuuucuauaauuuugccauuucaagaaaguuauguaagugaagucauacagaauguaaccuguucggauuggcccuuuuuacucagcuaaauucccuggagauucauccaagguguuguguguauccauaggucauuccuuauuauugcugaguaguguaucugauauagauuuacugccguuuguuuacccauucacuugaagaaggacaucuugguuguuucugauuuuuaccuguaaacauuuguguacagguuuuuaugugaucauaagucuuuauuuuucuggguuaaaugcccaagggugcaauuuuucacucgugaugauuaucaugguuaauuuuaugcugccauacucuucucuaaaguaguugucuaauuuuacauuccaucagcaauguaucuaguuugcguccucgccagcauuuuaguguugucacuauuuuuuauuuuagccauuaugauaaauggcaaaugauguugcacaucuuuucaaguucuuauuugccaucuacauccucuucagugaaaugucuauucauggcuuuugcccauuuucuaauuggauaguuuguuuuuacuauugaguuuugagagaucuuucuauguucuagauauuagucuugucggaucgauguuuugaaaaguuucuccaagucuguaguuuguccuuuuauccucucaggucuuucacagagcaaaaauuuuaauuuugaugaaaucuaauuugguuaguguuuauaugauauaucuuuuucuauccuuuuaucuuuaacuuaucuauuauauuuaaaguggauuucuucuugauagcauggauguaggucuuuuuaaaaaaauuaagucugaaaaucuuuuuauucauguguuuaaaccugcguuuaauguaauugcuaauaugcuucaauuaggcccaccauuuuacugcuuguuuucaauuuuuucaccugcuuauuuuuuucuucucccucuucugccuucuuucugguuaugucuaauuuuuuauauuuuaucuguugucuuuuauguuuuuuaaaugguuguuguagguauuacauuauaaauaccuaaccguucacagucuacuuagaguuuguauuguaccacuuagaguaaaauguaaagagcuuacaaccauguaggucucugcuuuccagaguuuuuguaugcguuacauccaccuauaucaaaauccucaaaaaggacuauaauuuuuuguacguuuauacauauuguaaagaacuugaggaaaaaauaaucuuauauuuacauaguauuuacuauuuuucuuuccucauuuuuaaaauugcaagauugcuuugauacuauuuuccuucagcccaaggaauuuucuuuaguauuucuuuuacaacagauuugcuagugauaaauuuucuuagauuuccuucacuugagaauauuauuuuccuuuaguucugaaggauauuuuugcugauacaguauucuguguugacaggguuuuuuguuuuuucauuuaguauuguaaagauuguucuacugucuucuggcaucugugguuucugaugagaaauuuucaguccuuuuguuuguucuauauguaaugcauuuguuucuuuggcugcuuucaagauuuuaucuuugucuguaguuucaaaugauuugauuauacugugcuuugacauaguucugcucauuuauuuuuucaaucuuuuuucucucauuuauucaaauuagaucauuuuuguugaucuguuaaguuuacugaaucuuuugucauguacagucuucucauccgugaauguuuuaucucagauauuacaguuuucaguucuaaaauuuucaugugguuuauuguauuuuaugagagcauuuuauuuuucuguuuauuuauagaguguuuaccucauagagcaugguuauaauugcuucuuuaaagucugauaauuucagcaucuaggucauaugacaucuauugauaguuuuuacccuugagaauuaguuuuucugguucuuugcauguuugguuauuuuagauuguguuggacauuuuuaguauuauguugcuuagucucuggggcccuguuacaguccucuguagaauguagauuucuuuuuuccuuuuagccaauaaccaacccacugagguucaaacugcaaacuuucuccuuguuuggaagaugauuccgaugucaguucaauuuucaaagccuuuacuaugcugucuuguguauacaccacucaguggcuagucugagacauaggagugguuuaaauuguaguucaguucuuuaaccuuuguuauacugcuuugagucuucccacucauacacagcucauauuagcuuauguugauucauacacagaauuagggaaucuuuuucucuacuuuucuccucucuggagggaucucugggauuccuccuguucucuuuagaccacaagagcccauuuuuggucuggccagaaacaugguguuucagaguuuuagcuuucugcacugccacacaguucuugcaauuggggucauccuucugguaaaaugggaagagaaaaagaggaggaaguauacuggggauuucucccacucucuucgggacugagggcccauuucccaguucucuagccagaaagacagauuucuaaugaaguuuuagcuacuggcacugucuacugccccagcucugcuaucacuuacucuaggugaacugugaaauaagaaggaaaaaagugaggguuuucagcccacacacauacucacgcucaaagggcccccuuuacccugaucuucugguuaaagacagucucccagaguucuaauugucugugugcaccaggaagugcccacccucagcucaaggccacaagaaaaaaaaaaacgggaaaaccaggaaacucacuugcauguaggucucuuucuucuucaggcguugguucucuuccacaaacugcuuuuuucucuuuacuuuucagaguucuuugguaauuguuuuuuguguuuuguccugaguuuuuauuuguaaucagcaggagauaggcacuuuaaugggcuuaugcuauccuggccacaauagaaguucucaagugguuuuuaaauaaaacauuuaaaauggcugugaguugcaucuccaucaucaguugguccauuguggaccagugguccacaauccagugguccaaugauugugauaaucaaagcauuagaaaucuguucugauauaaugucaacacucaguuucuaugaaagcagauuauuuuauugguugagauacuccuaauagcuuugaauaucuucuggguaucauuacucuccuuacuuuuuacauuacauuuacacauuucucucuguucaucuucaguaugcauucugaaaccaacaggacaucagagcuggacugugguuuucuuuaauuauucaagcuaaauuaccagaaaugcccuuuuaagaugaaauauuuagucgcuucaaaacaagucagguuggaggaagagggcagguuuacuuagcucauguuuuucauccuuacaagcaguauugauguuucaugcuagcaaacugugguagaagccuucgaguccuaaccaaaaacaauucuuucuucaaaacucccguaacacuuuaucaaaacucccauaacacuuuauuaaaagauuaaaaauguaaauccuaaggauaggguaacaagcacucuuaagcacuauugguuuuaguauaaauuucuagauguucacugaaacuuugugugugucuguguuuacauggcaauuugaugaacuaagcuaggaauaugauuuuucuggcucaaaagguaugcaaaagauuauagguauaaacacgugagagauauauauauauacauauauauauauaaugcauacccuuugaggcagaaaucacacuucuagguguaguucaucagauuggcugcuuauuuuagccaaaaaaugggggugggggccuucauaugcauuaauggaguacagauaauuaaauuacgguacaguuauaguuucuauaaaauggaaugcuaccuagccauuaauacgauacauauuauuaaaguggaaagcucuauaauauuaaauggaaauugaggcuacuaaauauaauacaucuucauauacgcuaauggaggacagauaauuaaauuauggcacaguuauagauucuauaaaauggaguacuaccuagccauuaauaugauacauauuauuuauuaaaauggaaagcucuguaauaguggaaauugaagcuaccaaauauaauugguauaaucucuuuuuauaaaagcuauagguauacuuauauugauauauggaggaaaauaauuuggaaggauagauaucaaaauaguuauagugaucauucucacagagccaagauuaagaauuaaaaaaauguuuuuuuguuuccuauuaaguauugccagguauuuuuuuaaaaucaugacuuauuuaauuugagcaagaguaggagggaccuauaucauguuggagaaaagauuucuacauucuaaaggguaaaagaacuagaaucuaugagaagaaggggcaggguguuacagaucacaguuccuuauauacaaguaaacuuuuaaacugugacuuuuuaacacuaacauuuaacagaccugacaguacaaaauggguugccuguagguaugaguuccacgucacuaaaaauguucagacguaagcuccaaagccauuugguaaguuuaucauggaaguaauugaagcaucaguuuuuuugacguuuugccuugggacucucuugguagaugauuuuaacugugugaaaagaugaaugaggggacuuagaaaagccuuucugauucucauuuccaaauucaaagagaauuauauuucaaccugcuuaucacuaagaagauaccagcauguuaaaauucacaugaaguaugaccuucuuuaaauacgcuacgaugcagcacccucaaaaguaaaguacagaaacugacaguagugguaucugucuacaguuuaucauuggugaauaaaugaagggaagaaggaauugagucuggacuugccgcauauggaaccaugaacuauacacauagaauguuguuuggggucacaaaguaguagauuaggccagugauuccuaaacccugcugaacuucagaauccaucuucagagcuuauagauauagacauauuacauauuuuaauagacucuuggguccugaucccacagauuuagauuaacuagcucuggaauagggcccagaaaucacuaucuuuaaaagaauucucaaguuguguugaugaucagccaaguucagacacgaccagaauaaaauauauauacguauacauaccuacauaucaggacaguuacaagaaaggagaaagcaaaauaaaguauuuugauaaacacaucaaguucuuuugaguuacugauauuuuaaaaagcugucucggugagaagcccauuaacauucuacagcuaagugaugcuacagccaguauuucugauguuucauucaguccauuaagcagagcugcuuaaaagaacuaguuuuauuuauuuauacauuuauaaucagguucaugaauacagucaacacuauggaaauucuugucaauaaaaaaguguuuguccacagacuacacacagaaauaaaauuauuagaccugcaucagucaccgucugagcuggucaugcccuuaaaggaaauuucaaggaagaugggcugaaguuggugagauaucugcugauguuuaagauguaagcaaggugguaucuuacucaugaucagguuaacaauaacacauacauugaacaguuugagaauuuugcaucuuuagcuuuauguccaaaugaugaaaaggggguaaggaagaaaugaugaaaagggggaaaugaugaaaagggggaaaaugaaggcaaccugcaaaacugauaaugaaaauagaacaugaaaguaacugucaucacccacuaacaaagcaccucaucuuccuaaauaacagagucagcccucuaagucagucugucauaagugccagauuuguuuucugaggccacuuuuggcacccgaauuccugaggucuagcuucaaaugagcauuuccuccacugccagaguccugcaggaggcuguagagauggaucccacagcuggucccugcacugacaggcaugcugucgccggcucaggcauugucuagggcauguccugcuuagaaugcucuuccccuagaaccugcacgguagggagcagauucccagaaacccuucccaucuuuguucacagccacuuucccaacaaggccugggaucaucuuauuuaaaacuguggcaccugugcuccccacccaccaccugauccacaucuuuuuuuccauugcacuuaacacuuuuauuguaaacccagaauugacuuguuauguuuauuguugaugucugcgcccucugcuaauuacagagcuuuauuugcuuuguccauugauguaagugucuagaauaguggcuagcacuuaguauauaaauauguguugaguggauggauaaguacaugauguauugauuguucgauuguucauuacuagcuauuuaugccacaucaggcaguuuucaguauagccuucaguauucacguaguuaaaaccaucccaaauauuuguguuugaacaacguugucugugaaauggaacugccuaggucaugagugcauuuuggaguucugcuguugagucagagcaugcuggcaguaguggcuccgcuuguagaagugaaaccuccugcuuauguuuuggccccaugagaucucauaagauuucccccaacauuuuuggcuuuacuccugaugcacacuuucauaucucuuaaagaucagccuguuggacguuauucuuagaacagugcuaagcacucagcaauuaaccuagucaaugauauguguugacugugggugugacccaccaugucuguugugauuuuuaacuucagaguaucuuaggaauuauccaguccagcucauuuuauacuucaagaaacucaggaaaccaagauuagguuaaucuucuaaauucacaguacuagcuagaggcagccccuucugggacaggaguccuagucuguuugguuucuuuuuuuuuuaaacccaccauauugcuaaaacagauagcaacaccagcuuccucaugcagugcagucaucuacugucaacacaggucuuggcuucuuucccuucagcgucucacccaucuuucuuaaggaggauccagauuucuccaaauguuaccuucauaugggacccuauucugucaccccaauccagagccuucuuagaaugccuuucccacaggggccaguauauucucucgagugcccgcuguuugggaaugcuugcuuuucugcuuuccuaggcccccaucaccauggauguucagcacagggacucuggagaagcaccugguuagugucugguggcugcuuuguuguuuuugacucccaucuuuuuugccugucucuuccuccagcuucacccucaacucgguuugcccucaggaguucuuuaccuccuuugaucaguuucuccggcuccuucuucacccuuuguggcuucucaaggccacaucacuagaguuaggaggggaaagaagcaagcacccuccuuuuaucuaguacuucauuuuuuucagcauuaucucauuugcccuuuacagcaacccuguguuaagugggaacagauacucuuacucccuuuuuacuaucaaagaaaugaaauacagauauguaaaggaaaugaucucauuggcagaacuggaagcagagccuccaaaucuggguguagaaucuuuucuacugucccaaauuuuaacagagagacaaaauuuaucaccgucugguauucugaaauguacauaauuuuucucaacaucguacucaguuuaaaaaucuucugaggauauuaauguggauuucucuagugucuuuagaaacuugauuuuagaaaaggccacugacaaguuagugauauaauaaacagguccucugauacugacugcauuuucaucuacauuuaccaguuauuaaaugcuguuauauguggaacuguguuugcaauauuuuauuuacuguuuugagaauuagguugaugguaagauuuauucaaauucuugauuuuaauaauguaucaauacaacuuaauaauuugauuuauuugcaaguuuugaaaauccacauauucuaguagauccugaacuuaacuaaaaguguaagaaauauuucacauauaaaacaugauacaggcugggugcgguggcucacgccuguaaucccagcacuuugggaggcugaggcgggcggaucacgaggucaggagaucgagaccauccuagcuaacacgaugaaacccugucucuacuaaauauacaaaaaauuagucgggcgugguggugggcgccuguagucccagguacucaggagacugaggcaagagaauggcgugaacccgggaggcggagcuugcagugagcaaagaucaugccacugcacuccagccugggagacagagcgagacuccgucucaaaaaaaaaauauauauauauauauauuuauauauuuauauuuauauauuuauauagauauuuauauauuuauauauauuuauauauauauuuauauauauauuuauauauuauauauauuguauuuaaacauucuuuaaaauauuuaucauuuaucucaacuaauagaaagugaucuuaucacuuuuuauuauucauagacagacugaaauuuguuuuaacuuaaauucaaccaauguuuuacuuaauuuuauuaauguuuuuaaguuacuccacugucaagcaaagcauuuuaaaguacacugugauguauauacuuucauaagaaaaacgaaauguaauuacauuuugcaaguaacacaaauuggaagcugacauuguccugacauggcuggcagugucugcucccugccaagcuucucuguauagccaaucaagagaguuuauaugcaaaguagcaaauacaugguguuuuguaaugcagcuuuauucucacugccacuugcccuccuagaggccaugggaugcacaaauuguuuguauguaagaguccuagaagauguuaaaaacccuugugucuuauguucagagcugucagcaugaucuaaggcccgaaaucguaagguacaguaguguacaguaaauuuauauaaaguccuuugauauaaauugaaguuguccaaauucauuuccuauaaaaugauaauauccaaauucuagguuugccuuugauguuguuccuuccacucauuuuuaaguuguuuucauguuucacauugccaaauggcacacuaccuggaguaugcccucuuguugagaccauucuuaguuugauauagugucaaagaaaaaaagugagaauguugggaauuugguuugcuuuacaaguuaggaugaguggagagaacccucuugacaggaugaagaaaucuguggaaguaucauagcgaacaauaaccaccugccuauuauccaguuuccugaaugauaaaaauugucuaugcauccugccucaaaggcuugaccauggggugguuuucucuucugacagauuuagcuguuuccagucacauuuguuaucacuuuugugcgaucuugcuguuuagcuccuuuaaaucagaaauacauucugcuuaugggaagacacacacacacaaacacacacacacacagauuuauacuaaaaucacaaaaaccuuuuaaaaugucuugugaaaauauauuagcuaucuuucuuagaacaaacauaaagaagaauaguaaauaaaugugcaguccagcaccaguguugacaucuguugugaaaugugcuacauggaguaaccauuguagagacaaucaucuuaggcaccaaaaugacuuaggagcuucuuucuuuguucuuucuuaucacuuacuauuuuuauuaguuuagcuuuuuccaaacguguuuacucagagauaccuauuuuaguuaggaagaaaaagagaaauaacaccaauuaaagcuaauugaggcugaauucuugucagucuuaaaagaauccuaauuguuucucuuugaacugacuaauccauaaaaguuuucugaagggauggggugugguuguauuugauagcuuccauuuggaugauuucuacuaccuuuuuucuuguuugagaacuauuagaacgaacaugaucauuuuuucaagcuggagugcgguggcacgaucucagcucacugcaaccucugccucccagguucaagcgauucuccugucucagccucccgaguagcuggaacuacaggcaccugccaccacacccagcugauuuuuguaugaacaugaucaauuuuauacacauagaacauaguaaaaugcugauaauuauaaguuguuuguuuacucauuguagcuauuuacugugugaucaacugugaaauuuugugcaacccucucucagaauggaaaaaaaagaggauuuagucugaguuucugagaauaauuuuccaaguauaucuggaaagguaaauugauuuuaaaggauauauaauugauuaauuaaaacaucauuucauaaaacucauuuuaucauccacugugagagcagcuucaaaugcccucagaucuaaguaucaagccaagugguacaaaucauuuucaugcaacugaagauaccauuuauguuggaauagcccccaaaaacgaaaauacacgugaccuguuuaacuuugugcuaacuguuacaauguauguguguuuuguuuauucucucauagguaugagaaagugccagucaucuugguugggaacaaaguggaccuggaaagugagagagaaguaucguccagcgaaggcagagcccuugcugaagaguggggcugccccuuuauggaaacuuccgcuaagaguaaaacaaugguggacgaacucuuugcagaaauugugaggcagaugaacuaugcugcucagccugacaaagaugacccaugcuguucugcauguaacauacaauagcauccaaauauggcuguccuggaugggauuugcccaaugucguaggugauagaaaacucgccuacuccacugcagaacuugcagaaugcgugguguuaaucuacagagaacugcagcccuuauucagaauugagcagugauugucaguugauaucucugaguaacauuuggguucaguaacuacaguuuucaccauuuguccucagucuccuuuaugcaucugcaacuuuaaggcauaguccaucgaucuacagggugaucucauuugaaagcuaugauggcauugucgcugaguugacagaagcaacuauuguacaaauuaaaaauaaccauaagggagaaaccagaagaauuccucugaccacuuacaauuaaaauauuuugucuucuuuaaaaaaauaaguaaaggagaaauauuuuccuacaagaguacugaauuucaggaaaugggauagagcuucuaaccaauguauuccgucaaguaagauaauaacagcugaccugccaacagcauuacagggagauucuuugcucagcuaacacauuucuguuuuucaaaauugaugcuuaauuguagcuguuauucuaauuugugacauggaacuaacucaugcuucaauccuugauagagcaaaacucagaacagguuauguaaaaauauagucuggcuuuagaauuuguuaauucaccugcuuugccacagaaaauggaggcuuucacaaggguuugaucagaauuaaaaccccaaacccgcccucuguuagggguggucuuuauaacuuuacugaacaagagggaagcaacugugaugggaagagauuaccuagccuuacuaacaagaagcauucuaauagauaaacuaguaccaucauguaaggaagaugaagccauguugcauccacauguucccguuugcagaaaccucacaggacaguacgaauaucuggcauuuuuaaguucauuaaagcagcaaauuccuucucgccuuuaagggcuaugguuguagugugacccguggcuaaccugcuuucaaaaucaaguauuugcuguagcagagcuuuauugcaggcauuuuaaaaauugaauaaccaugugaaauaauuugggcuuaaaagugaacauaaauuauagaguggaagguaagggacaaaagccuuuuaccuuuaauuuuccuggagaauuauauaaagguuuucuuagaacaauuuugcccugauuacugaagcgucaaauaaagcuggagugaaaauuuuguuuugaaaaggugcucaagcucugacauuuuugguuuucauagucgugaaguauuuaucauuugcaugacuaauggcacaggaaaaaccuauucauaaguuuuacaaucaaguauagaggggucuucagcuaacuuaguuauacauaaaugcugaaaagauuaucuugagcugggccuugggagaagaauuuggccuucagaacugcaauaucacugagccugcgaucuauacaccaccccacauuuuguugguuucacagucuugugcaaguaaccucuggucuuacguguguaacugagagaagaguguguguuugugugugcauguguguuuauuguuccuaagaauuuggcacaagucagagauaauugccuauacuaagaaucuauacugcagaauauaguguaucaaaaacuuuuuucuuuuaaauuauuaaagugucuuuuauacuuuuaugaaaucauugguagccccccaaguguuuaauaacuggcauuaagcuuagagggugaaaaaaaaaaaaaagauugauaguauuuuucauaaugaaaaaacugaagagauacgugaaugaaaccaggccauagcugucauaaaucuuugacuuuugaauauuuacauucuucaguauaauuuuuuauaauccucaauuaugaaccaccuuguuuauaggacaaaaaaauuuaaccaauuuuauugaaacgaauuucacuguguaaaaguugguuugauucaaacauguagagaaguuguagauucaagauauaugauuucucuauggaaauaaaaauauuuguuagugaauugguugaguuuugauuccucuaacuucucagaaugauucuuuagaauucuauaauucauagcaauuuuugacaaguaagauugcaaaauagaaauaucuauaaagauuccacaguuugacauuauggcuugcuaugcagaugugaaaauagguuaaauaauaugaaagauauggcagaauguaaaguggaaaagaugaccuaaaauuuugaguuguauuaauaguuaaaaacauuugugucagaugacagggugggcuuuuacugucaagacaugaauaagaacugaucuggcugccugaugaguguuuccacgcagcccugcauauuuagugaccaaggcaucaaggacaucccgaaacuggaaauucauauccaucugguaugaauauauaacucagcuggcaaaugaauguguuuguugagauauuacaguaauaaaacacuuaagaacaggaagauuacauuuguuggcauacgaaaccuuaguggcuacagaagaaaguugaccuugugucacuauuuauuuuaugcccugaucagacuagcaacuuagauaagugaaaguuuuucuaacaugccuuaaaaauauuaugguuugauccaaagacccacuuuuucuuuagcucuugugauaagauuuucuuuuuuuuacuuuuauacaaaggcagcaucuuugaauuuuuuuuucuuuugauguugcaacuuuuggguucuuuuaaacugugauagugaugguaacugaugccuuucauuuuguucaacuuauacaaaacaagccagcaucugaucaaaaguauuacauaaaauauuuucuuaaacuauugaaaggugcuuugaugauuuucuccuuugguuuguagaauuaggacugaacuuuugacucaaauugcuacaguugccaucaccuuucugugguaauacuacugauauuugcuuuucuauauaaagaaauguugccuaaggcugucugguauuucuuuucaaggguuuuccaguaugaauguuaauguugucaguguauguaugaauaugaaagugcuuuguuuuguuuguugcuguuuuuuguuuauguguguguuuuuaauuuuuuuguucuuaucagcagucuuguguuagcacuggguaagcuuuaauugucccuuagccaaucaaacauuaaggacuauggaggucuuuuuuuuuuuauuuaacaugucauuguucaucuauuaaaucuugaucaggguuucaagaaugacugcaguggguuuuggaaacagacuuaucauuauugauuugagguuucccagagauauaguucacaguuaauuguugcgcucuaauacaacugaccauuuaaaauugaacaaguuuauuguuuuguaacaaugucaguuguuaaaccuugacauuucaauuaaaacaugaauuguaguuauaacucaaugcaaauucaacaguuguauuuggaguuaaauuauuuuaacaaauaaauuuauuuaaugaa

SEQ ID NO: 21300 - RNA, 5393 nt, Homo sapiens
auauauuugccaguuauuuuauuuuuucuaaaaacaauagaaaaaaaucaacuuuaaaaagcaaaauguacuuaaauaaaaaaaauuaggguuuauaguaccuauaauacuagguacuauauacuaggauugaaauucuguguaacugcuauaaacguuuuauuaaaguuauuuacauuuaauggcaauauuuacagagaaacauuguguaaaucuuaaaauuuuuuaaaaacaauucuuaaauacaaaucuguuaaagaaaaaaaaaagaugguaagcauaaaaaaguucuuuuaugcccaaaguccaauuugaggcaguuuacauuauggcuaaaucuuucagucucaagacucagccaagguugugagguugcauuugaucaugcauuugaaacaaguucauaggugauugcucaggacauuucuguuagaaggaaucguuuuccuuacuuuuccuuacgcacaagaguuccguagcuguucaaguuuguguuucaacuguucucgucguuuccgcaacaaguccucuucagaaaugagcuuuugcuccucugcuuggacggacaggauguaugcuguggcuuuuuuaaggauaacuaccuugggggccuuuucauuguuuuccaacuccgggaucuggucacgcagggcaaaaaagcuccguuuuagcucguuccuccucuggcgcuccaagacguuguguguucgccucuugacauucuccucgguguccgaggaccuggggcuggugcauuuucgguuguugcugaucugucucaggacucugacacuguccaacuugacccucuuggcagcaggauaguccuuccgaguggagggaggcgcugcguaguugugcugauguguggagacguggcaccucuugaggaccagugggcugugaggagguuugcuguggccuccagcagaaggugauccagacucugaccuuuugccaggagccugccucuuuuccacagaaacaacaucgauuucuuccucaucuucuuguuccuccucuuuaagaaaggaaauagaaaucacuccuuuagcaagguuacauuaaaauaaucaauuaccagauuaaugcuguacaaauacaaggcaugaauacguuagaaaggucucuggacaaaauuaucuccccaaagagccacaucuaagccuggugcccuggcucacaccuguaaucccagcacuuugggaggccgaggugggcggaucgugaggucaggagagaccauccuggccaacacgaugaaaccccaucucuacuaaaauuacaaaaauuagccuggcaugguggugugcaccuguagucccagcuacuugggaggcugaggcaggagaaucucuugaaccaggggguuggagguugauugcgccacugcacuccagccuagugacagagugagacuccgucuuaaaaaaggaaaaaaaaaaaaaaagaaccaaucuagccagccacccuuacuccucucaccaugaagguaagagucucauaaagggaaagacagcuggguuauggcauggacaagaaaagugcaacuucccaggauaggacauugaugccaauucuuaccuaagacuuaaugaggcuuuggacacacccaaagcaaagcacauucccaagcaccuccuauuuuugagggacuuuaccaagaacacuucagguguugcaaaugauagcugcaaauugcuugguaugacuuuagcaacucccuauuuuacuggaaaugaaaaauaaaaaaaaaaaaauugcaguuuugccaaaaguccaagagggcgggggaaggaauaaaagaaaaaaaaaaguccaacuuuggcaaggauuugcuuuucaguguucaaaauaggcugagaagaucccagcuccucagcccacccacucuugaggcaguucacuggcucccgcacucaggcaggcccugccuagccucuaaacacagccccucauuuuuguagauaguucauuaaaucccaccacuucucggaaguuaagagggaagcaauucauucacucucagagaucaauccucucuuauccucauucauacacucccugccaccccgccccagggcaauuaaaauguuaacgggagguaagaagaaguggauugaguuguaagauaagccagaagguuuaaaaaccuaaaugaaauuccugaggggugggagacaaacggggaggggggcugcaaacaugggcagucuaaggggaagggaugggaggaaacgcuaaagcccaagguuucagaggugaugagcucccaaaucucuccagaucugcuaucucuccuuccuaauaagaguggcccguuaaauaagcugccaaugaaaaugggaaagguauccagccgcccacuuuugacaggccugggcgggcuucgcuuaccagagucgcugcugguggugggcggugucuccucauggagcaccaggggcucggggcugcccugcggggaggacuccgucgaggagagcagagaauccgaggacggagagaaggcgcuggagucuugcgaggcgcaggacuugggcgagcugcugucguugagaggguaggggaagaccaccgaggggucgaugcacucugaggcggcggcgcucagauccugcagguacaagcuggagguggagcagacgcuguggccgcgggcgggguucgggcugccgcugucuuugcgcgcagccugguaggaggccagcuucucugagacgagcuuggcggcggccgagaagccgcuccacauacaguccuggaugaugauguuuuugaugaaggucucgucguccgggucgcagaugaaacucugguucaccaugucuccucccagcagcucggucaccaucuccagcuggucggccguggagaagcucccgccaccgccgucguugucuccccgaagggagaagggugugaccgcaacguaggagggcgagcagagcccggagcggcggcuaggggacaggggcggggugggcagcagcucgaauuucuuccagauauccucgcugggcgccgggggcugcagcucgcucugcugcugcugcugguagaaguucuccuccucgucgcaguagaaauacggcugcaccgagucguagucgaggucauaguuccuguuggugaagcuaacguugaggggcaucgucgcgggaggcugcuggagcggggcacacaaagcgggaggcagucuugaguuaaaggggucuuggugcggaaaccuggcgcagcgcgcagugcgcgccacagucccgaaccucuccccuugcagagcuauccccuaaagcggcuggguggucuuggugggggaauaaagggagcacccuuucacccccuuuggacaguccccugcuaucucggagacgcacuuagugaaccagcggcuuggugcccgccgagcccccgcucccccgggagcccggagcgcaaagcccgggagucggccccgcagcggcagaggaaucgaaaucggcccuggcgcccuuaagaagccgcgggagguggcggugaggaaaacaauuugccaaaauccaaggcacaaaguuuugcgccaccugaaggagaaggcgagaggcgccugggcgcuagcggcugcgugaaccccgcuccgcgccggggccccuccgcugcggcuguucccacucgcgcccuagccgcucuccuacccccgccggcaccgcagccccucccaaccuucccucuccaccgcccccguccccacccccaguaccgcccccguccaacacuccuuuugccagcuuuucuucuuucucucgccggcuggaguggcgagcucagccgcgggcuuuaacaccccuccauaaauacaaggggggugucaaauaauaauaggggcaccucccuucgcacucaauacggagaugcaacugcgccagagaccccgcugcgauaccucccccggagccaccccaccaaggguagcagcuguucuggaaccgcccagagccccgcuccucgcaguuccuccgcaucucgggcgcgaggacacccgagggcggccgcggcaggggagucagggcugggugcggagauucgcccugguuuuuccaagucaacgauuccaggagaaucggacacauccucgccucccuuuuccccugccugcgccuacccaacaccacguccuaacaccucuagagacccagguuuuaaauuguauuauugcuuuuuaaaaagccaaaugccaacuucuuaaaaggaucagggcggguuggaaucgccgcggggacaggcgggcgggacgcgccgcaguguccgucuccggcugucagaaaugcggugagccgaaauuuaaaugcccucccggagacggggacaagucagcggcugcggagcgaucuggcucacacaggcgauaugcggucccuacuccaaggagcucaggaugcaaggggcuuucugcccaccgcaaagcaacccccagccccccaaaacccagagagcaauuaacacaauaaagcaggaauguccgaccggccgggagucagcgugaauauauucauaaggcagaaaucucgaaaggguagucuuaaaaaccauucccguuuucccucugccuucuccucucccaucuugacaagucacuuuaccccgauccaguucuggauuaccccccaccccagccccaguuaccauaacuacucugagaaaagugucaauagcgcaggaaugggagaaaagacacccuauuuaggcauucgacucaucucagcauuaaagugauaaaaaaauaaauuaaaaggcaaguggacuucggugcuuaccugguuuuccacuacccgaaaaaaauccagcgucuaagcagcugcaaggagagccuuucagagaagcggguccuggcagcggcggggaaguguccccaaaugggcagaauagccuccccgcgucgggagagucgcguccuugcucggguguuguaaguuccagugcaaagugcccgcccgcugcuaugggcaaaguuucguggaugcggcaaggguugcggaccgcuggcugggggaucagcgggagggcugggccagaggcgaagcccccuauucgcuccggaucucccuucccaggacgcccgcagcgcagcucugcucgcccggcucuuccacccuagccggccgcccgcucgcucccucugccucucgcuggaauuacuacagcgaguuagauaaagccccgaaaaccggcuuuuauacucagcgcgaucccucccuccguucuuuuucccgccaagccucugagaagcccugcccuucucgaggcaggaggggagccagggacggccggggcccggcgguggcggccgcgagcagcacagcucggggguccucagccguccagacccucgcauuauaaagggccggugggcggag

SEQ ID NO: 21301 - RNA, 17928 nt, Homo sapiens
gaggaggcggggcaggugggcuaugguugcuuggagagugcauccggcccgguacuugugaucggaggagagccggaucguccuuccuugaacccucuggguagggcugugcugaggggcugggcggggagcacaggccguguccgcucgcuugcaccuuuucagacugccgugucaggccucgagccgggcccaccuggagcccuccccugcccacccgcccccagcgcccgauauccgcccccggcccagaagggccgggcucggucauccccagucccgucgcggccacugacccuugagaucagcccuccccuccccaccuucccgucccaggccagcccagggcccgaagcccacccacucgcgucucuagcagccgcucuuguccucuggguacggcucgcgggaguguugguuaccauggugaagcuggcagccaaaugcauccuggcaggugagucugaaaacuugcgcuugaauacgguggucucuggaguccagagccuucauaauucauccagagcuuuuguucaccuaaauugccuaccuuuuccuuucucucucccaaaggcgaguuacugcaauuacugauacaguaaauuacguuaggcguggaagaaugaucuuccagggcacuucgcagcuccaguggauuucccccugcucccugucacauacucugagaccaccuucaccaguugaggugacucguuaaaaaaucacuaguuacaacucuggagaagcagacuuguuaaaacaaaacaaaacaaacaaagcuuaagcaaaccuugagugcuucagcuaaacauauacuguaccccaaaguuaggcaucagugacuuugguagucuuuacuaugggauuuuucccccgaccucacccccucugauaacggugaccugaguguagugaccagaguuugcaaaaggcacuuguguguugucuuuaagacccaaaguuacugugcugccccacuccaagaagggcauaaauguugagucucccaaaggcaggaaucuuuguuuuguugacugauacaucccaagcacccagaacaaugccuggaacauaguagguacucaauaaauacuuuuagaauggaugaauaugugaauauguggcaugcacauuuguaguguaccccuuguaucagucugcacauuuagaaaaacaauauuuuggauuauagacugcgaaacacauaugcauguuacugagugcuuacugcaugugaagcacacauauuucauguaaucgucucaccauagcacacugggcuagguacuggauuguuuuucuuuuuuuuuuuuuuuuuugagacggagucucacgcuguugcccaggcuggagggcaguggcgcaaucucggcucacugcaaccuccaccucccugguucaagcaauuccccugccucagccucccaaguagcugggauuacaggcgcaagccaccaugcccggcuaauuuuuuuuuguauuuuuaauagagcugggguuucaccauguuggccagacuggucucgaacuccugacuucaggugauccacccaccucggccucccaaagugcugggauuacaggcaugagccacugcgcccggccagguacuggauuguucugaucuuacugaggcacugagagaugucagccaaggucaaccccuagugaaggcccuaugcaggauuucagccccuagaucuggccaacuccaaaacucuuaacucguguuucuguugaaaccugugaccuuuccaggcuucccuggccagcucaggaaagaaguggugagaaauuauauagagaaaaagagauuccuguuuuaaaaaauuccccucuuccagacugagaauaaaugauaauauuuuuaauggcuuuuauaauuugaaaauaaaagggucacacagaaagaugacugacaguaguaacugaaucauacuggagcaaaauaaauuaaugguucucaggagaaucuccaguuuccagagcaccagaggaggcaguguuguguaacaaaaguaauuuugccuguuccucuuauuggcugugucaucuuggacgaagcacuuuuugagcuuuaauuuccuuauggauaaggugggaacauuauuuucugaaguuacuuuuuuuuuuaaaugggcuucucucuggguucuuuuuaaauucgguuuucaucauggagcuaacuuacuggcgcuuugggugcaucagcucugcuagacccucaauacagguggucucauugaauccucauagcaacccugugggauuggcauuauugccauccucauuuacagaugaggcaacugaggcccagaaaaaugagaacauuugccaugggucacagagcuggaaguggcagagcuguaugauccagacccugggucccaaucugauuuccagggcuuuagcccaagcuacucuguccucaaguagugcuccucuguguccuucuauuuuuuuuuuuuuuuuuuuugagacggaguuucacucucauugccuaagcuggagugcaauggcacaaucucagcucacugcaaccuccaccuccuggguucaagcgauucuucugccucagccucccaaguagcugggauuacaggcgcccaccaccauacccagcuaauuuuuuguauuuuuuaguggagacuggguuucaccauguuagccaggcuggucuugaacuccugacgucaggugaucugcccgccucggccucccaaagugcugggauuacaggcgugagucacugugcccggaccuuuuuuuuugaggcguaauuucacucugucucccaggcuggagugcaguggugcacaaccuuagcucacugcaacuuccaccuccuggguuuaaaugauucccugccucagccucccgagcagccggggauacaggcacacaccaccaugcccaguuaauuuuuguauuuuuaguagagaugggguuucaccaguuggucaggcuggucuugaacuccagaccucaagugauccaccugccucagccucccaaagugcugggauuacaggcgugagccacccacuaugcccggccucuuugugcccuucuuuacccccaacucccuuggguaguucuuucaccugagugcagccacugccuaguuaguggcuccugaacuccagccugcgccucaaucugcagccucuuuucagggauuccacagcauuuccucuuggaaguuuccagggaccaaaagaccucagcccagaaaucagcccccucugacaccuguccacccacccccaccacacacaugccauugguuuuauuuuuccauccaugacccacagcccuacuguuuaaacugaguuacucuguuuuuucucucacauaacuggucauugaaggaccugacguucaguucaaguguuuaugcauugaacagauacucgcugagcaccuacuacgucagagucaccgugcaaggugcagugggccugcaagcaugagucaguugcacucaaggaagaacuaagaugcgugugauacguucuaacacagcgaacacaaagugaaugcccuuugugugccagaugcggggaaaugccuccaggcacagcugcuacuuguucugguucuggagaagaaagaaaacaacauuugacauugaucuguauuuuguuuacuuuuaaaaaaacacuuaaauaguacuuauauaugccaggcacugugcauauuaacucauuaaauccucauaacaauucugugggguaggugcuaugauuaucuuagguuauacauguugcagcugaggcacagagagguuaaguaacugauuuaaacucacacagcuagaaagugauggagcuggagucuggcuccagagucugugcccuuaaguaccauaauaugcugccucuugauauacauggagaugguaauagagccuccugggaggguugcucugacaucacaucgugcgcuaccacugagcaacgauccacguuagccacacagauaaagaugaaggagggagagauggccuucagaggcugugcaggaaggguauucuuugagcuuuccuugcagagaauggacaggauuugaauuuggucuagggguaccuggaaggagguggccuugaggaauuuccagggacugggcgaacaggaaugcagagcccagauuugggguaagggauuacuagggagagagugggaagguggguuagggcugaccguggagauggguaggcuaugaaggaauccucagugggguuugugugaagguuugccaagauggaggcacugugucauggggguccaccuguugaugccacccacuggguggauaacagccgggagaaaaaagaagagaaaagaaguguucaaggcacagucgggaagacagaaaacgcagucgucauuucagcagagaaauuuuaauguauggaauugcuucaucaaguguuggagaacugaggaagcaagaaggcagcauugaguugacacagauuggcgggcagaggucgggguugucagaagcuugaagagacccagggagcugggauccggaccccugaggaaggggcccugcccggcuggucccggcaccucaggaguucagucaccugccgcgugaccccagcacaugccacagagcaccaggacccauuucccacugggaggagcccagcccuguguucagggcaagacacaccaaaccaguuccaaaccauccuggaggguccauguuuuaagaccacuccugguaccaaggacuacauaagucaggggccaggcaaaaaccagcaacucuacucggcauuucaacagugaggauuucaguaggaugugaaugacacuggugcuagaggacuggaagaggaaaagggggaaacugaggcagcacggguaguaacugcaggaaggagcaccaccucuugggcuggggaagcagagggaagcauguggggcucucagcccagaagcagggaggaggggcccugggagccaagguguggaucucugagaagagggcacugcccgcuggcgcuguuuccucugggggcaacaauaagcuggucugggaguagggaaacacacacacacacacacaccccaagacaggaagcaguuagugcugcuggggugcaggccauugcuaggguaguacuaagaaaaaggagaagcaggcgggaagagcaguguccucucccccgacuccagccuucccuucuucuuccagaacucccauuggcagagccuaacaggaagcuccuagcaagggagaaaugugucugcagaggccccuccccugcacacuguggaaggaugggcuuggggcugagauagaaacccagcagugaggcugagcuaacuggggcagggucagcagggagggccgagcagaggugggcugagacucagccaaggaugugaggaaugcaagggaggcugccugaagaugggaggaaggaggaggagcagucagaggugacccguugaaucuggggacgaugaaaacacacgguggcgucacaaacagaaagcuugggugaugggggcagcccacucaggaccagggcaugacggagcuuggcuguagacagacugagguuggaggaagguccuucauucuaguggcaacgcacacggguuuuuggauauacagacaaagcuugggagggagauccugccuucugucaaggugaugagagucagugggacggaguggacuaggagcagagcgccgccgaugacaggcccaugggaaugcccacacucggggggcagaggggcaggcagauagcaggagaaccaggccagggcagggucacugaggccacggggacaggacucgggaaggaaggggucacuucaggcugacucacauccuucagagaagucaaggaggaugagaaccaagaaaaggccaucggccuuggcaacugugaggucacaggugaucucgcaucgugcccuugcagacgucauccucucuguccugcagcgcccugccugcugucgcccccaggcccagcccuugccccuagggaagccucccuccccagugaauccucucauucauuucuuuucucgaugcuucccagacgccuugcuucucaguuugugcuauuugaauuugcacuugucauccuguugcucugcaaauguguuuaucaguuauuucaccucccugugcuucugagcccucauagccaacacaggcgguuuccuguaaguguuggugacucugacugacagucagaggaaagauuuaugaaauuaaccagaacaaaucugugaggaaucucauaagcaggaggagccaacuuccagcugaauucaggagcagagcugaaguugggagggcgggugcagucagggcccaaggaaggaaagcgaugcgcucuguuugcuccgagauggguggguaccccuugacagucuaggcugugguugccccagaugucauggaaggcggugaggagggcuuggagggacagcauuaaaaaugggucagaacucacuucuguaaucccagcacuuuggcaggcagaggcaggcagaucaccugaggucaagaguuugugaucaggcuggccaaccuggugaaaccccgucucuacuaaaaauacaaacauuagcuggucaugguggcgugcaccuguagucccagcuacucgggaggcuaaggcaggagaaucacuugaacccgggaggcggagguugcagcgagccuagaucgcaccacuguacuucagccugcgugacagagacuccaucucaaaacaagaaaagugucagaaguggucccugagcucuaggagaggagcagggccugggaagagcgugagguuggaauccugggcgaguuacccagccucucugagccucagucucuucaucugucagguaaggugaaugauaccuuggcggggaaggaaugaaugggauugugugaacagguccaugaggggggcucagcacauauugguucccuucuaaggagugaugacaaauagaaaagcaggaccugaauagcucacucaaaccuggaggaguucacauaaaaugaaaugccacaagcauugaaauaauugucuuacaagggaaaauuauaggugggaaaagucaaaacugaaaagugaacaguggcagacuguugagaagucgaggaaaggaguguugaagccgacuguaaaaugggaagcaaaggugaagagaugguaccaagugaugugaguuggaagccgcggagggcggugcugauuuugcuaaggauccagaggaugagaagcagaaagcacguguucugccaggaccuggacgguggagugcaaguccacguaagacucaggaggaaaagaggcugcaaauggaaacaaucagcaucaaaggaggcucagcagagccaugagagggaaaauggggagggcaaagggaauuaaagaugggcagggagagcuuccagcacccgugacgggcacgggaggagcgcucgauuaaauggcucccagcagucuugugaaaggcucaggucucagacugaaaacugcgacauaaaccuuuaguucugagggaccaguuucuggggcuguugaccagcagaggagagggagauaaagccaguaggugagagaugagcuuggaggaggugacugcuauugcagauagaauugguggagaggccccugggaagaagaauccuugggucacagacagguauucugcgauggagauggagcauagcauuuggaaagagauuucagaaugaugaacacagccucagacuucuugcuucccacaaaugcagagacccuuccaccccccacgccccacacaaaaaaguauucagguggaagcugucaacccagguugggucaguuggacaggugacucugccugucagugccagucacacuucuuuaccuucaagacuucaaaguaaauuccaguuuggaagugacagcuuuuccccauagggcguguuucaguggaagagcgucaguuccguuuccagggccccaaagcccucuguaaguucuguuaccuucugggucaguuccuguggauaaaaggcuuagccgugcagaagugugcucuggcuguugugagguuugcagaucagucucauggaccugugcccugcccgcggccucagaacaaguucccgugagaggcaaguacaucucucaaaacucauugaaguuuuugguuucuagacuaauguucugcagcgggagauucucaagucagaugagaacuaaggcguucuuuuucuucuuuucugaucucacaggagacccagcagugggcaagaccgcccuggcacagaucuuccgcagugauggagcccauuuccagaaaagcuacacccuggugagcuggggugucaagaccuggccacagcuuauagagaagugcucgguucaccaugaugagugacuucgaaguuccuugagggaagccuuaagacagcugaugaaaggcugcucagagggccacguggagaucguuuuuuccacuagcccagggugagagguuggcuacagagcagaauggccacaagcaacuuggccaccacguguagcagcucacaucagggcagggagguggagaggacuaguugguccccucugacuucugcaugcugagcugcuucucacaagaaugaguccagaacaaacccuuccacuggagauagcccuccugggaucggggugcuuguguguccuccuguaacaugcucucccuuugggggcccucagugcuaacauucuugguguuccucggcagacaacaggaauggauuugguggugaagacagugccaguuccugacacgggagacaguguggugagugaugccuuuacccaggggaacucagggcucccccagcugggcccagggucucuguggucacaccauccucccuaggagagaugcagugcaaggcuguggucuagacuuggcugagcauuucggaauagaaucgggaagcauucaagggagggacugaggagguggaggaggaaggaaggaaggaggacuaggagaugggccuggcccuugaggaacuuguucucuacuaucaagguucuugagucucuuuaugggaaccuggggcucuugaaagugaauugcaagacguuauguuugugugugcuuuucuagagagaggguuuguagcuuucaccagauuccuaaagaggucugcgagaaaaaaaaaaaaaguauaaguacuucugaugaagagaaaggugaguucccagguaaccaauaugcaaaacagacaauggugcugauguuuagacgguguaugccagggaucagaggccagccaggaaauacccagugccaggagggagcuugugggggagccgaggggugauuuccuaggggaccagcccuggggguucucacaugggcuggggaagguuuggacagggcaggaagggucaucccgcacccucugucugccucacaccuuagccaucccagaagggugacagaauguccuacuuuaaacaccuuccccaggccuacucagugaccuccuuuagaaagaauuguucuaagauuugaaaaucaauuugguuaacaaagugcagaaugaccuuuuggaaaccagagcacucaccggccuguuuagcauucuguucugccaggugggaagucagcuuguuccugguauuuuugcacucaggguuacaagaggugagacuccacacagaaagugcugguuggugcgagaacccgucguacugccucucuaagacucuggaguucgcuccuuuccccuucaucuucucucgugccugggagaaaagacagagcaugugugaagaugugggugccuguauuucaccccuaagacaaguccagugugaguugagagugauaccagugacucguagcuugugguuuuuccacguggagacuuuucuugcuuuucugauuguaggaacucuucauuuuugacucugcuggcaaggagcuguuuucggaaaugcuggauaaauuggcaaguagcacguggucuuuuuccugacugucaccaccuccugccaaaacguuuaccccugacagugcucacacagcaguuucccugcacugugcuguugggaagcucccauggcauuacucuuuaaggggcauuccucccagcccaggacucauggauacuuggcaagaaggaguggcugaugcgugugacugcccgggccccagcucuggggugcccaggauccaaugggccaagagcccugcggcucgguccuugcagcccucccccugugaggccucccuucuuuagagcaacacuguccuuucagaugguguccccuaccucccaagacaguacagacugccuccucccccucugggaagugcuguagaggccucagccuauaacgaggcucacuuucugccguuccacugggguuugcucuggaacaugccccugcugcugcccaggccucaccaugccccauccacccccgucccaccagccucgcaggauccacuugcuguaccuuccacgguaacagucucacuaaucugggccagugagcuaauuagaagguuugaguucuccagagcccuccccugccuuuccaagaacagccacauuuuaaugggaacaguuuucugccccuuuuuuuuuguugccuaagagaaguagaucuaaugauagugauuucauacaggguuggcuucaugcaucgguucacgacguucaccccaauugccuaccgugugcauggccuggcacuggggcugccaugcccagcagaagggaagauguauuagggcaaauccaggccaugugccacccgucagcucacacccuccccuccagccggcccugacuccugguucacccgcucuggcuuuagcuugaugccaggccucuccaggacccccucacugaagccuggaagaaggaggauuucuugaguuaaaaccacgcugaagugucuccugcgugcauguaacagagcucaauguguucuagcaggaguucaagaguuaaucuguggagugaaggguucaucaguuuaguccacgguccucccaucccugacacugccagaagccagcacagccuuguagggugaggaggagcccuccagaguggaaucugggcccgccuuccaaggaucugaaagggaauccaaucuggagggaaaaggauucucuucuguacccugggagguuacuggcaccccggaaauaaaccagguccuaauugugcgagguugggggauccagaaaccagagcauggccaagagucacgagcaccagggugcgcacccacagccuguacagggccauucuacauccaggggcaggcagcaggacaucccaggacucugagcagccccugaaggcgacagccccugagaguguagccuuggcucuuaauugggucauggagcccuguccaguugucagugugguuuggauuaggcugaugcagagauggcaagagaagcagaaagugcccucugcauuuuaacaagccagcccuuauuaagaagaugcaagcaaacaagcuucccaggcuggcuaaugaagaaagaaucuucuuucagggcugcaaagcacaaaaauguaacuugcaugguggugggcucuugauaagaaugaguggagaaugaaugaaugaggccagcugcaggugaaagcagauuguuggguagagaagaacucagucgucccccaucucugucaucguugucuuuguuuuuaaagccugucaggccuggacaagucacuuacccucccugaauuugguuucuucagcuacaaaguggaaauauucagacacucuaccgaguugggagguuucacagugaggcacggaagugcccagcagagccuggcccagacaugagcucuuguccuuggcggcaccgccccagcccugccuccugccacugaacguggcccuccguucauuccuuuggggaaauuguuggacaucuggggguguggcuguuuucguuucuuguuucccucugcuccccauacccuuucccuuggaaggccaaauugucucccagccuugaagucacuuuuccuguuacugacccauacucauccugucccucuugcacagugggagagucccaaugucuuaugucucgucuaugaugugaccaaugaagaauccuucaacaacugcagcaaguggcuggagaaggcucggucacaggcuccaggcaucucucucccagguacgggcugcagacacccauguuucccagcggcaucucuguccuuugguucaagagcacaagggcauugcagagguagcuguggguggagaaggggcccugggcuuggacuuugauggccuaaggcguacacuggcccugccacuuagcagccaugccaaccucggugagucaccacacacaccucucccagucuaggaaacgggaaugaagacacgcaccuggcagggcuguggggagacucaauaacgggagggugcuguaauaucaguuguuaauuccagaaagcuaaccccagggaagaguuccuaauuuucucuuguauaugggguacaaguaaacauucaagccuguugucacuucugaaugcuuuaaaucaguuuauuuuucgucccuaugugagaucaacaaauucuccucauuauagaccggggaaagugaucuccagagacaggcucaaaaauuagcugcagcugaugcagcugggagcugaacuaaauuaccucugaaucccugacuccgagccgaguccuuagauuacuauuaaugaccaguuuacaguuugcuccgugugcucagaauuauuacaaaggcucacauaaauuuggcccucgccuucaggcguuugcagcccuuuaaggaggcaagggagacagauacacgugaggucuagaaaaagaccuagcagaaguugugcaugaaaagcgaagcccaccugucucucuguggcccuuggggccaucacgagagacccccggcuuucccugugggggggcucaccaccucgagucaggcagcucucagaggaugcuuuacaccccucaaaaauagugcucucaucucgcccgcuguccuuccagagugugacagugaagugccauauuuugguuguuucuucugaguagguguuuuaguugggaacaagacagaccuggccggcagacgagcaguggacucagcugaggcccgggcaugggcgcugggccagggccuggaauguuuugaaacauccguggugaguauuuccacuugccucgucgccaagucuggagugggccucugcuggcagcggucuugcacaugaccucacgugcagggagcuguuauuccaccauaugcagagucucauuuggaacugauguuuacauucuuacccgagaucucuucucaguauagcaguagcugcucagacauaacaggaaagcagaucagccagccaacccugggaaaagguguaucucaacuaguaagaaauacaagugcuuugugugcggugaucaugacccucgacguuugcaugcaauauucuggguucagauguuguuggaacauuguuucauguggcucucacaaccaguccugugaaccagaaguuggccccacagcucccauuccaguguugaggagcucaagugacuuguccaaggucccaugauuagcgaaggguggagccaggauuaggacucauggccucuaauucccaucgguaccacccauccucaccuugcugcagccccagggugacuccaggccacaaagugccugccaguuaaaagagcagaagaccucauuacaaaaagcaagugauuuucagcgucuucaguacacuuuuccuggcaaaaacugcaauuacuuuugcaccaaccuaauguaucaugauuuuagcuguccagcacugaggaaccugcuuccuguguuugggaguuuuaaagucccauccuccuugaggccaagaugcagccaugugacccaggcugcaccaaucagaccccucacaugagacuccacuaggaagggcaugaagugaugaucugcccucuaggaacagguguggcccugaacauccaucucagagccagcaggggcccgaguguugguugcccugccccucgccaggguugcuagcuggggagaucaccaggccuggcacagucauggucguaacuuggaccucaccuuguggccuuuagaccugauucuguggcccucagaauugagucaugggcugguuaauguucuggaggucaucuucugcuccagcuugacuuuggcucuaggcacuucugcuauugcaucuaggaaccuugaccagugcugccguccgagcuuauaaaacucccccaaagcagcaugcuuccuuagggaaaguacagcaguaaaggcaggcacucugaccucccauggugaguggcagaacucgccgugggaaccuggacauguuauuucaccuguugguggcucaggcuuguaaagugaggaucauaaaauacaucccuuaucgaguaauaaauaugagaaucaaguaauaugucgcauauaaaacauggaucacagagucuggcgccugguaaacacucaguagauguuagcuuucuuaaaguauaaauauuaccccuagaaucuuguuuauacuguuauuacuuacuaaauccuuguauucauggcuugugcagagauaaauaucacccuugccucugguccaauuaucacaaaugcuaaauuaaugaagcccaaaucagcuuuuccuguauagaggguuugccaucuuuucugcagcacaccuuugugcaaagcaguaggcgguagugcccuagcaaacaggauuucaguauucucccuuccuccauucauuugugaaauugucccugcaccccaauauuccauauucccuagaacgcuugauagaacucagaaauuaaaacccaccccaaccuccaaaacaggagucaccaaaggccagugggcuacggguuaaacucuguugagguguugaagugggugggugggugugaacuacucuugaagaggcugcaguaagcacuugcuauuaucugugcaaguuaacuaguccccccugaguugaggcucacagaagcaccgcuggcagcucgguuaagaaagcuguaauuaaaaaggaaauauaagcaaacgcagcuugagacgcagccaagggcuggcgccaagcucaucuccuccucucuucugccuaaacaccgcagugaccauccugccuacccaaaggaggucccuacaaacaagugcaagaacaauccgcgcugaucacugcccucccaggcaagcgaggaguggggaaguaacguuugaugagggccuacugugugcuagguguuuugcacacauuauuuguuuaggcuucauaacagcccuacaagguaacacuccuguguuguauagaugacagacucagaaagguuguguagcuugcccugguugcauaguuaaacgagggcuagaaacaggacuaggagucaggccuguccagcuggaaaacuuggguuuucuagaagggguacccuggccuccugcggagccugcugugggacucugcagaacacaauucaaggccagacugaacacuagccugaaccugcccugagaaucccucuaagccgaccuacuccacagcuguccugacuguguaagcgagaugaugauuagugaucagacgaaaggauuccugucauugguaacccucucaaaguauuuggaaaacaguucaauuuucaucuauuucagaagcacgccguggugucuauugaggcucaccugcauugaauuccuuccuuuuuauguugcgaucucccaagauugcauuguggaguguuuucgaauccauuuugaaauccccgugcgugcgcuaugcaggccucagucuuuuuccauuccauucuuaacucuacuuucgacggaagcaguguuuuaccccgacacuggcuugccuaggaccuugugcucugcacaacuagcagggcccggcaggauguacugaauucuugcucucguguccagcuggacggugauggcuuucaaguccuuggcuguugggagcuuacuauaaauguucgucuuggcuacaaacucuccacucuuuccucggcacucucucagcauugccaccacugucuuuccucuuggccaacuguuuucuuuacuuaggcuuucccuugcuagaaaguccagguaacuuucuccacgggaccugguuuccuucgcacaucccagcuggccucgaggaaagguagcucuucccaaaucagagaaucuggaugcugggcugggcucugcaccaaccagcugggccgcuucacccgcugggccccaaacuacucaucugugaagcgaaggcaccgcgcuugaugccuucugcaacguucuucaguuuggaaauccuucuguuucguuggggauauuucacggccucuucucaagguugcacuuuugccagcugccagggaucgucucaaaacagguucuuagugcauucauagcuugagcugcugucuugaaaguaguacauuccuuuuucugccaacuuuuuucugagaaaguuuuugaaugcacacgugcacccaacagagugagaguggcuguuaagagagagggcgccauuuccuuugcccuccagccugucccugugcacccuggaggggcccguuuuuuccaccgcuuagauaaaaucuagggcaaguuccugaacuucucuuuucucucucagguaacaaaaauucuuuugggcuccuuuagucacaaagauauucacgauuucagguauuaaagugcccagcccugggugauugucaaaauucugaacuugauuuaaaguggcaccuccucucacagucuucgggagggagagaccggagccaggagugcagcguguuugcuggggucugucguggcccacuccacaccugcuggguggauccggcuggugccccaugggcgccucugagaugccccuccccaccccaucaguggcgcugucucaccugcaggcugcuucucacaggugguccccccucacuccuccugcagccccaguuccuggcuguucauucuuauugggacccgucacccuccuggaggcggucccagccgagcccccuuaagacagcaccaggcuggcuccacuuggcccccgcugguucagggaagugcugcugcagccguuuaguuugacaaaggaggcagcgaggccgucucauugguagcccucuccuggcuugcccagccaccaccucaccucgauuccucccaggccuggguccagcaccagccuaggaagagggugccccaugcugucuagcucuucuucgggauggggggcuccagguuccuugguauuuugcuuuggccuuuggagccucagucaaaacugaggaaaggugucauuuucacaucucgucacacguacagugacugcaacuaaaagcacaggcuuuguagaaacagacauggguucaggccccagcuccaccauucacaagguguguggcuuccugcaagguaccuucaucucugaguuaccugacuccaucugaguuuccuucuuguaaaacuggcauccaugaaaguggcuaccucgaagggcgugaagaugaaaugagguggaaaguagguagcccccgaaugagggaagcauugagugagagcuggcccucugacccuucuaaaagaacacagccaacuuuuuaaacugucuuuccagaaagagauggaaaacuucgaagccccuuuccacugccuugccaagcaguuccaccagcuguaccgggagaagguggagguuuuccgggcccuggcaugacgagcuggagcagaucgugcugcacaaccggagaagacagaauuaccucugcucuuuuaauauauaaugauggcuuuaaauaaaauuaggagaaaaugucgaagcagc

SEQ ID NO: 21302 - RNA, 14380 nt, Homo sapiens
ugaccggagcgcggaucgggacagcggccgggacagcggcgagacgcgcgugugugagcgcgccggaccaagcgggcccagaagcgggugaggaacgcgggaccaggaggacggugcgcgggaccccaaggcggcaggguuucugcgucccgggaugcgccuggggugggcgcccgggcccgauccgucggggcucccggagcuccaucgcccggacggcucggggcggggagaagggagcggccgucccggggacgccgaggacggggccgaggccagcucgggggaguggggguggagacggggccccuucccggggcgcgggcggguaggcggcggcgccgggaggaaggggcagcgcaggccggcgaucuccgcguccgcccggcgggggcgggggcgcugugcuccuacgugacucggugggaacaggcccuggcccggcgcccgcgggcggugcgugcgcgguuuguuuacguccgagggcgggcguguguucccuggcgggcggccuggguauccugcccggugcgugcgugcgcuguguaccucgggggcgugugugcguguguugugcuugugugugcguguccgcgcgcgcgcucccuggggccuguacaccagcaguguguaccucggagagggcgugcccugggccggccaccggaguaaacgcggaacaaggacccgagcgaaggaagcggacccgugcgucuucgcacggggucugggaauucuggcccgggccgccccaguccuacuacccggggcuguccguccccggcucuccccggaguuucccagggccuccgccacgugaccccaguguuugucucccgcccagagcccgcgcccgcagccacaggguggggcaagguaucaaagaccccacccagcugagcuaggagugagggaugugagccacccccgcuuggcaccccgguggaucugguaacaaagugaguuggagcccagguucuuguccccagauuuuggggcuuccuggggagggaagaaccaagggacucucguucguccccaggguugcccauccccucagucccaugagaacaggaagggccagaaaaccuugacugcaagggugcggcgcagggagaggaccacaggcuuuuagcuaguccggguucuggaggcuguaccugcuaggucguggaggauggggcggagccgguuuccgcucuccugguaguuucaguucacaagugggacuggugagacuagacugaccuacagcuggacgccggaagcuagcugaggcucugagccagccgacagaccccgagugcccucacccugggccaggcagggucaguaggcauuggggauagaacucugacugcacggaggguuaaugagugagggguggggccugaccuagccgccacccacccacucacccaauagcccugcagaaagcaccuguuugucguagccgccugcaggaugggcugggggcuagagauuccuuggucuuaauccaccuucccccuccacccacccacccacggucuauggaauugugggaggggagcaauugaacuugcuagggugaggaaccaaugaucuuuugacuuuggaucuuugaacccugggugagcucugcuacagcagcccggacccucaguauucccaucuaccacugggaacuagguaacagccaggauggcaggaugguggguagaagggggaagcucuggaagucugugcagacagcguauuuuccaggugaauuguggaagagaaagcagggcugacagccccaugccaggagcuggggguacccaagaguaggugggguuugagucaggaggguuggggccaggagcacaggaaccagacaggcccacccucaaagcugggcaggaaacauuacaaaguagggccuggggucaggggaugaggggaaguggcugguugacucagucccagauggaaaguuagcacugagaaguuuaacuucccauugaaucaccccugggcccugcauugccauugggcccuuguccuggaccagaugccagggaugagaugaacagaccagauccagagacugcccucugggagcuuauagcucagcagcggacacaaacuugaaaaaagauccacagaaguaaaugcaaaacacagcuuagaugggugaugugagggagaagucacugugguuugaaaguacauaacagcgcucugacuuagccagggcaaucaaggaaggcuucccuggggaggugacuagugugcugagucugauagaguggugguugucugugaagcccuugaaggcaggagcugugauucacuucagggucuccagggcccagcacagagccuggaacauaguaggugcuucuuggauguuugcugauugaaugaaugagcccuggaucccugcccucuaagagcuccacaacacauggagaaaaaggccugggaaccccagagaaacaggaagccagggcaggggcugggggaaucuugaagcagucucccaaaagcgagcaaauccuucaggacucaggcaacuuccucccucacacacacaggcaugcacugcccgcuugucccuuugggaaacauucagggauaguagaauuugcugucuguucauucaucuguuagcauacgauccugggagagaguggacaggaauacgguugaggccugaggacccuacuguguuggcuugcggggaggcuggcauugcaggguuuugaaaugggccaagcacggacaggcucguggguuugugucaguagugauuccucugacagcucuugggggaggaucaaugauggggauuggagacggagggcaaggcaagaggcuggugagcaggcgguuguggucaugguccagaugaaggaggaaguggucuguggcugugcagguggagaagagggcuagucugauagucugauaguuugugucucaugcccccaccuccaggaagccuucaccgcuuuccuuucccuaccuccauucugcugguggucuuggagcucugggccagaaucugaaacucuaaacucagagacagucauuguuggaagguaccuuaggcucggaggacguuuggcauagugggaaaacugaggcccagagagagggagugccguaccugaggccacacagcgagugugagaggguaccugaacuggggcuggaaccccaggccguugcuucucuguggugcuugguucuuccagccuugcuccccuuccagcagggaggaggcuccagcagugcugacugccaagagcuaggaaaacacauuuuuucccuguccucacagagcgagcagaauggcucagcagccagaaaggagcccaugccagcgggugggccuucuacaggaugucucuggaguggacugguggggccagggagggggacguuggaggguuguggcugcugacuggacaaggcaguugucagucccucaagagucaccucucuccuuaugccuccagaagacgucaugaaccugcagacccuggaggucagcucugcuggcuuccaagggaagaagccagggagagguggugguggccgacauagaagacagaggaccccuggguuccaguccgccacggcuaccaaacaguggcuugguugccucaggugcugaacaggggaucggaucagcuacuauuucucaggcccagggucagccagccuggcaaaggcagaggacccaggccccuuggcagccccuggccugggguuggcagcggaaagccugagguuaccagaaaguucccccuucuugugacuuucccccugugauugccugacugcugagcuaggacauuccugggcaaacgugggugccucagcugacauccaggaugcgguugagggggcugaggcucggacaggagggcauggaggagugggggaagagcagguucaaaaccuuccuagcaccugaggguauuuacaaucacagccagcuuccgcuauuaucaaggauagggaauggcugaugguuccaucucucaggccuggucuggaggcaguguugaggauucuaggcuguguccaagcucaggagaaaacaguucugugcugagaaagacucaggggcuguggccugccucacugggaauuggugcugugugugguuagugaugucucuguugcuuguggauagugggaugauggugagaugaggugaucuuucuugccuaugccuccuuuuuuuuuuuuuuuuuuuuugauggagucucgcucuguugcccaggcuggaguccaguggcuuguucucagcucacugaaaccuccaccucccggguucaugcaauucuucugccucagccucccaaguagcugggacuauaggugugcgccaccacaccuggcuaauuuuugcauuuuuuuuuuucuuuaguagagacaggauuucaccauguuggccaggccguucuugaacuccuggccucagaugaucugcccaccuuggccucccaaagugcugggauuacaggcgugagccaccacgccuggccuugccuaagccuuuauauuuuacacaccaagauuauugugauuauucccacuuagcaaggaauccaggacucaggaaaaaugacuugugcaugaggccagacugugccucugagguucuguaucagccgcaacacccaaagggcaguugauuaacuugcguggggagaggcuucccuucucccauugggucuuucuguguagcucagguggccaagcaucacugcacgugccagcuccccaaacggcugguaagggggccuggauacuuaacuguaacuugcaaaucguaucccuagcgggcccaacacaaauccuggagaaucagagcugggguggccuuggaaacuggcaaguccagcuucaucuucacagggcuagggaaacagggcccagggaggucgcccugccagggccacacagggaggagguguguggcuccauguggccucaggccugaauucuauuauuauuauuauuauuauuuuugagauggagucuugcucugucacccaggcuggagugcagucgcguaaucucggcucacugcaaccucugccucccagguucuaagcgauucuccugccucagccuccugaguaguugggacuacaggugugugccaccaggcccagcuaauuuuuuguauuuuuaguacagacaggguuucacuguguuagccaugauggucucagucuccugaccucaugauccgcccaccucggccucccaaagugcugggauuacaggcaugagccaccuugcuuggccaucuuuuuuuuuuuuuuuuuuuuuuuuuuuuuuuuuuugagacagagucucgcucugucacccaggcuggagugcaguggcgcgaucucagcucacugcaagcuccaucuccggguucacgccauucuccugccucagccuccccaguagcugggacuacaggcgcccaccaccacacccggcuaauuuuuuuuuuaagaggcggggucuugcuuugucacccagggagugcaguggcgggaucacagcucacugccgccuugaauuccugggcucaaugguuccuccugccucagccuccugaguagcuggggcuauaggugugcaccacugcacccggcuaaucuuuuuauuuuuuggagauggagucuagccaucuugcccagguuggucuugaacucucaggccugaauucuaccccaugcuggcuguaugagccuggacuacucuauuguccucucugggcauuaccucaggguugggcgaaccagggaggugacggugugaagggaccagguuucaguccugggccuuugcagcuauucauucacaccuauugugugacuucaggcaagugcugccccucucugggucucuaccuccccuuggguaaagggaggaggcaggaccugauggccucuaagggccuuuccugcaguucccugugugaccccagccagcugggagaugcuaaaucagagcgagaccccagugcuggcuacaggccugaccccuccuggacagacagcaauucuaaccucccagcugcucacugaccucuacaguguauaccacuugauuccaccaaaacccugcgaggcagguauuguuccgauccuuuagaugggaaaguggagacccagagagauggaguggcucaccccaggucacacagccugagaaaacagagaugcgacuuaaacccaagcuugacucccaauccagugcuccuuucccuguuucccacaccccaccuuugggcccaaagucacguggaugggauccccucugcucucuucccauucgccuagcaucuguacugucucugccaacaggcccaaggaagcagcuggagaggaggaagaauuagagacagggccaggagguacugaacuacguuucggcuuggaacccggcuuggugacaagcugggugauggcgucagagacucugaccauccacccuuccccagugccugcucccugccaggucuugagauggguggccucaagcacccagagcugacucagccucucccugucugguggagagacagcaaggaaauacaacccauuacacacaggggugggggucccuaacaaguccuagggaucagggagggcuuccuggaggaggagaugucugcacccagggccgaaggaugaguaggagucugccaaacaaaguagaggggagugaggggagagaaauaucauggggugggagguggcucagaggcaagaaagcgcgggugggaggaagugaaagaaauucuguguggcuggagcacagaguggagguggcaguggugggaaaugggcguggggcuggacacacagggccuggggugcugggagggugggucuggacuccauccuuaggauaguagggaaccauggaagguuuuuuuuuuguuugcuuguuuguuuuuguguuuguuuuugagauggaguaucacucugucgcccaggcuggagugcagugucgcgaucucggcucacugcaugcuucaccucccggguucacgccauucuccugccucagccuccugauagcugggacuacaggugccugccaccacacccggcuaauuuuuuguauuuuuuaguagagacgggguuucaccauguuagccaggauggucucaaucuccuuaccuugugauccgcccgccucagccuccuaaagugcugggauuauaggcaugagccaccuugcccagccgaaccauggaaggcuuuaaucuggcugguggcauggucagauucgcguggugcaaagauuguccagcugcugugugggaaugagcugagaccagcagggaggugugcugggaccuccccagguguguguaggguggugagggugaccacuuaagaggccugcauuggguugggcgugguggcucacaccuguaaucccggcacuucaggaggccgaggcagguggaucaccugagguuaggaguucgagaccagccugaccaauauggugaaacucugucucuacuaaaaauacaaaaauuagcugggcguggugguaggcgccuguagucccagcuauucaggaggcugaggcagagcuaaucgcuugaacccaggaggcggagguugcagugagcugagauccugucacugcacuccagccugggcgacagagcgagacuccaucucaaaaaaaaaaaaaaaaaaaaaagggaaaaaaaaaaggccugcauugaaagguaggaucggugagguugacauguaaacgucuccagauaguaucugaaaggucaggguagccagcagaucucauaugacuuuuccagguaggaugggagugcacagaggcccccaaggagagcuaggugggcagccagggccugagcccccuaggauuuggagugcuaggcagggaaacugaggccagagcccaggcuaagccggcauguucagcaguggggggucgcagcucaggggucaccccaugaagccacuggucuucaccguggauccgcacaggggucuaaagcugccuggguccugaccuggcacucuggguccacccagcuacccccagcgaaaccugggugaccccuaagacucuccugcuuaagggccacaguggcugccccugucaggggaucucugcaagcgccaacuuccuucugucccacuccuuccuucccugugagcugccagacccccugacugugugggcugggaggagcuggggaguuuccugagaagcccuggacuguccccaccuuggccugagucacacugagaacucagcaaggauuccuugaguaucugcgaggugccaggcgcgguucuaggcaugggggaggccgcggugaaucagguauaaguucugcccucauggagcuggcauucuaaucgggggguugggagggacagacacugaacaaauaaccaccauauaugugagugaugacaauuacacauggggaaaccugagguggggaagggacacagggaguguguguguguguguguguguguguguguguguguguccguguguguaucagggguugcaaauucuaaacugagugaacaugagauuugaagagaccucaggaggugauggagcaaacuuuguggauaucuagggaacaaggaugccaacagaggccaugcgucguggcucaugccuauaaucccaacacuuugggaggcggaggcaggcggaucgcuugagccaaggaguucaagaccagccugggcaacaugaugaaacucugucuguacaaaaaguacaaaaauuggccaggugugguggcaugcaccuauaguuccagcuacuagggaggcugagguaggaggaccacuugagccugggaguuugaggcugcaaugagcugugaucgugucacugcacuccagccuguaacggagugagugagacccuguauaaaaaacaaaaacaaaaacaaaaacgccagcagagggaccagccagugcaaaggcccuggagaggagcgugcauccuguguugaggaagggcggguguggcugaggcaggggaaacaaaaggaagccaaguagggcugagguuggagaagggaugcuggggagcacuuucuuuuuuuuuuuuuuuucagacggagucucacucucgcccaggcuggagugcaguggcacaaucuuggcucacugcaaccuccgccucccggguucaagcgauucuuuugucucagccucccaaguagcugggacuacaggcacgugccaccacgcccggcuaauuuucguauuuuuaguagagacgggguuucaccauguuggccaggcuggucucgaucuccugaccucaugauccacccgccuuggccucccaaagugcugggauuacaggcgugagccaccgcgcccggccacuggggaucacuuucugcagcacuuugugggccauggugacaacucuggcuuuacuccagugagccgugggaagguccugagagaggugugacaugagcugacuuaacacagcuaccugugucacccagggggaaagugaggcacagaaagaguggcugaccuaucagaaccacacaacuagagagcgagaccacccccaaaaggccccaggugugucuggcaccaagguccaugugcuuuccauuucugcaccuugucccugggagacaccccgguccugccagaaugugucagaggcugagccaacccgugaggucaacccuguagacagcucaaggaaccaggacuuggaucuggcuuuugcccucugcuguccacaaaacugggugaugcucuuuccgauacgguacguguuuauaggaugcuacagcucagaucacaaagcaucuuccuuuguuuucuuuuuauuuauuuauuuuuuuugagauggagucucacucugucacccaggcucccaggcuggagugcaguggcgcaaucucggcucacuguaaccuccaccucccagguuuaagcaauucuccugccucagccucucaaauagcugggacuacaggcaugcaccaccacgccugggcuaauuuuuguguuuuugguagagacaggguuuugccauguuggccaggcuggucuugaacuccugaacugaggugaucugcccgucucagccuccuaaagugcugggauuacaggcgugagccaccgcgcccagccuaucuuccuuuauuuuccuuggcuucuuaucacugcccccuccccuuggagacagaugagaaaacucagguucucauggcggagaaccugagaggauuggcaaaguagauccuaucagcuagagacagagaggacugcugcuuuaaaggggacuuugggagaugguccccuucuccagcccagagcaaugaccacugacccuccacgaguuuuauucaccuuuuucuccccauuaccaaguacauguuuggcaaagagcucaauaaauaguuguugaaggagcauguggcugucaggccugugggagggaggauuaggagaugagaggcccucauuggucuagggauggcugccccaucugccuagggcaugcugaguuaguauggggcagcccccaggagguugggaaaacuuucccaaaacagaggucuagaugaaggaggccuggggagagaggggacuggcugauguuguaucuuacggggugcuggaugggcuuuguguaaaggcauuuacuggugcacauaugcuguguguacuuuucuguauguagguuauacuuuaagaaaaguucugaaaaauuggcugggcacaguggcucacaccuguccagcacuuugggaggcugaggcggguggaucaccugaggucaguaguucaaaaccagccuggccaacauggcgaaacccugucucuaaaaauaaaaauaaacuaaaaauacaaaaaauuagcugggcguggugacaggcaccuguaaucccagcuacuugggaggcugaggcaggagaaucccuugaacacgggaggcggagguugcagugagccaagaucgcgccccugcacuccagccugggugacagagugagacucugucucaaaaaaaaaaaaaaaaaaaaaaaaagaaagaaagaaaaagagaaagaaaaguucugaaaaaucaaaucaaaggcacauguccaagccccauguggaagaauggucaggagaggcacaucuauucauuuggugcacacuuacugagccaucuacuauauaccaggcacugauuuaggcauauugaugccguggugagacagggaaggccucugccuucauuggcuuccguuuugguggaggaggagugggaaggagaaacaaaucauagaugaggaaccaagcaugagaaaugcagaagaggugacuguuacaaggguuaauaggcgggguuaugugaugugacacagaggcguuuagccagaauggucaaagaggaccuccugaggaggugacauugggcaaagaccuaaaugaugaggagucaccauggggcuagaacaguaaagagcacagccugugcacagcucccgcggcuggaaggagccauucaaggaggccuguggaccaauguggagagaggaagguggcagguaugaaucaguucuaagauagcagaggccuugaauggcaagguagugaguuuggauuuuauucuaaaugggaaaccaaaaacaaaacagugacuuugaccuccuuucuacccuaggucugcagcccagagggcaccuucugcaaacaugucuguggauccccuauccagcaaagcucuaaaggugaggaggcagccucugucaacccagugaagcccucccucccugcccaugcagagccuccucaucccaacuuccccuucuuuccuggaauccccuggguggcucagcaggcaccaggccuucaugaugccaaagggaagggccacagccaugggcugggaccaggaggccugggcucuggucacaggcugcaugucccugggguaggucacuucccucuccaggccuccuuccccaucgggucaauguccccuggggcauucaaaggugcuuuccgaccuggguuucucuggcugaguccagggcuuggcgcuagguuagaauucaggcugagccccgggguggccuccuuuugugucccgauccuagucuggcccgguuuccccuucccggauuccugcuccccuucgggguuuuggaucaaguccacccaccaccucggcggcuaaggcggugaaagaggaacaccgcggguggagcgggggggcccguccccaguccccuggaccucaguuuccucaugcccgcagaucaagcgagagcugagcgagaacacgccgcaccugucggacgaggcgcugauggggcugucggugcgcgagcugaaccggcaucugcgcgggcucuccgccgaggaggugacacggcucaagcagcggcgccgcacacucaaaaaccguggcuacgccgccagcugccgcgugaagcgcgugugccagaaggaggagcugcagaagcagaagucggagcuggagcgcgagguggacaagcuggcgcgcgagaacgccgccaugcgccuggagcucgacgcgcugcgcggcaagugcgaggcgcugcagggcuucgcgcgcuccguggccgccgcccgcgggcccgccacgcucguggcgccggccagcgucaucaccaucgucaaguccaccccgggcucggggucuggccccgcccacggcccggaccccgcccacggcccggccuccugcuccuagugcccgcccccgccaugccucagccacgccccuccggccucagcucccuccccaaagugccugagcgccgccucugugcccaggucccauuucucugcagcacuggccccuuggugcacacacauucccuucgugggcccugucuuccucuugcagccccccaaacugggaccgaaugacccugggaaggggaacuuggguagguuggggauggggcagaggucuggaucugggaucgcccuuggcugaaaguuuagccuuuuuagauugagagauacagagccggcuuagagaacagcuguugggggagaagagggcaccccucaucuuggaaacugcucuuauugugccaauaugcccuccaaacccucccaggauucaaagcuagguuuggcugucugugacuuacgggaccguccugcugagaaauugcacugaagagaugcccccaccucugguugggccugggggugccuggccuuccgaaacuaaaagagugggugggaagacuagugaaacccaguucacggauggggaaacaggccugaggucacauuucacuuagugguuguguugggaccaaaaccuggguguccucacugcugcccugaguccagccaugguuuucagggggacaguggacagggacucagaaauguggugggagggccucccuggcuugggagaccgcucucugcaagggagggggagagaagcagagggagagagaaggugacacggauggaagagugggaaggagcuggccuggcucagcccuaggcugucccugcagccaggguguccgggggcuggccagucagagaaagggggccauggacugcuguggcaaauagggagacaaggagacagacccugcaguccuacuacagucuggagugggguccuaagaagaagggucccaccucaaccccugucaguguccacuguggggugggggcugaccccugccuuugauugucauucuccugggaagcccagucucagucccucccccaacacuguccacacugccccuccccacuguuuauuuauugcacggaucuaaguuauucuccccagccagagcccgagcuccugcucccugggaaaaguggcguauggcccugagcugggcuuuauauuuuauaucugcaaauaaaucacauuuuaucuuauauuuagggaaagccggagagcaacaacaaaaaauguuuaagccgggcgcgguggcucacaucuguaaucccagcacuuugggaguccaaggagggggaucgcuugaguccaggaguuugagaccagccuggacaacauggugaaaccccaucucuacaaaaaauacaaaaauuagccaugcaugguggcucaugccuguagucccagcuacuugggaggcugaggcaggaggaucacuuaagcccagaaggcagagguuguagugagcugagaucgcaccacugcacuccagccugggcaacauagcaaaauccugucucaaaaaaaaaguuaaaaaauauugcccggcuccuagaauuuauuuauuuccugacuuacagcaagcgaguuaucgucuucuguauuuuguagacuuucuaaauaaagucaaauucuuucuuuuuccacagag

SEQ ID NO: 21303 - RNA, 3591 nt, Homo sapiens
cgcggagugagagcgugagcgcggagagcggaccgacgcgacacgccgugcgccuccgcggcugcgcuacgaaaacgagucccggagcggccccgcgcccgccgcacccggcccucgcccgcccgaagacaggcgccaagcugccccgccgucuccccagcuagcgcccggccgccgccgccucgcgggccccgggcggaagggggcggggucccgauucgccccgcccccgcggagggauacgcggcgccgcggcccaaaacccccgggcgaggcggccggggcgggugaggcgcuccgccugcugcgcgucuacgcgguccccgcgggccuuccgggcccacugcgccgcgcggaccgccucgggcucggacggccgguguccccggcgcgccgcucgcccggaucggccgcggcuucggcgccuggggcucggggcuccggggaggccgucgcccgcgaugcugcucuccaaguucggcucccuggcgcaccucugcgggcccggcggcguggaccaccucccggugaagauccugcagccagguacgcgcggggccggcggggccggggccggggccagggcggggaccgggggcgccccgggccgcaccaaccccgcccgcgccucccugcagccaaggcggacaaggagagcuucgagaaggcguaccaggugggcgccgugcuggguagcggcggcuucggcacggucuacgcggguagccgcaucgccgacgggcucccggugagucggaccgccgggcgggcccggguuucucgcgcgccuugcgccucgcuuggcccggccugacccccgcgucuccgcagguggcugugaagcacguggugaaggagcgggugaccgaguggggcagccugguaaguuggggcacgggcggcggcggcggcggggggcgggcgcggggcuuuugcugaccgccgugucccccagggcggcgcgaccgugccccuggagguggugcugcugcgcaaggugggcgcggcgggcggcgcgcgcggcgucauccgccugcuggacugguucgagcggcccgacggcuuccugcuggugcuggagcggcccgagccggcgcaggaccucuucgacuuuaucacggagcgcggcgcccuggacgagccgcuggcgcgccgcuucuucgcgcaggugcuggccgccgugcgccacugccacagcugcggggucgugcaccgcgacauuaaggacgaaaaucugcuuguggaccugcgcuccggagagcucaagcucaucgacuucgguucgggugcgcugcucaaggacacggucuacaccgacuucgacggugagcgcgggcgcggggcagggaacguuccgggggccuugccggcggguuaacgccugcaggggcggcacauggaggggcugaugacuguugggcggccgcgcgcccugggucugcucucguggggagcagaggcccacgcgcuacccuggggagggcugagcgagggaucaagagcgggaucgugcugggugggggcuaggggcgcgcucaauauugcuuccuccaucgcguugggggguacggggccucuugccccggugugggaggcgcgugacauccuuccggcccgagagacccccggcugggggcgguagcggaggagucuccgugcgugacgcagggcgcagccgggcugggucugcgccgggagccuggaggcccccgcggcgcgguuggaguggcggggccuccccugcgugggggcgggagcugcgugcgugcggagcgcgggggcgcggcggcagaaauccccgcauugcggagcuuggggaagccggggcuccccgcccgccccucccuccucccucccucucuccccuccccccguucccgcaggcaggcgcgccgggcgguaagggacccgcgcugucccccccccacccagguagccucacagcgcaucuguuuguugugaaagccgagcucuuacucaugugaccugcuccucccccgcggccggcggagggggacggccggccccucccccagcccccccaucgccugccgggguuuuuccagggugaugacgagcaggauuuugaggccuggcucugcuuccuguuacugaggccagggaguuaaccagcagggaccucgccgucuguugagcggcucugccucuguggugggcgugcuaagcccuguguccccuuaggcacccgaguguacagccccccggaguggauccgcuaccaccgcuaccacgggcgcucggccaccguguggucgcugggcgugcuucucuacgauaugguguguggggacauccccuucgagcaggacgaggagauccuccgaggccgccugcucuuccggaggagggucucuccaggugcgugguggcucgaggcgggggugggggccucgcccugcuugggcccucccugaccucuccgcuccgcacagagugccagcagcugauccgguggugccugucccugcggcccucagagcggccgucgcuggaucagauugcggcccaucccuggaugcugggggcugacgggggcgucccggagagcugugaccugcggcugugcacccucgacccugaugacguggccagcaccacguccagcagcgagagcuugugaggagcugcaccugacugggagcuaggggaccaccugccuuggccagaccugggacgcccccagacccugacuuucuccugcgugggccgucuccuccugcggaagcagugaccucugaccccuggugaccuucgcuuugagugccuuuugaacgcuggucccgcgggacuugguuuucucaagcucugucuguccaaagacgcuccggucgaggucccgccugcccuggguggauacuugaaccccagacgccccucugugcugcuguguccggaggcggccuucccaucugccugcccacccggagcucuuuccgccggcgcagggucccaagcccaccucccgcccucaguccugcggugugcgucugggcacguccugcacacacaaugcaaguccuggccuccgcgcccgcccgcccacgcgagccguacccgccgccaacucuguuauuuauggugugacccccuggaggugcccucggcccaccggggcuauuuauuguuuaauuuauuuguugagguuauuuccucugagcagucugccucucccaagccccaggggacaguggggaggcaggggaggggguggcugugguccagggaccccaggcccugauuccugugccuggcgucugucccggccccgccugucagaagaugaacauguauaguggcuaacuuaaggggagugggugacccugacacuuccaggcacugugcccaggguuuggguuuuaaauuauugacuuuguacagucugcuugugggcucugaaagcugggguggggccagagccugagcguuuaauuuauucaguaccuguguuugugugaaugcggugugugcaggcaucgcagauggggguucuuucaguucaaaagugagaugucuggagaucauauuuuuuuauacagguauuucaauuaaaauguuuuuguacauagugga

SEQ ID NO: 21304 - RNA, 3591 nt, Homo sapiens
uccacuauguacaaaaacauuuuaauugaaauaccuguauaaaaaaauaugaucuccagacaucucacuuuugaacugaaagaacccccaucugcgaugccugcacacaccgcauucacacaaacacagguacugaauaaauuaaacgcucaggcucuggccccaccccagcuuucagagcccacaagcagacuguacaaagucaauaauuuaaaacccaaacccugggcacagugccuggaagugucagggucacccacuccccuuaaguuagccacuauacauguucaucuucugacaggcggggccgggacagacgccaggcacaggaaucagggccuggggucccuggaccacagccacccccuccccugccuccccacuguccccuggggcuugggagaggcagacugcucagaggaaauaaccucaacaaauaaauuaaacaauaaauagccccggugggccgagggcaccuccagggggucacaccauaaauaacagaguuggcggcggguacggcucgcgugggcgggcgggcgcggaggccaggacuugcauugugugugcaggacgugcccagacgcacaccgcaggacugagggcgggaggugggcuugggacccugcgccggcggaaagagcuccgggugggcaggcagaugggaaggccgccuccggacacagcagcacagaggggcgucugggguucaaguauccacccagggcaggcgggaccucgaccggagcgucuuuggacagacagagcuugagaaaaccaagucccgcgggaccagcguucaaaaggcacucaaagcgaaggucaccaggggucagaggucacugcuuccgcaggaggagacggcccacgcaggagaaagucagggucugggggcgucccaggucuggccaaggcaggugguccccuagcucccagucaggugcagcuccucacaagcucucgcugcuggacguggugcuggccacgucaucagggucgagggugcacagccgcaggucacagcucuccgggacgcccccgucagcccccagcauccagggaugggccgcaaucugauccagcgacggccgcucugagggccgcagggacaggcaccaccggaucagcugcuggcacucugugcggagcggagaggucagggagggcccaagcagggcgaggcccccacccccgccucgagccaccacgcaccuggagagacccuccuccggaagagcaggcggccucggaggaucuccucguccugcucgaaggggauguccccacacaccauaucguagagaagcacgcccagcgaccacacgguggccgagcgcccgugguagcggugguagcggauccacuccggggggcuguacacucgggugccuaaggggacacagggcuuagcacgcccaccacagaggcagagccgcucaacagacggcgaggucccugcugguuaacucccuggccucaguaacaggaagcagagccaggccucaaaauccugcucgucaucacccuggaaaaaccccggcaggcgaugggggggcugggggaggggccggccgucccccuccgccggccgcgggggaggagcaggucacaugaguaagagcucggcuuucacaacaaacagaugcgcugugaggcuaccugggugggggggggacagcgcgggucccuuaccgcccggcgcgccugccugcgggaacggggggaggggagagagggagggaggagggaggggcgggcggggagccccggcuuccccaagcuccgcaaugcggggauuucugccgccgcgcccccgcgcuccgcacgcacgcagcucccgcccccacgcaggggaggccccgccacuccaaccgcgccgcgggggccuccaggcucccggcgcagacccagcccggcugcgcccugcgucacgcacggagacuccuccgcuaccgcccccagccgggggucucucgggccggaaggaugucacgcgccucccacaccggggcaagaggccccguaccccccaacgcgauggaggaagcaauauugagcgcgccccuagcccccacccagcacgaucccgcucuugaucccucgcucagcccuccccaggguagcgcgugggccucugcuccccacgagagcagacccagggcgcgcggccgcccaacagucaucagccccuccaugugccgccccugcaggcguuaacccgccggcaaggcccccggaacguucccugccccgcgcccgcgcucaccgucgaagucgguguagaccguguccuugagcagcgcacccgaaccgaagucgaugagcuugagcucuccggagcgcagguccacaagcagauuuucguccuuaaugucgcggugcacgaccccgcagcuguggcaguggcgcacggcggccagcaccugcgcgaagaagcggcgcgccagcggcucguccagggcgccgcgcuccgugauaaagucgaagagguccugcgccggcucgggccgcuccagcaccagcaggaagccgucgggccgcucgaaccaguccagcaggcggaugacgccgcgcgcgccgcccgccgcgcccaccuugcgcagcagcaccaccuccaggggcacggucgcgccgcccugggggacacggcggucagcaaaagccccgcgcccgccccccgccgccgccgccgcccgugccccaacuuaccaggcugccccacucggucacccgcuccuucaccacgugcuucacagccaccugcggagacgcgggggucaggccgggccaagcgaggcgcaaggcgcgcgagaaacccgggcccgcccggcgguccgacucaccgggagcccgucggcgaugcggcuacccgcguagaccgugccgaagccgccgcuacccagcacggcgcccaccugguacgccuucucgaagcucuccuuguccgccuuggcugcagggaggcgcgggcgggguuggugcggcccggggcgcccccgguccccgcccuggccccggccccggccccgccggccccgcgcguaccuggcugcaggaucuucaccgggaggugguccacgccgccgggcccgcagaggugcgccagggagccgaacuuggagagcagcaucgcgggcgacggccuccccggagccccgagccccaggcgccgaagccgcggccgauccgggcgagcggcgcgccggggacaccggccguccgagcccgaggcgguccgcgcggcgcagugggcccggaaggcccgcggggaccgcguagacgcgcagcaggcggagcgccucacccgccccggccgccucgcccggggguuuugggccgcggcgccgcguaucccuccgcgggggcggggcgaaucgggaccccgcccccuuccgcccggggcccgcgaggcggcggcggccgggcgcuagcuggggagacggcggggcagcuuggcgccugucuucgggcgggcgagggccgggugcggcgggcgcggggccgcuccgggacucguuuucguagcgcagccgcggaggcgcacggcgugucgcgucgguccgcucuccgcgcucacgcucucacuccgcg

SEQ ID NO: 21305 - RNA, 4281 nt, Homo sapiens
uaaaaauagagauuuuauucugcagaggaagaugcuacacuggugggggcgaggagccgcuaauagcuacaguggaaggaaauacugauuccaggaggcaaacgcaucuuugagaaacugaggagagaagagggaccagaaaaggcugcagggagaaaggagagaagaguggagagggauuggguuggguuggagguggucuuugcaaaccaggcugggacccagcacaauaaauaguuuuauuuacaacauccaaacucguggcucuguauccacguuucagugcaaauuauuuacacacugaugaggaggcaggacaggaagggguaggagguggcccagggaggcauggcucacagcuguucaauggcuccacgacagagacugggagaaugggggcauuucugcugguucccccaaccucauuuccacaucaucacagcugcccuuuugcccuguaaccuccugcuucagcuacagguggggaggagaaaggcccugaugcccagguguggguucagggucugcacccauggcaggagaauaggaagggacuuaggaggacccggagaaaacgcaggacaaaggggaagaagagaggcagagaggucgcuggcgcgauggagcaggcagaaugacaccaucaggagccgaccccauggcggaggggacccauccuucucucaccuccuggccaagcagggggcagugcaacaaggggucucccgcggagagggagggagguagguccggggcagguccaucaggauggcaagaggguucaugccgccccaggcaagugguuugaggaguccccagguaggaggaagugggagagaugggaugcguaugaaccgcggggagugugacuggagguacucgggugggcgaauaaccgggucuugagugcuagcgagucuguuugggggagggcucgaggagagcguuccugggggcgaguccgcgcagcgccucacagacacucgugcaguacgcgcgugugcgugcaguugcggcagcugacguggcagcaccaguggaaggugcaguugcagcgcucggugacgcgcugcgugcgcgugcgguggccccugccgcagcagagcagcucgcagccguccagcgcgggcgacgagcuguuacaggcgcgcccugccgugccugcugugcccaggcguccgcuguacgugcagaaguugggcgauuucucgaaguagacgaggucguggggggagggcgguuugugggccgggucuuccggcuccaggcgcagcagcuccgcccgcgaagcgcgguugcugccgcgguugccguacaggacgcgcgaggcgccgucgaagcggucgcgcagcacaucgcccacggcgcgcagcgugggcagccgcauccagcacgugcgcaccgugcaugagccggacaucccguggcacuugcacuccuggcgcaucucggagaauacggucugcggggauaggggaagaaagagugucccagggcaccgggccagagucacccucccagacacugcccucucccggacgccacgggggccggaccucagcaaaggcccaggccuagcugagcccaggggaagggaggcgcgaaauguuccgcugagauuuggaaacccugcccaacccugcuccgccgcggcgagucagucucggccucucaggcuuauuuuucgaaucuguacagcgaagagacugugcuugauuugcaaccucuucuaccuguccgcgggccagacauaccuuugcccucagccacugucuccucuauucuccgucuucguuccaagccuccggcucucccaggacgcccucuccuggugccccuugccuuaucucaccgaccgucacuuccccagcccgagguuggccccugccgcuccgcuuagggugcggagccucucaaagcucaccguacggccugccucguuguugugaagguucaugaggaagcgcaggucccgccccuucuccccggaguccacgaacucccggccgaagaggcggccgaagucaauguugucgcugcagcccccccagugccagucggggcccccggggccgcgccgccgguagucacacgugcaggauucgauggaaccuucugagcaggagcgcgccaccgaaugggugaccccggcggaggugauagcgaagauaaacgccguuucucgacagccugugggagaagggagcggggaucagcgaggggguacgcggggcgcggccagcacccucaugaagggcuugggaccggaaucccacccccgacuccgcacuuugaguccugagagccagggccggcagugcuggaaagcuggucucuagggcuaguagagaaagcaggugcgugggcacgcagccacguccacgggcguaaucacaccuuacugggagauucuagggcgcauuuuggcucgauagcggaaguggagcagccccagagagacaaaccgaagagaggggagcggaagaaccauacauccccaagacuucuucgcagcccaaaacuuucggcccauuuuggcggugcaagccuugcugggcgagaggccagacacacgccugcagagagcagcuucccaggcgcuuuugagagaggcugggggaaagcggcggucagccggcguccgcgacccgaaacuuucuuuaucuggggcaguagcucagaaaaguuaagcuucguuuccagggugcacggcuggaaaacgccugguagaagucuggccccgagcuggcgcugggcacgaggcacuuggcaagguugauugugugacccuccaggcgccugggacaccuucucugaacucgcccgcccaugcccugggggugaccccgcguuuccccugcucccggaagcgucgccuuccugggcacccaccucgguugacgaucuugccgaagagguggggcccuggagcagugggacaguuccagcggcgauuccggaacugccacuugcacucgcgcacggcacucugcagccccccacucacgcugugcaggauccccggauuuuggcguaucagacgccgcuguuugcggcucaacagcugcagacugggcucgaguaccaguugcagacucuuggagucuguaagcagguucguggaggaggcuacguucacaauaccccuggugggacguaugauagcucaggcucaggaaggggauccgcacccuaaccauaaaaacugugccacccgguccucuuccuggggguauguggcuggagagaauggcgggagauuaauaauacccgcucucccaggcucacuaauuugaaagaacugggcguccagacuugugugugcccaguagucccagggcugcucgccugagcccuagguccggagacuggacagaggagguacccggagaccgagugucuaccuuggaucuccgagccucuuccggucagccugagcgagauaaucauggccugcaguucuugcccacccaaggcgugaaaugcuuaggagucccacccucuucuccccuccuuucuaggcgaacuccuggcccuucacuucccgagguggggaaaccuguggugagccaccgccgugaggcuggaguuggcgcucaaaggggaagggcggugcuagaugagagugggcucccugccugggguaucuuaggccuccgcgggcggaucauucgccccacuuguacagagcuggagucuggggcaguuucaugccagaucgcccuucggugucgcggagggaagucagagcggggagggagccugucggcagacggaucccagagcgugggagcuggguaggguuggccccuggcucugugccgcgggacaaguggcgaccccgcaccagcucacuuaccaccaucggccacugcuguuggcagccagggcugcgggcagagcggccagcgccagcagcagcguagcagaaacccagccaggcaacagcgcccagagccccauggccugccuggcuuugcccgcucugugcugcaguugcggcgacuuugguuguugcccgcgacggugggacgggacgcggcgguggcggcaguggcgagaguucgcagucuggcuuuaacaacccugggggcgggcggcggacagcauggcucgcggucccggcuggugggcugaggcggccacggcgggcggcaccgccucuuauaguugcggcgcuggcugaagugacgggaggaggcugccccuccgggccgcacuguggcaccagggcgcaccgguuaggggcgcagacaaugggcagcgagcggggcugugguu

SEQ ID NO: 21306 - RNA, 10225 nt, Homo sapiens
uuugcaaagccccauaagccugacuccuuuuuagagauccccuagcagaguuuaugguggucacacagagcugcuuuuuagaugcauuugcgggaacugggaaaugagccuucaacuuguacuugacuuguacuuguucuccugcugugugagcucaaggagccugacucaugccacuuccugcacuuccuccugaccuccacaggagggaggcaggcguccaugccuggcaaagccuccugcugagcugccaaagcucuagcuguuugcucagcugucacauccagguccugucuuuacugaacugucuacacagccuuaccuggggugugaggcucuccaaggcuuccuguuagcuuuuuuguuugggguggcagggugagggggaucuauugccacccucgaagaacaucuuucccuugcuuuuuagggagcuuuucggcgcucccauuuauuccuuauacaggcucaguuuugucuaguguauagggacagcauuucugagagaaagcuuauucauuucucaagaguaaagaucuguuaagaauaugggaucagagucccacugagaaugauaguaaaggggaugggggcguuggaaggccuugaauuugaagcaaaggaaauuacccuuucucuguuuucugacucaagguuagucucucccucuguucaacugccaggccagcccaggccuuugcagaguuaucacagaaaaagagcauguagagaaucagugaguugcaaauuucugcagaaaauagaccaaagagcuagcugcucugaugaguauugcugauagcuuaaaaaaauagcuucugaagguuuauaauguacagugaaaaaugauucccuuuucaguccuguguaucccuuuuaccagggcuuuggguuucaggagaaaguaggaaaucuuguccaguugucucccaggggcgcccugcagggaagggagcuguacacgagacaaugcugaugucggcagugucugagaaccuuacccuuccugagacagauucugggaguggguguaggauguguuuagaagagggcugguaggggugggcguuggagcagaagggucaggaagcaggggguggagcuggaccacaggggugggcaagguggguggaagagggaagagcguauacuguccaguaggaggauggguuggggaaggagaauauccaggcuggagguuggguggcagggagccugugucugauguuccugaggaaauguccggggcuccuaggguccugcgugaggguccaggaaagaguccacgaguuccauucaagaguucguguauccuguucagguauccggggauuugguccagggaccuggagguuugguucagcagaccaggaaucuuggcucugaaucccugcugccacuucagaagcccagagccaguaguucuggcugaggcagugaaguuugucuccaacaauccagaaguccuguuugggagcucguucagugugaggacuagagagguucugcuggggacagcugugguggguggggcccgccugacgcagaggguggacccuccuacaagcaucaggaaacgcaccuuuccucggagcagguguuggaagcucaggaagauggcauugggauccuugugagcugugguccugcccuguggaggaagcugagggcagaggaugguccugaggccaaacaccagggccagaucucaggccucccuugucuaaguaggaaagacaggaugccaguacccaggcauuguggcuggcagggagcacucuuaguagaucagcucuucugcccuugagcucccuggaagagcccuucuucccucaggucuucuagggggacugagucagaaaagaacaguuucuacagaucccuugacuggggacuuaccuggguuccaaggaggcucugcagggccccaaggaggagacggaccuguccagaaagcugccccaggagggaugagaggcaagugggucccaguuguccccgugcugccaucacucccuccagcagaagggucacugcucccagaauguccugugccuuggucuccuccugagaaagagauggaagagagaagcgcacugccucaaagggcacacuaaaagcggguggggagccuuaggaguagccagcagagugaaucauacaggcugagaacuggacaggaccaaggucccacccagggcaggaauuccuucacagucucccgacagcuggucaucagccucugcuucaaaaacucccguguccucuaguccagccuggucuuacacuugguuucagugagaagagcuccuuuuuucuuacguugcugaaaucugcccuguuacagcuuuuaccucuugguucuagugcugcaaauuuacucuuucugcugcaaaaccuuaggaucauuugauuuuuaaacugaaugaaggcugggugcaguggcucacgccuguaaucccagcacuuugggaggcugaggcagguggaucaccugaggucaggaguucaagaucagccuggccaacauggugaaaccccaucucuaccaaaaauacaaaaauuagcugggcaugguggugggcaccuguaaucccagcuacuugggagacugaggcaggagaaucgcuugaauccgggaggcugagguugcagugaguugagaucaugccacugcacuccagccugggggauagagugagacuccgucucaaauaauaauaauaaauaaacuaaauguagguaugagacucuaccauaaugaucauaaggaugaaaagaaaggacuagaagggacccauaggaacugcccuucuucccugacucaguccugaaggaagaagggacgcuaggguucuugaggauagauuuuaguuuuuuaaacuauugcccauaaaacaugcuucuagucucuuucuguucaggcugcugcuuucuagacacauguuaguuuaauauggucccucuuaauaaauuagcauaugucuucagggggauguccgguguucaggccaguauauuuaaguguaguccacucggaauagaguucuguacgagcauuuccacaauggggaugcuaaacaucaaacagacaagaauuacuagcuuuaagaauagcagcuucaguaauguuacaugguaaguuugggggcaauuuaauucucucagauccuuuucguaggaagugcuagggccagaggcuuaaaugauggaagcagggcauuguggccugaaagcuggaauaggacuuuacucauuaauuuacacauguagaauuuuuuuuucuuuuugagacggaguuuugcucuugucacccaggcuggagugcauuggcaugaucucagcucacuacaaccuccaccuccuggguucaagggauucuccugcuucagccuuccaaguagcugggauuacaggcaugcacuaccaugcccggcuaauucuguauucuuaguagagacgggguuucgccauguuggccaggcugcucucaaacuccugcccucaggugaucugccugccucggccucccaaagugcugggauuacaggcgugagcccccggcccacauguagaaguuuauaucucuguuguuucaccuuguuuuugaccuagucuuucagugauuugaaucuugauucagucuuuuguuauuuuagugguacuucccagcuuugugucaucuguggaugacauaugagucuugcuucuucaugccaauuuaagaagacugaacgggaauaggucaaaggcauggccaugagcgauuucucuccagcuuuucaugguguucagcuucaaaucuauucacauauuggaccugcaagccaucaucuuauccacaggcuaucaucauaggugaauguagauuggguuaggguggccaagcugaaggugagauauuuuuaaaaagcucaagaauguuggagaauccaugggaagcagugggaaacugaagacaggacuuagggaagccaagguuagggauggcuuucuuaccaucuggguuuuccauucucccaagcuaaaguccacagcaggcagcaggacagguguaggcaaagggugaaccucugggcacuggcucuguugaaaaagauugguggggggagaagggagcugaaauagagagagcuaugguagccuaauaagcaggcuaguccuccaugaguacuaucucuagacgagagcuuuuaaaugcgggcuguauugugaagaauaauccuugucagagagugugaucaguagguggggacaauaugggaagaauagucauugggucaaggaguuagaggaagugauggugucuuccugggaguaugggugucuuaccaguuacgcggauaaaggggauaauguugggaguucucaccagucugcugugaaggacaugggagucacgaagcaguuuacugaggacucggaggucacaagcaggaggagccgggcuggacagcguuagccuugcaguuaggagaagcaugaccacgaggagcaauucuuagaugaggagaggugagguugaaagaugaggaggaaaucauugucagcugguauuccaggaauucccauucaggacccagaccugaaacccagggaauccaccccucagaccccuuauuuuugggagaauggguucccccagcuuccugcccccugcagcgugucuccuuucucucuccccuucugucauguuuccauauggcccuagccccucagguguguucucaccagucagcuccauucuggccggggugucuggcuggcguggcucccuguuuggggccucuccccugaauccuuccuggggccauggaggcggcuuaggcucuugcacuucugggcagaguaggguggggcaaaggcgggccaagggugaagaaucuauccugaaaguagcaagaagagugaacauuuaaccaaguuucuaggaagagacugccuggcagggugaacagaugcuggggagggcuugagaugcugaccagccuggaacugccaaagcccugaauucucucacauuuucuugugaugaaagcauauggugugccgggugcaguggcucaugccuguaaucccagcacuuugggaguccaaggcggguggaucaccugaggucaggaguucgccaccagccucacuaacauggugaaaccccggcucuacgaaauacaaaaaaacuagcaggguguggugguucaugccuguaauccaagcuacuugggaggcugagacaggagaaucgcuuguaccugggaggcggagguuguggugagccgagaucgcaccauugcacuccagccugggcaauaagagugaaacuccgucucaaaaaaaaaaaagaaagaaagaaagaaagaaagaaagcaagaaagcauauggugucuccuuuuugucaggacuccucagugaaucggacauggauuuggugccaccuaccccugcugagagcagcaggacaugauauguauacacacauaucuuaauuagccuuaaauucugagcaaccuugguuguuaggucagagaaaaucugggauggggauagagaaggaaaguauuguggcuucagccuggagaagagaguggaaaaugggaugcagggccugggugaggaacuggcaaacgggcgcaauauguugagggguaacuucugcgguggggaguggggcuggggaggggaacugcacaaagcuguaacugggaccacuagaggucaggauuaaaaggcgguaugggagaaauuaaccucuauucuuucccuaucuacccccacacauaaagccacuggagcuuuucucuggacuccaaguccugaaauacuccauuaucugaggccaagagaugggcuaacaguucugggacuuccuuccugagaccagcugcccaggaacgggcaccugcugggugaugcccaccuuaggggcuuaccuugucuuaggcgcccacuaacauaucugucucauagcucacaccugccucccugcccccuuggcagaaccccuuccgguuccuucacaggaccccccacauggcuuccuccuccuuucacaaguugugcaaagaggcuugcaccugauucaauauugggauuuccuguaggucugucaacaugagugggcccuccucccauuacccucuccuugcgcccuggcuugccuggcccagcuuccccagcaccagauucagaaccuuaagcuaacgaggaaugaccagcuaagaauggggauuggggcuguguccaucuuacuacuguguuugcuaagcccuaagugcagcucccucucuuauuuucucccugggcucauguccccuuuccuuagggccagccagggcugugcuguauuccaccaaguaagugaucagucccucagaaaccagcaccccacccccuaccccugcucugcccugcuccucccauucugggaaggcuacacucuucucgacaaaggucagugccuguagguuccaguuugccugccccucccccagcugggagcccauuucucuuugcuguccuuucuacccucacauaaccccacacccugcuggccacucaccggguggagaagggcuccaggacccaagugcacagcaggcagcccucuggggagcagauggguaggaagacauguggcgguggggcacagccccuccacagcagcaggucauacgccugccugggccacuucugcccaaucagagaagggagccaccagacacuggugaaggcccccggaagugacgccuucucuucccuggagccccugccuggaccaggguccacuccuccacccacacacaccacggagaagauuuggauagggggauccaucuuuuccuggacaugggcaaccugggaccuggagggggacaggagcagaaguuuuuuuccaggaggaaucuggcaggacauuuguguugcuggggaagaagcacagaggucuuguuuaagauuggugggguuuucacucccuggcuauccaaauuucuuuucccuggacaucauaccugcugcugaaauccaacaggaugcuugcuuuccugcuuuucuuucuguaauccccuagggaguccuaucuugucauucccccuuucgaagugggaacacggauauugcccacaugagagaaaucuccuguuauggguugguguuauggggaaaggguuuggacggguugaguggacugucaggugcggggcacauguaugugcgcacacgugcacuggguuaagccugagcuuaggugcucgucugcugggguccaguggcuuagauggcuacacacacagaccucugugcccagggcccuccuuugcuuguucugucuccgucuuccaucuccuaccguuccacaugugacaagaggaauaaccaggcccaugugucccugucuuaggaaagacagcugcuggaccucccccgcaaauaccucccugcuggccccccuuuuccuuuggcccuggcucuagcuccuuugcuuucuucccagucccagucuccccacagucucuguccucaggggcuuccuggccugaccuugaucccaucaucccccugucccccagaacuuccucaggcucucuccuguuccuccuccccaaggaugggcaugucugcugagaaguguggccuagauccuggaauuuucccguccagccagacgagaugucucccaagauuaggaaggagggugcugggauagcugggaggauagugggugugugugggagggagagacaggagacagggaggcaggcaugaccagggaaccaagagaaaggaggcugggagugggcuggagaggcagagggucccuugggugaaggaagggggugagaaagcaagaggggacugucgaaugcgccugaggauaaguuacaaugagagggagauacugucacuccacagaagggggaaugcugccgguuucuggcuaggucccuguccuggguaacacaagaaugaggagcgaccucagagagaagguagggaggcaggcuaggcagugagagaggguggugaggguuuggggggcgcugugggcccaggcagggggagaucggcugauggaccuuuccuguacguugucaucuuuaaagacaagucuucauccuucgggcggaaccggguccucgcucacagagcgguccaggccucaggccuagccucugccccucccuagccugaggcucccuuccugggcuggacaccgaccuccugguccagccgcccuguggccgccagcagcggggggcuccgggcccgccucuccucccccucuucgcgcccccuggucccuccccucccccucccccgcucccccuuccccucccgccccucccuccuccccugcccggucccagccccucccuccccucccccacccgcgauccgggccgcugcugcugggucggaccccccgggcucagcccggccccucgccgagcugccgccgccgccccguuugcugaggaggaggcccccggccggggcgucgggcgcggggcauaaaacgggccggagccggcgcccggggcaguagagccgcguacggcccgggucagcgcccgcccgcccgcgcuccucccggccgcuccucccgccccgcccggcccggcgccgacucugcggccgcccgacgagccccucgcggcacugccccggccccggccccggccccggcccccucccgccgcaccgcccccggcccggcccuccgcccuccgcacucccgccucccucccuccgcccgcucccgcgcccuccucccucccuccuccccagcugucccguucgcgucaugccgagccucccggccccgccggccccgcugcugcuccucgggcugcugcugcucggcucccggccggcccgcggcgccggcccagagccccccgugcugcccauccguucugagaaggagccgcugcccguucggggagcggcagguaggugggcgcccgggggaggcgcgggcggggagucgggcucggggcgagucagcgccagcccggagggggcgcggggcgcagguggcucggcgcggcgggcggcccggagggugggcgggggcagaagggcgcggugccugggacccgggacccgcgggcagcccccggggcggcacacggcgcgagcugggcagcggccuccagccaagcccguccccgcaggcugcaccuucggcgggaaggucuaugccuuggacgagacguggcacccggaccuaggggagccauucggggugaugcgcugcgugcugugcgccugcgaggcggugagugcaccccgcggccggcccgggcccuggcggguggggagcgccgggucgcgcgggcgucggaguggacucggagcugcugagaaggagcccagucggcagauguuggggauauuuuucugguggaggaaggggaaucagccccuccaauucuuaggugcuguuacugaucgcccacucugugugaggcucugugccaacuccguuucguucccugcucaucuaacucucauggcagccuugcuagauagagaguauuauuauccccauuuuccagacagggaccuugaggcccagagagaugaaguagcuugucuagggucacgcagcuuguaaguggcagagcuggcugacucugcgggacauccuugccugggggggucucaucaguuggcaucuugcacucacuuggguuucccgccuuuuccgggagcagccucaguggggucgccguaccaggggcccuggcagggucagcugcaagaacaucaaaccagagugcccaaccccggccugugggcagccgcgccagcugccgggacacugcugccagaccugcccccaggguaagucuugcuccgcccugcggggagggaggcagggccacgauacuaggucccgggccacuuggauggggcgucggacuggccuuucccauggccagcugaagcccguguucuuacccccccgcccgcagagcgcagcaguucggagcggcagccgagcggccuguccuucgaguauccgcgggacccggagcaucgcaguuauagcgaccgcggggagccaggcgcugaggagcgggcccguggugacggccacacggguagggggcuggcgaacagcgggguugugguugaggcugggccaccaaagcggcguuugacagugcucaggccaucuuccucccgucccagacuucguggcgcugcugacagggcc

SEQ ID NO: 21307 - RNA, 53937 nt, Homo sapiens
acccagggaaggcaguggcaagauggcgucccuggaucgggugaagguacugguguugggagacucaggugagcggcuuacccuaccucuggggcuccagacacuuuugaguuacccaguaacccuccccuuagcuuccuucccucaacuuccuggcuccucggcccguggcugaagucccucccagggccugaagacuacacuucccaggggacuuugcuccgugugacgacgcgguggcggcggcgucgucgcgcgggugggggucgcggagcccgggucuuuugccuucgcggcuuuccgcaucggucucccaggcgaccccagccuagaguguauugucaauucuuuuauuaaaaaaaaaaaaaaaaaaagcaggcauugaguauuguaugggguucuauguuaaggguacagaaguuaguaggaccgugccuucaagagauuuuguucauuaaggaagucaaacgugcacugagaaacgugcacugagaaacgugcacuggcaagcgcuucgcauguauuaacucauuuaauucugagacaguccuguuaucccauuuuacagaugagaguagugaggcagagagauguaaaugacagaauccuuuugaacgcggaguccacgaacuuaaacgcuaaguuauaauuaugcagugacauauuggguagugguccuguuuuauucuuaacugagcuuaauuuccugguucucguuugaucuucauugaaaaccuauuauguccuagacuguacaauagagaaauuaaaguaagaguuuuauucugaagcagcuaggauuuaacgcugagcccaauuuaauccuaguguuaaauauauauauauuuuuuuaaucucaguggaugcaaaaagaauucuuuugacaccugggacauuugagaacuacagcuggcgucuggauuuccagcucccaccucacugcccuuaucuuuucuuccauaauccccaauucagcucuccuuaguaacuucaauaaaugcugaccuugcauuuuauagaagcgcuccucuggaguuggccuaagagcauguguugugagcaaagacguugugcuagaugcuuggagguggagaggcuugaaaacuuaauagaaacuaaauaaaauugugggcagcaaauauagguuaagaauguuuucacauugcccugaggauuauuugcauuaugaaauauuuuacagagagcauuauuuaauauuccccuaagaaaguugccuuuugaaacuuaaugaacauaaucacaauuuaugucgacuucauuucuaucagguagcuugaaguggugccgaaguuaauuuaauaaaaucacucaguuuuacagauaaaguaauuguggccuaaagggacuuggcaagaguaucacugaguagaauuuacaauccagaacuaacagacuucuucaugauacguuaaguggguguuuuguguccuuuauaauuccauuuucuauuguaucuaacaaucccuucauauuacaaacuguugcaacuagucaauuuauuuucuuuccaacaggcacuguauuagguucugggguuauaacuguggaauuaaugcgucauauaacagggauagaauuagcagcuacauuaaauguggaaaaguaaucaggcaauugauaagcuucccuacugcccgccuccccuguuaugguuuaguuguaaagcagaagacacagcugugauggccaggaaagugauugauguugucacacauucacuaauguuaaccuuuaugugcaaaguuaguuauugucuuuuuaucuuuuuaaaagguaauuuugucagucuccuuuuaacugcgauuuaaaaguacacagucugacaguuuagaaugcacuuuuuacacuuccucagccuuucuuucaaacccgaaaguuuauuuuuaaauaaaggccauuucccuuauaaaauuuugaggguuucacaaauauauaaagaaaugacuuagccagacaagguggcucuagccuauaaucccagcacuuugggagguugaggcggguggauugcuugagcucaguucaagacuagccugggcaacauggcaagacccucucucuaccaaaaacaguacagaaaguuagccgggcaugguggugcacgccuguagucccgcuacucaggaggcugaggugagaagaucacuugagcccaggaauuugaggcugcagugagcuaggaucgugccacugcacucuagccugggugauagagugagacccugucuccaagaaaaaaaaauaaaaagaauaaguugauauuuggugauuuguuuuuauccuauugagauauuugguaauuugguaaggaacccugaaagucucacuaccauacgguuuucucuuucuuucagagauuagggacuaguuuaacauauuaccaaacagcuguauuuggagcugacauuuauuuauauugggccuuuuuuacccccaagcaaaucaagugcauucuuuugaucaaauuuaguucuaaaggugaaaacauagaaucagaaucucccaaaauucuuaaagaaaugaaauucgccauuauucccuagcacuucaacuguucuuacuguuuaggguuucaucccuucuuagcuaauacuuaucacccaaagcaguuaauucauggagagcuauacaauucuacugccuggaaauguuuacccuaacacaauuaagcuaaacuaggccucaaguguugcaucaagcugauaauuaaguggauagauacauuccuugaacauaaacaaaccuauuuacaaauacagaaucaacaauacauccuaaaaguuacagauauuagacacaaugcaguaaauucaaugacaaauauaauuuugaguauuuaaaaaucuuaaauguuucuauauaaaaaaaguaauaaaagggaagccugagaaaauguuugauucaauuacacauacguaaaaugauuaauauauuuaauagauaaagagcucauauaaauuaaugacacuaaaaccugguagauaaagguacagaguagaucaacagagaauuuaugagaggaaaaacaacugauuugccagaauaaucauaaugauaaucuuugaucuuuaucagaaaguaaagaaaugcagacuaaagcaagcugucacucccccacugcccgccaccaccgagacggauuguugcucugucacccaggcuggagugcaguggcgcaaucucggcucacugcagccucugccuccuggguucaagugauucucuugccucagccucccaaguagcugggauuacaggcacccaccaccacgcccagcuaauuuuuguauuuuuaguagagacaggguuucaccauuuuggccaggcuggucucgaacuccugaccucgugaucugccugccucagccucccaaagugcugggauuacaggugugagccaacgcaccuggccaagaugucacuuuuauuccuuuaucagguuaacaaggaugaaaagccaacuacaugauacuguugaggugcaacaagaccugcaggcucaaguguauggcugguggcaguauaaccccaugaaaguuauuucucaaugcauaucaagaacuuuaaauguuuccuuuuaaguacugaguuuacuccugggaagguauacuaaggacauaauuuuaauuuuaaacaaagguuuaaacagaaauaaccuuucacuagcauaucaaaaauuucaaaacacccuaaauaucuaauaauaauggaagaaugauuaaguaaauuuuuaugccuacuuucugaaguacuauggagauacuuuaaauguuuaugaagauuuuggaauaauauggaaacuuuuaauaaauacuaauuaagguucugaucuaaauacuagagauaaaaaagcugcguaagaacccucaaggaacuuaaaauuaagggagugguuccaagaugaccaauuaggaacagcuccagucuacagcucccagcgugagcgacgcagaagacaggugauuucugcauuuccaacgagguaccaaguucauuucacuggggcuugucagaccgugggggcaggacagugggugcagcccacugugugugagccaaagaagcgcaaggagucagggaauucccuuuccuagccaagggaagcggugacagacagcaccuggaaaauugggucccucccacccuaauacugugcuuuuccaauggucuuagcaaacagcacaccaggagauuauaucucugaccuggcucagagggugccacacccacggagccuugcucauugcuagcacagcagucugagaucugcaagguggcagugaggcugggggaggggcgcccgccauugaugaagcuugaguaaguaaacaaagaggccaggaagcucgaacuggguggagcccaccgcagcucaaggaggccugugugccucuguagacuccaccucggagggcagggcauagccugaaaccucugcagacuuaaaugucccugucggacagcuuugaagugaguagugguucucccagcacagaguuugagaacagacagauugcccccucaagugggucccugacccccgaguagccuaacugggaggcacccuccaguaggggcagacugacaccucacauggcccaguaccccgcugagaaaaagcuuccagaggaaugaaugaucaggcagcaacauuugcuguucagcaauauucgcuguucugccaccucugcugcugaugcccaggcaaacagggucuggagcggaccuccaucaaaauccaacagaccugcagcugaggguccugacuguuagaaggaaaacugacaaacagaaaggacauccacaacaaaaccccaucuguccgacuccaucaucaaagaccaaagguagauaaaaccacaaagauggggaaaaaacagagcagaaaagcugaaaagucuaaaaaucagagcaccucucccccugcaaagaaacgcagcuccucgccagcaaaggaacaaagcuggauggagaaugacuuucacaaguugagagaagaagucuucagaugaucaaacuucuccgagcuaaaggacgaaguucaaacccauugcaaagaagcuaaaaaccuugaaaaaagauuagcugaauggcuaacuagaauaaccaauguagagaaguccuuaaaugaccuguuggagcugaaaaccauggcacaagaacuacgugaugaugcacaagcuucaguagccgauuugaucaacuggaagaaaggguaucagugauggaagaucaaauguaugaaauuaagugagaagagaaguuuagagaaaaaagaguaaaaagaacgaacaaaggcuccaagaaauaugggacuaugugcaaauaccaaaucuaugucugauugguguaccugaaagugacagggagaauggaaccaaguuggaaaacacucugcaggauauuauccaggagaaguuccccaacguagcaaggcaggccaacauucaaauucaggaaauacagagaacgccacaaagauacuccucaagaggagcaacuccaagacauguaauugucagauucaccaaaguugaaaugaaggaaaaaauguuaagggcagccagagagaaaagucagguuacccacaaagggaagcccaucagcguaucucucagcagaaacucuacaaaccagaagagagugaggaccaauauucaacauucuuaaagaaaagaauuuucaacccagaauuucauauccagccaaacuaagcuucauaaaugaaggagaaauaaaauacuugacagacaagcaaaugcugagagauuuugucaccaccaggccugcccuaaaagagcuccugaaggaagcacuaaacauggaaaggaacaacugguaccagccacugcaaaaacaugccaaauuguaaagaccauugaggcuaggaagaaacugcaucaacuaaugagcaaaauaaccagcuaacaucaugaugacaggaucaaauucacacauaacaauauuaaccuuaaauguaagugggcuaaaugcuccaauuaaaagacagacuggcaaauugucaagacccaucagugugcuguauucaggagacccagcucauguacagagacacacauaggcucaaaauaaagggauggaggaagaucuaccaagcaaauggaaaacaaaaaaaggcaggguuugcaauccuaguuucugauaaaacagacuuuaaacaacaaagaucaaaagagacaaagaaggccauuacauaaugguaaagggaucaauucaacaagaacagcuaacuauccuaaacauauaugcacccaauacaggagcacccagauucauaaagcaaguccuuggagaccuacaaagacacuuagacucccacgcaauaaaaaugggagacuuuaacaccccacugucaacauuagacagaucaacaagacagaaaguuaacaagcauauccaggaauugaacucaccucugcaccaagcggaccuaauagaccucuacagaacucuccaucccaaaucaacagaauauacauucuucucagcaccacaucacacuuauugcaaaacugaccacacaguuggaauaaagcaauccucaguaaauguaaaagaacaguaguuguaacaaacugucucucagaccacagugcugucaaacuagaacucaggauugagaaacucacucaaaaccgcucaacugcauggaaacugaacaaccuacuccugaaugacuacuggguacauaaugaaaugaaggcagaaaugaagauguucuuugaaaccaaugggaacaaagacacagcauaccagaaucucugggacacauuuaaagcaguguguagagggaaauuuauagcacuaaaugcccacaagagaaagcaggaaagaucuaaaacugacacccuaacaucacaauuaaaagaacuagagaagcaagagcaaacacauucaaaagcuagcagaaggcaagaaauaacuaagaucagagcagaacugaaggacauagagacacaaaaaacccuucaaaaaaucaaugaauccaggagcugguuuuuugaaaagaucaacaaaauugauagaccacuagcaagacuaauaaagaagacaagacagaagaaucaaacagacgcaauaaaaaaugauaaaggggauaucaccaccgaucccacagaaauacaaacuaccaucagagaauacuaaaaacaccucuacgcaaauaaacuaaaaaaucuagaagaaauggauaaauuccuggacacauacacccucccaagacuaaaccaggaagaaguugaaucucugaauagaccaauaacaggcuuggaaauugaggcaauaauuaauagccuaccaaccaaaaaaaguccaggaccagauggauucaaagcugaauucuaccagagguacaaggaggagcugguaccauuccuucugaaacuauuccaaucaacggaaaaagagggaacccucccuaacucauuuuacgaggccagcaucauccugauaccaaagccuggcagagacacaacaaaaaaagagaauuuuagaccaauaucccugaugaacaucaaugcaaaaauccucaauaaaauacuggcaaaccgaauccagcagcacaucaaaaagcuuaucuaccaugaucaagugggcuucaucccugggaugcaaggcugguucaacaugugcaaaucaauaaauauaauccagcauauaaacagaaccaaagacaaaaaccacaugauuaucucaauagaugcagaaaaggucuuugacaaaauucuacagcccuuugugcuaaaaacucucaauaaauuagguauugaugggacauaucucaaaauaauaagagcuauuuauggcaaacccacagccaguaugauacugaaugggcaaaaacuggaagcauucacuuugaaaacuggcacaagacaaggaugcccucucucaccacuccuauucaacauaguguuggaaguucuggccagggcaaucaggcaggagaaggaaauaaaggguauucaauuaggaaaagaggaagucaaauugucucuguuugcagaugacaugauaguauauccagaaaaccccaucgucucagcccaaaaucuccguaagcugauaagcuacuucagcaaagucucaggauacaaaaucaaugugcaaaaaucacaagcauucuuauacaccaauaacagacaaacagccaaaucaugagugaacuccccauucacaauugcuucaaagagaauaaaauaccuaggaauccaacuuacaagggaugugaaggaccucuucaaggagaauuacaaaccacugcucaacgaaguaaaagaggacacaaauaauuggaagaacauuccaugcucauggguaggaagaaucaauaucaugaaaauggccauacugcccaagguaauuuauagauucaaugccauccccaucaagcuaccaaugaccuuauucacagaauuggaaaaaacuaaaguucacguggaaccaaaaaagcgcccacauuucgaagacaauccuaagcuaaaagaacaaagcuggaggcaucacgcuaccugacuucaaacuacacuacaaggcuguaguaaccaaaacagcaugguacugguaccaaaacagagauauagaccaauggaacagaacagagcccuacacaucuacacaucuacaaccaucuaaucuuugacaaaccugagaaaaacaagcaauggggaaaggauucccuauuuaauaaguggugcugggaaaacuggcuagccauauguagaaagcugaaacuggaucccuuccuuacaccuuauacaaaaauuaauucaagauggauuaaagacuuaaacguuagaccuaaaaccauaaaaacccuagaagaaaaccuaggcaauaccauuccggacauaggcaugggcaaggacuucaugucuaaaacaccaaaagcaauggcaacaaaagccaaaauugacaaaugggaucuaauuaaacuagcuucugcacagcaaaagaaacuaccaucagagugaacaggcaaccuacagaaugggagaaaauguuugcaaucuacucaucugacaaagggcuaauauccagaaucuacaaugaacuccaacaaauuuacaagaaaaaaacaaccccaucaacacgugggcgaaggacauaaacagacacuucucaaaagaagacauuuaugcagccaaaagacacaugaaaaaaugcucaucaucacuggccaucagagaaaugcaaaucaaaaccacaaugagguaccauuucacuccaguuagaauggcgaucauuaaaaagucaugaaaaaacaggugcuggagaggauguggagaaauaggaacgcuucuacacuguugguggaacuguaaacuaguucauccauuguggaagagaguggggcgauuucucaaggaucuagagcuagaaauaccauuugacccggccaucccguuacuggguauauacccaaaggacuauaaaucaugcugcuauaaagacacaugcacacguauguuuacugcagcacuauucacaauagcaaagacuuggaaccaacccaaauguccaucaaugauagacuggauuaagaaaaugugacacauauacaccauggaauacuaugcagccauaaaaaaugaugaguucauguccuuugcagggacauggaugaagcuggaaaccaucauucugagcaaacuaucgcaaggacaaaaaaccaaacaccacuuguucucacucauaggugggaauugaacaaugagaacacuuggacacaggaagggaacaucacacaccagggccuguugugggguagggggaggggggagggauagcacugggagacauaccuaguguaaaugacgaguuaaugggugcagcacaccaacauggugcauguauacauauguaacaaagcugcacauugugcacauguacccuagaacuuaaaguauaauaauaaaauaaacaaauaaauaaauaaaauaaaacauauuucuuuauacagggcauucuucuccacugcaaauaaaucaacagauggcaucauuuuuuuaagaugaauaaaaauccaacauccaaucaaaaaaaaucaaaguuaauaaaaccuauaaauaaacacauguaauaauguguuuuaagugcucucuaggaaaauguacaggguacaguggaggcccagagaauaguggaugcuaugcuuaguucucccuauguggguucagaaaauacuuuauaacuagaaugaugcugacucuccaaagauuaauucaccaggccaaugggugagggaagggagaggauggguaggauauuccagacagaacaagcuauggaagcagacgcuuauguuguuuuauuguuuuuaaguauacuguguauauaaucacaauaaccaccugcucauagaaaaacuuuucuuguggaauuaaauaaaccuucauguugacaguagucuuaaggugauuuuuuuuuguagacagugucucgcucugucacccaggcuagaguacagcagugugaucauagcucacugcagccuccaacuccugagcucaagggaucauccugccucagccugcugaguagcuaggacuacagacgcaggccaccaugccuggcuaauuucuuuaaaauuuauuuuuuguagagaugcagucuugcuauguugcccaggcuggucgcaaacuccugggcucaagugauccuccugccucagccucccaaagcacugggaguacagacgugagccaccgugccuggcccucauuugugcauacuuucuagauuguaaauauaacuuuuuauaauaaaaaauaaacaauagguuccuacacaguaugaucaaagagaugaucuaaauuuuugauaaaacuagugauuuguaaagauaccaaccaugcuugucauaauggaaccccaaaaaugccguuaaaugaaugagugacuccacacauggauguagaggaagagcucauucccuuuccucuucauacaaaucucucaaugcuacccuuagaaugaauaacuagauuucccugagccuaagaaaucuaaaagaagaccaaauggugacuuaaagggccaugauguagaagagguaguagaccuuuuuuccaaaagguaagucuuggcuaagugguuggcugcuuuuuuuaaaucacuaugugggacaacuggagugucuaaauuuagaauugugaaauggugaaucccucucacugacaguauucaagcacagucuggaagacccucuaacaggaugccauggaggggaccucagcauuggugugcaggagagagggauuacuucucagaucuguuaagauucuacaacucuaaaauaggcuaaauugauuaaaucauucaaaaggaaagggauucauuaauaugaaauugaccuggaccagugguucucaaagugagaccccuggaccaguaucaguaucacuugggaacuuguuagaaaucuugggccccaagacagacccgcuaaaucagaaagucuggggguggagcccagcauuccauguuuuaacucacccuccgggugauucugaugcaaauuugagagaaccgcugcccucuaccaucuucauuuuauucagugaagcuuauauuguugguauggcauucuaacaacuaugcuuuacuuaacauuauuccuguguaguauuagucuuacucuuuccaaaacagauuucagccuugucucuuaugugacuagaguucuuguaucucuuacagguguugggaaaucuucguuaguccaucuccuaugccaaaaucaagugcugggaaauccaucauggacugugggcugcucaguggaugucagaguaugugucuuuuauauuuuaguuuuucaauaauguacuaaagauaacugcuucaaauuacaugaucaaauuacaguacuauggucaagaucaauaguaauagcugggauuuauuacauucauacuaugugccagguacuaugccaguugcuuuacaugucccuucuuauuucaccuuuuuaaaacugagauguguagaugcagaaacuaaggcagagucaagauuugaacaguuuuucugaugccacagacuucaguuuuaaucacuaugccauauaucuagaguucacauagcauccuccguaaauaauucugccuaagcuugugcuauuaagacugccaacuuucagcuagaaauauaauguaaaggcaaaagcuccuggagcuucaugucugggucauuuguuccaucuuguguuuaggaauuagguauaguuuuaauuaaauuaaauaucuucccagauaucauuggucuuugcuaaugccagcuaguucugacaagucucucaucugcuggcacaccucucuccuuugaguuaagacacacauacggaaggcaagguaguuggcuagauugauaguuauuuuccuucuguucuuugaagcuauuguuccauagcucugauuuacauugcugcugauuagaaaucuuccguaagacuaauuauuauuucuuuuuaauguaauuucuucuuugguugcuuuuaaaauauuuuuuguguuuuuuuuuaaucuuugauauuuuguuguuuugcuaaccuaugucuagguguagauuuguuuuuauucauccuauucagaaguagucaugguucucaucucuuuauuuuucagaauuuuaagccauuaucugucuugccucauuucuucuaucccuuccucuugacuuucuaugagauuuuuguucuucauaacuguuaauauuucuccuugcugccuucuggaugauguacucauaucugccuuccaguuaacuaagaaucucuucaauuauaucuaaucugcuuuuuaauauaucuauacaguuuuucauuccaaguaccuauacuuuuuaauuucuagauguuccuuuuaguucuuuuuaaaauguaaaaauuuuccaaaauguccugauccuucauuauggugucugcuuuuuauuuuaauaauuuccaacauacuuauuuuaugguuucuuuuggauuauuuuauuuuuucuggaggagagguagcuaugcuccuugcuguauaugcuacucuacuucauggaaauguaucuccuuguauggcuuguaauucuuuaagaugaucacaucuucaacaggauuuuuuuccucucccuuuggaaguccuguaugcuguauugugaaaguaucccuauacagcgccuuuucauuucugucauugccaagaccguaaggauuucaauuucucagcucagauaauguaaaucuagauaauguaaauuccuccagcaucugauuguagcacagaccuauaguuuccauuucuuguggacuauuuaucuucugucuaccuucugucugaggucccugacagaaaguuuuugccguuucccugagccuauggacaauguuuuucuugucuugucuucucucuuuucacugacugggcaccucaucaaagguccggauuucaaaaaggcaucuauagucuagucuucaucacucacucacauauacuuuugccuugaaugcuggaaaacaggucugcuauuccugaaugggcauuaagacuccaggcaccaaccccugaagcuauaucugaaucuaugucaguucccacuucucacucugauuuuaaguuuuuucuucauuucuagcauuuggggauauuccuuucuuucuccuaacuuucucuugagcuagucuucucugccucuccucucuguacucuuucucucugucucaaaauauuuuuauagcauuucuauaaguuugaaguaggagcggaccuauuuugugucauuuuuuuuucuuuuuuguuuauuauuauuauacuuuaaguuuuaggguacaugugcacaaugugcagguuaguuacaaauguauacaugugccaugcuagugugcugcacccauuaacucgucauuuagcauuagguauaucuccuaaugcuauuuugugucauuuuagccaaccaucuuccuaaauucaguggcaacuuuauuuagguuugggagacccaauagcaaguucuggacaaauuuucccuuuggauuuuucuagcuccgauucugugaaagagcaugacauauugaaaagaaacuuagauuuaaacacucaccuccugagucaauugcccuucgcuucugaaagagugaccuuagacuaaucaguuuaccucuuugaggcaugguuauaucaucuggaaaacagaggucaauaauaugugcuuuauugagucuacagguuuguaggaaggaucagagaagcuuaauaaaugggaaguuauggucuaguccuuuacaaugugaaguuguaauugaacuuuaguccaauuuucugccccuucccuuccuccugcccuacuccuuuuccuauccccacccagugcccauucuauucauguuguucaccuuuugucuugguuuucuuucccacuugucuuauugaauuagcugaaacuccaguacaauguugaauagaaguggcaccaacaagcaucuuuguuucauucccaucucaugggaaauuuucaguauaacacuauuuaguaaaguauuugcuggaggauuuuuuauggguauauuugauuagauuaaagaaauguccuucuauuccuauuacaaugagaguuuguaucaugaauggauauucaauuuuaccaguugccucuucaugauaaucaugauuuuucugauuuauuccauuacugugguaaauuauguugauuaauuuuuugaauguuaaaccaaccuugcaauccuguaauaacucuaacuuggucuugugcugcucuuuucauauaucacuagauuuaauuugcuaauauuuuucuuagacauuugcaucuaaauucauuggaaagauugucccaucauuuucuuuucuuguaaucucauuguggguuuucuaucaggcuuaugcuaaccuuauaaaauaaguugggaaguauuaauuucuguaucuguucucugaaagauuuuauuuaagauugguauuuuuuuuuucuuagauauuugaaagaauucacaggugaaaccaucuggaccuaaguuuuucuuugcgggaaguuuuuaaguaacauuaaagaaaauaauaaaauaacuauauuccuucuugugucaauuuugguaguuuauguuuuugaaagaauuuuauguaaauugacacaaaaaaauuuuuuccgucuuacuguuuuucaauaagauaauugaacaauauucccuuuuucauuucugguagaaugauuuguggcuuuucucuuacuuucuugaucagucuuaccagagguccaucaaagaccaguuucugccuuguugauuuucucuauuguauguuuguuuugugcauuguuaguuucugcucuuaucuuuaugaacauacuuucuuuggguuuaauuuagugucuucuuucuaacuuguugacaucaguaauugcuuaauuuuuuucagacuuuuuuuuagagcucuaagacucuaaaauuucuaucuaagcacagcguuaacugcauuccuaaaauuuuuuucauuauuauucaguucaaacuauugucuaguuuccauugcaauuuuuucuuugacucauggguuguguagaauaugcuucucaauuuccaaacauuugacaauguuuauuaucuuuuaaugauugauuucaguuaucuuucauugugcuuagagaacauacacuguaugcuuucauccuuugaaauuuguugagauuugcuccauguccaguuuuuuuuauuguuuuauuuauuuauuuauuuauuuaauuuauuuuuuugagauggagucccacucuguugcuccggcuggagugcaguggcacgaucuuggcucacugcaaccucugccucccggguucaagcgauucuccucccucagccuccugaguagaugggauuacaggcacaacaccaccauggccggcuaauuuuuuuguacuuuuaauagagaugggguuuugccauguuggcuaggcuggucucgaacuccugaccuaagauacucuggccggggauuacaggcaugagccacugugccuggcccgacuuuuuuuguuuuauacagaugggguugcaccguguugccccagccuagucuccaacuccuaggcucaagcaauccugcaaccuuggccucccaaagugcugggauuagaggcauaagccaccaugccgggcccuaaacucuucuuuugaauaaaagcacagauagcaaacaaaauuaaauuugaaauaaagagguuuuuuuuuaacagaaaucaaaaggcuuauauguucuccaccccuuguuauaaaaugcaccuuaccuugggcaagcaaauucuaccugucuugaaaaagcaauaggaaauacugcuagucucuucucuaugagacagaaaaacuuuuacccagagguguugaguaggccagacaugguggcucaugccuguaauuccacugcuuugggaggccaggugggaggaucacccgagcccaaguuaaagaccagccugggcaacauggugagacccccgccuccauaaaaaaauguuaaaaaauuuuuuuaauuuaguuuuuuucuuuaauuuuuuuauuauacuuuaaguuuuaggguacaugugcacaacgugcagguuuguuacauauguauacaugugccauguuggugugcugcacccauuaacucguaauuuaacauuagguauaucuccuaaugcuaucccuccccgcucccuccuccccacaauaggccccagugugugauguucgccuuccuguguccauguguucucauuguucaauucccaccuaugagugagaacaugugguguuugguuuuuuguccuugcgauaguuugcugagaaugaugguuuccagcuucauccaugucccuacaaaggacaugaacucaucauuuuuuguggcuacauaguauuccaugguguauaugugccacauuuucuuaauccacucuaccauugauggacauuuggguugguuccaagucuuugcuauugugaauagugcugcaguaaacauacgugugcaugugucuuuauagcagcaugauuuauaauccuuuggguauauacgcaguaaugggaugguugggucaaaugguauuucuaguucuagaucccugaggaaucaccacacugacuuccacaaugguugaacuaguuuacaguuccaccaacaguguagaaguguuccuauuucuccacauccucuccagcaccuguuguuuccugacuuuuuaaugauugccauucuaauuggagugaaaugguaucucaaugugguuuugauuugcauuucucugauggccagugauggugagcauuuuuucaugugucuuuuggcugcauaaaugucuucuuuugagaagugucuguucauauccuucacucacuuguugaugggguuguuuuuuucuuguaaauuuguuggaguucauuguagauucuggauauuagcccuuugucagaugaguagauugcaaacauuuucucccauucuguagguugccuguucacucugaugguaguuucuuuugcugugcagaagcucuuuaguuuaauuagaucccauuugucaauuuuggcuuuuguugccauugccuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaaggugucaggaagggauccaguuucagcuuucuaaauauggcuagccaguuuucccagcaccauuuauuaauuagggaauccuuuccccauuucuuguuuuugucagauuugucaaagaucagauguuguaguuauguggcauuauuucugagggcucuguucuguuccauuggccuauaugucuguuuuggcaccaguaccaugcuguuuugguuacuguagccuuguaguauaguuugaagucagguagcgugaugccuccagcuuuguccuuuuggcauaggauugacuuggcaaugugggcucuuuuuugguuccauaugaacuuuaaaguaguuuuuuuccaauucugugaagaaagucauugguagcuugauggggauggcauugaaucuauaaauuaccuugggcaguauggccauuuucaugauauugauucugccuacccaugagcauggaauguucuuccauuuguuuguguccucuuuuacuucguugagcagugguuuguaauucuccuugaagagguccuucacaucccuuguaaguuggauuccuagguauuuuauucucuuugaagcaauugugaaugggaguucacucaugauuuggcucucuuuuugucuguuauuaguguaugagaaugcuugugauuuuugcacauugauuuuguauccugagaccuugcugaaguagcuuaucagcuuaaggagauuuugggcugagacgaugggguuuucuggauauacuaucaugucaucugcaaacagggacaauuugacuuccucuuuuccuaauugaauacccuuuauuuccuucuccugccugauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauaugucccaucaauaccuaauuuauugagaguuuuuagcaugaaggguuguugaauuuugucaaagguuuuuucugcaucuauugacauaaucaugugauuuuugucauugguucuguuuauaugcuggauuacguuuauugauuugcguauguugaaccagccuuccaucccagggaugaagcccacuugaucaugguggauaagcuuuuugaugugcugcuggauucgguuugccaguauuuuauugaggauuuuugcauugcuguuccucagggauauuggucaaaaauucucuuuuuuuguugugucucugccaggcuuugguaucaggaugaugcuggccucauaaaaugaguuagggaggauucccccuuuuucuauugauuggaauaguuucagaaggaaugguaccagcuccuccuuguaccucugguggaauuuggcugugaauccaucugguccuggacuuuuuuugcuugguaagcuauuaauuguugccccaauuuccuagccuguuauuggucuauucagagguucaacuucuuccugguuuagucuugggaggguguauguguccaggaauuuauccauuucuucuagauuuucuaguuuauuugcguacagguguuuuuaguauucuccgaugguaguuuguauuucugugggaucgguggugauauccccuuuaucauuuuuuauugcaucuauuugauucuucugucuuuucuucuucauuaguguugcuagcggucuaucaauuuuguugaucuuuucaaaaaaccagcuccuggauucauugauuuuuugaagaguuuuuuguaucauuauuuccuucaguucugcucugaucuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugucccagagauucugguauguugugucuuuguucucguugguuucaaagaacaucuuuuauuucugccuucauuucguuauguacccaguagucauucaggagcagguuguucaguucccauguaguugagcgguuuugaguuuccauuucuuuggcaucugugaugcuaguguuagccaguuuuguuguaaguguuagaaagaggacacauagaacuaggaagcugaauaggaagaugauuauaauggcgugaucauggaaggcgauuagcucuucuguuauaggggauguggcaucuugaaggccuaguugggcugcgugugccauuaagauauaugggacuuaaccuguaacuuaacuuugacaaaguuaugaaauaauuuuucuaauaucuuguugaaaaagucauagagguuaugagguuggcuugaaaccaguuuuaggggguuggauuccuuccuuuuucgucuagguuuuauguagacugguucuucaaacguaugguaggguggagggcagccacauaaccacucuaaguuaguggaagguuguucaauuauuagaacuuuccauuuugaagcaaaggccucucagguuaugaaaauuauuaauauuacugcuguuaaggagaugaaugagccuacagaugauaaaauauuucacgugguauaugcgucgggguagucagaauaacaucgggguauuccagauaagcugagaaugugcugugggaagaagguuagauuuacgccuacgaguauguuucuuaauccugaguucucguuugauugcacuguggucugagagacaguuuguuauaauuucuguucuuuuacauuugcugaggauugcuuugcuuccaacuguguggucaguuuuggaauaggugugguguggugcugaaaagaauguauauucuguugacuugggauggagaguucuguagauaucuauuagguccgcuuggugcagagcugaguucaauuccuggauauccuuguuaacuuucugucucauugaucugucuaauguugacagugguguguuaaagucucccauuauuauugugugggagucuaagugucuuuguaggucucuaaggacuugcuuuaugaaucugggugcuccuguauugggugcauauauguuuaggauaguuagcuguucuuguugaauugaucccuuuaccauuauguaauggccuucuuugucucuuuugaucuuuguugguuuaaagucuguuuuaucagagacuaggauugcaaccccugccuuuuuuuguuuuccauuugcucaguagauguucuuccaucccuuuauuuugagccuaugugugucucugcacaugagauggguuuccugaauacagcacacugaugggucuugacaauuugccagucugugucuuuuaauuggagcauuuagcccacuuacaauuuaagguuaauauuguuaugugugaauuugauccugucauuauaauguuagcugguuauuuugcucguuaguugaugcaguuucuuccuagccucgauggucuuuacgcuuuggcauguuuuugcaguggcugguaccgguuguuccuuuccauauuuagugcuuccuucaggaacucuuuuagggcaggccugguggugacagaaucucucagcauuugcuuaucuguaaaguauuuuauuucuccuucgcuuaugaagcuuaguuuggcuggauaugaaauucuggguugaaaauucuuuucuuuaagaauguugaauauuggcccccacucuguucuggcuuguagaguuucugccaagagaucagcuguuagucugaugugcuucccuuuguggguaaccugacuuuucucucuggcugcccuuaacauuuuuuccuucauuucaacuuuggugaaucugacaauuaugugucuuggaguugcucuucucgaggagucucuuuguggcguucucuguauuuccugaauuugaauguuggccugccuugcuagauuggggaaguucuccuagauaauauccugcagaguguuuuccaacuugguuccauucucccugucacuuucagguagaccagucagacauagauuuggucuuuucacguagucccauauuucuuggaggcuuuguuccuuucuuuuuauucuuuuuucucuaaaauuaucuucucgcuucauuucauucauuugaucuuccaucgcugauacccuuucuuccaauugauugaaucgacuacugaggcuugugcauucgucacguaguucucaugccgugguuuucagcuccaucagguccuuuaaggacuugucuguguugauuauucuaguuagccuuucaucuaaucuuuuuccaagguuuuuaacuucuuugccuuggguucgaacuuccuccuuuagcucugaguaguuugaucgucugaagccuucuucucucaaaucaucaaagucauucuccauccagcuuugcuccauugucggugaugagcugcguuccuuuggaggaggagaggcacucugauuuucagaauuuucagcuuuucugcucuguuuuuuccccaucuuugugguuuuaucuaccuuuggucuuugaugauggugauguacagaugagguuuuggugaggauguccuuucuguuuguuaguuuuccuucuaacagucaggacccucagcugcagaucuguuggaguuugcuggagguccgcuccagacccuguuugccuggguaucaccagcggaggcuauagaauggcggauauuggugaacagcaaauguugcugccugauuguuccucuggaaguuuugucucagaggaguaccuggccgugugaggugucagucugccccuacuggggggugucucucaguuaggcuacucgggggucagggacccacuugaggaggcagucuguccauucucagaucucaagcugcaugcugggagaaccacuacucucuucaaagcugucagacagggacauuuaagucugcagagguuucuggcuaugcccugcccccagagguggagucuacagaggcaggcaggccuccuugagcugcggugggcuccacccaguucgagcuuccuggcugcuuuguuuaccuacucaagccuuggcaauggugggugccccucccccagccuggcugcugccuugcaguuugcucucagacugcugugcuagcaaugagcgaggcuucgugggcguaggacccuucgagccaggagcgagauacaaucuucuggugugccuuuugcuaagaccguuggaaaagcgcaguauuagggugagagugacccaauuuuccaggugccaucugucaccgcuucccuuggcuaggaaggggaauucccugaccccuugcgcuucccaggugaggcgaugccucgccuugcuucgacucacacucggugcgcugugcccacuguccugcacccacugucuggcacuccccagugagaugaacccaguaccucaguuggaaaugcaggaaucauuugucuucugugucgcucacgcugggagcuguagacuggagcuguuccuauucggccauccuggcuccacccuccccacguccaguuuuauggucaauuuugauaaaaauuucauaugcacuugaaaacaaaguauauuuuguaauuguugggugcaguguucuaaauauguguuaaucauuuguuaaaucuucuccaucucuguuggguggguuuuuuuggucuguuuuuuucaucaauugcuaaggaauaaguauuauaaucuccaacaguaagugugaauuugucuauuccucauuuuaauccuguccauuuuucauuuauauacuuugagauuauauuacuaggugaguacuaauuuaugauuguuugaacuuccuaaaggauuuaacauuuuguuauuuuaauaugucccucccuauaucugguaauacauuguaccucgaagacuauuuugucugauauuaaaauaguuaaagccaacuuauuuuuaguuaguguuugugugguuuaccuuauuuacauauuucaacuuucaucuuucuguguccuaauaucuaugggaugucucuuauaaguaagauauagcuaaauuuuguuuugaugaccagucugacagucuuaguauuuuuauuugauucuugggccuugcccccagauauucugacucagaguugauuggugcccaagcaucugcauuuuaagaagcaucuugaugauucucuuauaggugaauaaugccuugagaaauacuggguaaggagugcaaucauauugccaaguggauaucaaaguguuuaaugacaggacuuauagagcagagguauaagacuaagaaugagaugcuaauaggaagcuaguacauauuaacgauaagacaaggagggaggggaguauagcugaugguccagagcaucuaaagaaggcagauuuuuaauauaaggguagaggaguaaugcacuagaaguagcuuuggaguguuagcaaggcauuuccuauuuucugaacuccaagguaauuagaauauugaaaagugaacagcaucuaucugagaggacauaaggagaaguuguguuuucaagguagaggcggagauuuguuaauagaaugagauugaggauaggguauaauggaauuuuguaaccauggaguaagauuccaggagaaaaguggaaauauuuggagaaggaaacaauuaggaguuuaaugauggguagaggaagcaaaagcagucugagaauaagaauaugagagaccaauuaaggacccaauauguauaguaacagaggauaacugggauauaaaugucuugaguguagcugguggcaaaguuuccaaaagaaacuuuaucucagcaguccccuguaugugagaguggagacuugauuuugucugcaaggaaugcuuuugugcaaagucccagagagcaggccaacaugagauuacuaguuaguucucaagacacugaccaaguuuuagaaguaauagcaguaauuccguuuagaaacuucugcuuugggacugggugcggugggucacgccuguaaucccagcacguugggaggucaaggucgguggaucacgugaggucaggaguuugagaccagccuggucaacauugugaaaccccaucucuacuaaaaauacaaaaauuagcugggcgugguggcacacaccuguaauccuagcuacucgggaagcugagguaggaaaauggcuugaacccgggaugcggagguugcagugacuugagaucaggccacugcacuccagccugggcaacagagcgagacucugucucaaaaacaaaacaaaacaaaaagacaaaugucauauaauuacguuacuggguuuacuggaaugaguguggcacuaauugauuccuuuaaagacagucuuaccugaauuguguuauuguggaagaaugggacaugggcugaaaaugauuugcuuuacuguucauuguaucuuaagccaguugacuucugucuuguuuuuuuuuuuguuguuuuuuuuuuuguuuuuuuugagauggaguuuuguucuuguugcccaggccggagugcaguggcacaauaauuuuggcucacuacaaccuccaccucccagguucaagcgauucuccugccucagccucccgaguagcugggauuacaggcacccaccaccacgccuggcuaaauuuuuuuguauuuugaguagagacuggguuucacaauguuggccaggcuggucucaaacuccugaccucaggugauccacccaccuaggccucccaacgugcugggauuacaggagugagccaccaugccuggccaugucuuccauuuuugagaagaaugcacugcgugagugauaacauaaguaaaaggcauuuuuaaaugauaaccuuaaguugucauggacauguaaaucacuuugacuguuguuauaauaaagugaacaguucuuuucuauagaaagaauaacuaaagcuuauaaagccuuuaccuaaauaacuugggagagcacuguuaccuguagcagcuuuuauauugcaguuauaguuuuuguuuuagugaaaccugugcgaagggaucuccagaauuaguguagauugaugaauacacacuuuucaaaacucuuagaaacaguugccucuuuuuuuuucuuuuuuuuuuaauuuuauuauuauuauacuuuaaguuuuaggguacaugugcacaaugugcagguuuguuacauauguauacaugugccauguuggugugcugcacccaacaguugccucuuuuacuucaaaucuauuaagagccaaccaaaaauagagaugauagcagugaugauguaauuguuuaaucuuaaguaccaggugaagcuaaugaguuuaauguauguacucaguaauuacuaacauuuuggauuuacuguuuaguacagagguguucauaacugaauugaaaagaaaaggaagaaaaguuuaauuuugugguauucuucauucauuccugucuuuaacuuugcugucccaagucuaaugggaguaaauacaaauacauggcuacucuuaauuaugaaaacaagacuuaaugaauuuagaauuuagucuuuucacaaacuauaaauaaggaaauugauuugucauuucuaguucacuuuaaugguaauuuaacucucuaauuuacacauugcauacaauugauauuuauugaauuccucuuuggacagccuaacaauguacagacacugggaagaaauuagaggaauagucucuaucuucacuaagcauaugaggugggacacuuuuuauugcuuacuuuggcuaggcauccauuuacauacuaauucauuuaauucucacaacaacccuaugaggcagguacuguuagugccccuauucauuuagcguggaagcaauugaagcacagaggcacuacaugacuuguccuggaucauauaguuaguaaguuauggaacugcgauucaaacccaggcagucugcuucaagaaccugugcuccugaucacuacucuguacugccucuuguuccagaacaguauuaagaaaaaaaaaaaucugauacuguucaauauaguagccaauagccucauguggcaauuuaaauuuaaauuuaaauugauuaaaauuaaaaaucuagcuccucaguuaaacaagccacauuucaauugcuaaguagucacauguugcuaaugguuaccguauuggacauuucguucuuucuuuuuuuauuuauuauuauuauuauuauuuugaaaaagagucucauucuguugcccaagcuggagugcaguggcaccauaucggcucacugcaaccucugccucccaggaucaagaauucuugugccucagccuccugaguagcugagauuacaggugcgugccaccaugccuggcuaauuguuguauuuuuaguagagacagguuucgccauguuggccaggcuggucucaaacuccuggccucaagugaucugccugccucagacuccaaaugugcugggauuauaggcaugagccaccacaccuggccuguauugggcauuucuauggcuguagaaaauuccaugggacagcacugauauagaaaacaaguguuauaguaguucaagaaaguaaguguaaaauuauccuaggcacuaaugauugaauggguggcuuaaguaaguggcuagauggacuguccccaagaagagggccauauuauaggugaaaaagaaggaaacaauaguaaguucaguucuggacauggugaaaggagguaucugugagcuagccaccuggagcuguccuggaaaugaaaugcugaagcucaaaagacaauucugaguuggaaucauauuuauagaaauaaucccgaaccacuagaacugaugcaauuucuaaaagagaaaauuuagaaaaagguugggguauauuuagagaguugaugggaaaagaggggucagagaaagacugauuaaagaaauaagaggauagccaaaaugaacgacaagagcaaagagagaugagaauuucaugaaagagggauugauuuuuaguaagaaacaguagcaauauaaggacugagacaggaaaaaaaaauacuggauauguuguaaagucucugcugaccuuugaaagugcaauggaauauuuguggcagaaaccaaauuauaugacuggcagagaggaaauagagacagagguuuaacucaauuuuucacgaaguuuagacguuaaauaaaagagugaauggguacagaauggcagggaaagugaagggcuuuuuuuuaauuagaaaaaaauaagcuugacugaaggcaaaagagcaguaacuggaagugaagagacagcaguaaccuuuacacuauucauuuguucauuucuuccuucaauacauauguuacauaccuccuugguaucagacacugugcaaggaacuggaaguauagcagugaaugagauaaauuaauuucugcuccugugguauauucuccuaguaucucuuuuucacccuucucucuuuguuaccaacucccuccuaagaccuccuaccucccuuccucucuuuaauaaugauucugcagguacaaauacuaaaccaaacuuauuagcaucuacaauauccacuguucuuucuugauguguaucauuuuuuuucuaaauauguuucugcauuuuaaaaguuacaaacaaugggccaggcgcgguggcuuacgccuguaaucccagcacuuugggaggccaaggcaggcggaucacaaggucaggaguuugagaccagccuggccaauauggugaaaccccauuucuacuaaaaaauacaaaaauuagccagacguggugacaugugccuguaaucccagccacuugggaggcugaggcaggagaaucgcugaacccagggaggcggagguugcagugagcugaaaucaugccacugcacuccagccugggugacagagugagacuccaucucaaaaaaaaaaaaaaaaaaaaguuacagacaaugaaugaacucuucaaaugaaacaaaaccuuauguacauaggucuugauuuuguuuucaagaaaaagucaaaagcugaauaaaugagaagguccaaaguggcagcaucguugaggaguacuguuccuuuuuccauuugaugaucagcuguacuguugcuuccuuuauuguuaagaaaauccuuuauuguauagcuguaaggucuguaaugacuuuaaguaucagauccuugaugaccugcuuuaaauauaaaacacacuucucauaguuuggcauuaccucccaucauguuggguucucaguauagcaccaaaguacuacuuacugugucaagagcaauacuuguuauaaugucaagcuuucccuuggaaauuacucacacaugugaaagauguaacaucauaacuagaagcuguaagcuacugauuuaaaauuguugggauucauuccaugugaauuggguuaaacuuagccaguauuaaguuggaaaggaaagaagacaccuuaucuucugauuuuaaaaggaaacaggaaaggauuugacuaggaaagguaauuugugguagagaagaguuuagaugagugagucagucuggcuugggaguaugcauagccugaaaggugcuggcuaacagguuugguacaaugcaaggcuaagaggguaugcugccuagaaauuuacauuggaugauggcuauucucagaggaguuauaguccuuuagaggaggcaacauuagguacuugaaauaauuuagagaaaaaaaaugguguacugcagugguugccaaacuuaaucauguaucagaaucaccuagggaacuuuaaaaaaaaaaaauacagacucuugagccccaucccagaaguuucaaggacaguccaggaaucuguauuuuuuaacaaacuuccuauuggcuuugauuuaguuugcucuuggaacuguacuggagaaacacuggaauucgguaaauaauaaacugaacauaauaaaaaccuggaggaugaguuauccuaaauuuauucauguauuuaauaaacaugucuaagcaucuaauauaugcuagauauuaugcuauuuucuagggcuaaaggaugaauaauacaugguccgugcccuuacacucagagucuagaagaagagauaucaguagauaaauaagacagugugcuuagugaaaugauagagguguguaggaugcuauggaagcaaauaggaggaguaccaaaccugcucugguugauuugggcccagaaggaagguaggaucagaaagacuuaacugaagucgcugagcuuuuucauaacagauaacuuacucuuuauaagaccucauacugcuuuuucucauuguuuugcuuagaaaucuugcuaaaacauauguuuuuucugcuugguuuaacuuuuuuacugcuaacuugacaugaucacauauuauaaguuauuuuugccauauaacaaaauagugaugccuucuauuguaauaugcagaauuaauuuccauuaucccaaaugguccucaacugcugcaacugugcuauucucauuuuucugucauacugucuuugaugucagucugauaauugucuucuuaaugucaauguggcuguuuauagaguagcauauuuauuuaaauuuuuccuuggccaaaaggauuuggacaaaaaaauugugaauaaguaaaaguguaaagcauuaaguugaauguaguaugugaguuuuagugcauuuuaugacaucuauuuuaacuacugagcuaucuuguuuuuuuaauuauuaugucaaagccaguagauacuuuagaaaucacauaauacaauucuuucauuuuauaggcaaagaaacugaggcuccaagauaccagggacgaucaguggcaaucaaggaguagaaucuaggccuccugauacuguaauagucccauucuaugaaagcagcaguucuuaacgaggggauuacagcagaaucguuuggagaauuguucaaaauacacaugccuaguauuuaaucccaaagguccugauucaguaagauuggcauguauauuucuuaaaaaaaauuaauucuuggaaaaugccgauguguacucaugaaccagcauacuuuaaucugcuugccauauaucauaauuuguuucugaauaguuauacaguacaggcaguaaaugccuauagagccuagacaugagaaaaagagagucuuuggagauaacugugagugagaaagucauuggaggguuuugagcaaaagagcguaugauauaacuugcauuuuuaaaggaucacucuagcuacuguauagaaaacaaacagggagguugggggaugccucuaguagggagaucagucagagaccauuauaucaauucaggcaaggagauagagacuuugaccugggugguaauaguggagauagggagaaaugaacagauuuuugacauauuuuuuuaaagucaaagaagcagaacuuguuggcaaaugcaauaaugcaauaugaaaggagucaaggaucagucuuaaguuuuuggcccaaguaacuggaagaauaaaauugccuuuuagaugaaauugccacaagaaugaguauugauagaaaagaaaagagacugaagaacuaaaccuugagacacauuagcaauuagaaaucagagagauaagaaggacccaaauggaagcugaaaagcacuagccaaugagauaggaagaaaacuagaagagugugauaucccagaagccaggugaaaaauguugcaagacacgagguggaucaaaugguggaguaaaaugaaaacuguuaauugaccauuggaguuaacaauguggaggucauuggugaccuugacaaggaauaguucauuggggucauuagggcauaaguucgauagaaaugaguucaaaagagaaugugaagaaaaggauuaccgcuaagaauagacaacucuuuggaggacuuuugcugugaaaaggaaaaggaaaguggcaugguagcuggaagaggacuugaggucaagagaaggauuuuuuuuagaugaggaaaauuaugccauguuuguaugcugagaauugaauuguguggugaggauuauccagcugagaaggaaaauuugaugguauaagggagagacgggagaacugguagaauuacaucuuuaagcaagaaaguggggaugggaucucaugcacagaaggaggauuuagccuuagggacauaggcagccuaagaaaacagcaagaaggaaagcagauuaugugggcacagauggagaaaggcagauaaauacaggaagaacagguuguagaagcuccuuucuaauugcuucugcacuaggaagcaaaguuaguuuuaacugaggauggggaagagauauuagaaguuuauaaagaggaaaaaguaugaaauaguuaucuggaagaggaaaaugguaaauuaacuguggaauugauugaaggacagcuccaaagguacacuuaaauuuagaaagaauccauucaucuugaaugcguauuuuuccgagcuccacauucgguugcuggguuguagacaugaaagaggguaaaagguggauauaaccaagaguggaauuuugucagaugaauacaaugugagagaggggcaaaggagugacuguaugauggaucaugaaauuuaugcuuaguuaggagggaggugaggcuucggaaguggaacagagagcugugaaagauguuaagauuaauuaacuauaagguccucuggaguaaaaauuauuaaaguauuaaagagaguaagcuuaaaagauaagagguagcgaucagaaagucagaguaagaugcugaaaugcuuuaaaccggaauaaggguacuuacuaguuuguuuaguggcuauauuaauuauuuuaauugauugauuuguuagguucaugauuacaaagaaggaaccccagaagagaagaccuacuacauagaauuaugggauguuggaggcucugugggcagugccagcagcgugaaaagcacaagagcaguauucuacaacuccguaaaugguaaaacauuuuuaaauuucuaucuuauauuaauggucuaagaguauagaucaucugauauguaaugccauagcaugccagacucaucuuaauuugagaaagauauaauguacucacaacccuugauuuaaaucugcauaguacauuccaguuugcguuucuacauuguaaccaucuaauucagaacauuaaacauuaaguguuucuauuuauauuauugucauaaacuaaauauugagaaauaaaaucauauuuuugguacuugacauaaaacauggaacuuaaaauguuguccucugggguugcucugucuccagugaguugaguaaguacaguaggaccauaggagucccauagucuuaagccagauaacacagagauagagggauuucuuucaucugccccuuagaaagagcccuaaggcucuuucucagcuaguuauaaagagcugcuuaagggggucuuuaugggugcagaaauuuuauccaguuauagauauucaaauaccuggagcagacuuccagauggagcuguguaauauacgacauaauuuccuuucauagaguaccuacucugugucaagagacuaaacugcuuauaccugugauuugccaauagaguuucuuucuuagucuuuuuaaaaauucauuuuuaaaaccuguuuuuacugugaaacauaauuucaacuucuguuugauuaauauaccaaaggauuuggcauuucccuccugguaaaugcauagccauuaauagacuucauuuaugcugugcuuagaucucacucaauauuagguaagcauugcauuuauucaguauguucauuccuuauauuccucuucugaugucuucccagaucaugagguguuguagacucuacaaaaagauguagagaagguucuuuucauuggauacauauuauagaauacagaaugagaugugucaguucagacccauauccuauuuagcucagaauucuaucugaaaaugucacagucuuaauaaagaaacaaagcauucauaaaugagacaaaaauaguuauaagaugaccuugauauaugccaucaucaugcaaaaagguauauacaaugguauauaugaauagaaugcauauaaauaagaaaaacaacaauaagacuaaguauagugugaggugaccucuuagagaaggaagugaaaccuaguuuagacuuauacuagagugaucaacuuguaucaguaaaauuacuugucaaauuaagauaucuaucugaucuggcacagagaagucugaauauauaacaccuuugauauuuagguauuuuugagacagagguacaauaaaaauuaugaauaaauaauagagauaaauaccacucaaauccuagaagcuauggaauucugaguuguaaacuuguaagugcugaagaagaaauccaucuaaucuauauuuguuuaucuuuucuguaccuacuauucauuagugauuugucuccuuuaauauuauugaaagaauugcauauauccuauguugauuuugcagauaagacugaaauauauuuccauuucuuaaaaguaaaaaaaaaaaacugcauuuauugaaaaaccuauuucuguguucuuucaccuuagcucuggaacauucuuccugguagaagcacucaaaguucuuuauuccaucuacuauccuuaguuuccuaagaaacugaacauaaggaucacucuauccaaaugcacaguccauauucuuagcgauaacuuucuucccuuaauacccuacauucuucccucucuaauagccuaggcuaguaauccuucagaaggaaauaaugaagugucuuuacuucucucccuuaagauuaagauauauuaucauaucacccugacuccuuucaucucagccccaccuugauucuucuagcacauguucuacaaagcaauaacucucagcccaaaugaaagagaaagaauaggggaaaaggguacucaaaugcccuuaaaagcucaaaagucuuaccuaaagauccucaguaaagucuucccuguccaucuaauagccaacuuaggccuuuguaauucuuuuacucccccguccaaaauucucacccauaguuuugccauauuuauagccuggggaaaaggaaagggagaaaauauaugccaguuuuuugcccuaaaauggagauuuuauucugcuuaccaccagucuuuacugucagauuaccugagugcaaauucugacuuaccaugugcccaaggacaaguuacucuacuucucugaacuuuaguuuucucuuguguauaaagauaauaauaauucuucauaggacuguucugaaaauuaaauuagauaacacauguaaagcacaauauuuaguacauuaguacugaauaaauauuagcuguagucuuuaauggugguucuuuauuccuuuuuuuaaaucugugccacugaugcugauuaaaaccccucauugaggaaggaagaguggguacaauuggauauuagggcaagugucagaucucuauuaguuucagacaccagaagagaugcagguuuaucuaagcuggcuggaacaagucagcuauagcuuguacaagcccuuuaguuacacagauggcuauaaaaacuguagaagccagcuaauucuaccucuucugcuuuucuuuuucaaauugacacauaccaccucuugaagauggaggaaucauugguuucauguccuauucacaaucuggguaauauagaaaaggguugggaguuugaaaccuguaguguuuugaccauaaggugauauccuaaauucuagugggcaucaaaguuuuuccucuuuugucuauaucuugcuguaauaauuaauucccugauuuuccuuucuaucuaggauuuuaauugauucucuucaguuguauuuuaguguauuucugggccucguuacauuuuguuauuuuucucaaucuaucaaaauccgugcauguacuuucuacuauccauacuucuuuacuauuuaaugucucacccacucucuuauaguggcauauuucuuuugcucuaauaacuaaaucucuuacagguaggaagcuuacauaacuaaucauuauucaaagaacuagaaaauuagacauuugaauagauuagucucagaugaucuacaggacacuauuuugucagcuaaagaauagcaauuguaucaaaucaguacuauuuuaguagauuuucauuaccuaauauuacuuuuagugaguauaaguaauauauguauguacugguaucuauggcaguacuguguacagugaagaaacaacauaacuuuuugaaugaauaauuucauauguacuugaaguaguuuugauucucuugauuaauaaagugguucuacagguaggaacaggcauggaguaggcacucaggaaguguugaaugaaguaaagaucugcuaaaaguuuaaugggauuucgucagcccuuguaaaauaaagaguuauaaaacugacagagaaagguuuauggcuauuuauaaauauuuguagagaaaauuuuaaaauaauugucucugaguuguuagucauacuagaaugcuagauucauuaagcaaccuaaugcuucuguuuacuaagcuucauuuggccaauugugaaaugaagaggaauuguuaagggauuaacauuguuuucucugauuauuuuagguauuauuuucguacacgacuuaacaaauaagaaguccucccaaaacuugcgucguuggucauuggaagcucucaacagggauuuggugccaacuggagucuuggugacaaaugggugagccaauuucacaauugguuugaaagauuguagcaaucacaggaauguacuucccugaauaacacuuuguaaaauguuugauuugcaaagauuuuucuuucaguguauagauuaucuuuuccuuuuaacaguaucuuucacaaagcaauaguuuucauuuugaugaagucugauuacucuucuuuucuucuauggauugugcuuuugauaucaugucucagaacucuuugccuaauccuagaugaugcagguuuucucuuauguuuuccucuacagauuuuaugguuuuacauuuuuauaguaaaacauuuauauaaaacauuuuaaguuuuauagguuugcauuuagauuuaugaucuaaguuaguuuuguacgagaugggagguuuugguugagguuaacguuugcauaugaaugucuaacuauuccagcaccauuuauugaaaagauauccuuucuccauugaauugcuuuugcuccuuugccaaaaaucaguugaccauauuaguaugagucaacuucuggacucuaguucuguuccauugaucuaugugucugucccuucaccaguacuacgcugucuuaauuauagucuuaaaauugagcaguaugauuccuucuacuuuauucuuuuucauaauuguuuagcuauuauaguuuauuuguuuuuccacaugaauuuuuagaaucagcuugucuauauugacaaaaauuuugguuggauuuuuauuagaauugcauugaaccuauugaucacauuggagagaauuaacaucuuuauucuguugcaucuuccaguucaugaacacaauauaucucuaaauuuauuuagaucuucuuuuauuucucuuaccagcauuguguaguuuucagcauacaaauccugugcauguuuuauuagauuuauaccaaaauauuuaauauuuuuuaagcuauuguaaauuguuuuuuuguuuuguuuuguuuuguuuugagacugagccuugcucuguugccaggcuggagugcaguagcacgaucucaguucacugcaaccucugucucccagguucaagcaauuauugugccucggccucccaaguagcugggauaccuggcugauuuuuguauuuuuggcagagacaggguuucaccaucuuggcaaggcugaucucgaauuccugaccucaggugauccaccugccuuggccucccaaagugcuggguuacaggcaugagccaccauaccuggccauaaaugguauauuuaaacuucaguuucaaauuuuccauugcuaguauaaaaaaaaauagaauugauucugagugcugaccuguaucuugugaccagaguuuuuuaguacaauccuuaggaugcucuacauagacagguuuauuucuuccuuuucaaucugugugcuuguugucuuauuucuugccuuuucgcacuggcagcaacuuccaaaaggguacuaacuaggagugauaagagugaauaucuaugucuuacuccaaucuuagggggaaagcauucauuucacuauuaaguaugaugucagcuuuagguuuuuuuuguugacaucauuuaucagguugagaacauuucuuucuaucccuaauuugcugauaguuuuguuaauaucaugaacagauacugaauucugucaaaagccuuuucugcaucaauugauauggacauguggcugcuucuuuaggcugucaguaugguggauuacguucacugauuuucaauacugguggauuacauucacugauuuucaaauauugaaccagccuuccauuccuuggucaugguguauuauucauuuuauguguugcuggauuugauuugcuaauauuuuguugaggauuuuuauccauguucaugacaggcauugguguguaguuuucuguucucauaaugucuuugacugguuuuggugugaggauaauguuggccucauagaauuaauuggaaguauuccuuccucuucuauuuuuuggaagaaauugaguauauuugguguuauuucuucuuugaagguuugguagaauuuaccaagagaccaucugggccuggagguuucuuauuugaaagguuuuuaaccacaaagucaacuucuuuaguaauuaggauuguucaaguuauuuauuucaucuuggaugaguuuuuguaauuugugauuuucaaggaauuccaucuauuucauuaaauuuuuuaauguauaucaauagaguuguuuauaguauuuguuuauuguccuuuugauaguugcacaguuuguagugauaugaccuuuuucauucugauuuugguauuuuaugucuucucuuuuucuugucagacuuguagagguuuaucaauuguauugauuuuuuuccaaagaagcaacuuuugguuucauugauuuuucucuauuguuuuuccauauacaguuuaauugauuucuacucuuauuucuuuccuucugcuugcuuuugguuuauuuuguucucuauagcuucuuagauuacuuacuggauaccuugcauuuuugccaauacaaguauuuuaaugcuauaaauuucccucuaaacacugcuuuagcugcauccugcaaauguuuaaauguauuacuuuuauuuucauuuaguucaaaauauuuucuaauacuccuugagauuuucccauaggcuguuuagaaauguguuguuuaguuuccauguauuuagaggcuuuccaguuauuuuuugcuauugacuucuagcuuaauuuuauuaugauccaagaacauacuuuauaugauuucacuuauuuuauauuugugcaacacccgguaugugaccuggguguuguugucucuguuguuucaguuuucagugucuuugguacacuaaguaggaucaaauccaugcaugcacagcuuuggcaaugagcucaagcauucacgaacuacuucaugggguugcuuucucacacuucacccugucuacagucucugccauacuuugugauuugcuggggcucccuuuuucgguccccaggccaaauuuucucaugcacuugcacaacugcaccuauguccagggccaagugguagaaggacaaagaauaaaagcaaugggaguuugccccacugucuugagauacaguuccaucagucagaaaaauuucccuucugggcccggcgcgguggcucacgccuguaaucucagcacuuugggaggccaaggcgggcggaucaugaggucaggagaucgagaccauccuggcuaacauggugaaacccugucucuacuaaaaauacaaaagauuagccaggcguuguggcgggcgccuguagucccagcuacuugggaggcugaggcaggagaauggcaugaaccugggagacggagcuugcagugagccgagaucacgccacugcaccccagcuugggcaacagagugagacuccgucucaaaaaaaaaaaaaaagaaaaauuucccuuccucuguauuuguaagcaggcguucccaaccccugguccauggccuguuaggaaccaggccacacagugggaggugaguggcaggugagugagcauuaccaucugagcuccaccuccugucagauuagcagaggcauuagauucucauaggagcgugaauccuauugugaacugugcaugugagggaucuagguugcaggcuucuuaugauaaucuaacuaaugccugaugaucugagguggaacagcuucauccugaaaccaucccccaaacaccuguccauggaaaaauugucugccaugaaacuagucucugguaccaaaaagguuggggacuguuguuuuugagcauucugcuuguguuauagccuuugccacaacugucaugaaauugcucagaagcuggcuuacaacagaaggaaaaauauuguauuucuacacuaucuccaaguauucguguguccccuuucuuguuucaugagccagaacuauaggccuucuucuggaguauucuguucacacuuuuggguuuuaagcugaguugcauucagacaaggggauauggaaggaaacugcuaauucaaugguucuucacauugcagucuuccuuaauaugcucacuauuaauuuuucagaguccucaaauagccacuucauguauccuguccagguuuuauaguugcauucacugggaaagacaggauagaguuugcuuauucugucuuaccuagaacagaaccccauuuucuaucuuuugauugaagcaagucuuucaaaggcuuuguuuucuguguggaagucuaauuguuaugugaaaccuaaauauaguauaaguuugaguauauauauguagauuccagcaagaccuaauaaagaauaagcacaacuaauuuaaaaccuauauuucaaagccucauugauauuuauuuccuaucucaauuccuuucaucacugaugucuucauuaaccuagcuuguucucuauuuucuacuaaaauuucuacuuaagaaacuuauccuuaaauuuaggguuaggagacagcauauucauaucagaaagaaaucugcauuuuugucagggaauucaguaaaaguucuauacccauuugcauuuugacacuacaguuucauuuugauucuauagauaaaccugcaaauguauaaaacaaccuuaauacauuggugugcuuuguuggugcauuauuguauagcaucaaaaaauuuggaaacaacccuaguguccgagcaacgaaagauucauugaauaaauaauggcauauccacauacuggaguaguauucaauguuuaaaaaagaaucaggaagaucucuaugaacuaaaauagaaagaucuacagaggguacauuauuagguuuaacaaaucaaaaugcagagaauauauaucguauaccuccuauuguauaagaaagaaaagaaauaauauguauuuauauuuggauaaagaaucagugaaaaauaagaaacuaauaaaaaugguaaccuauagggggccaggggagauggguggauggguacagugguaggagcaagacugcuuagcauauaucuuuuauaucaguuugaguuuuuagccauauuuaaacaauuuagguaaauuuuauauuauguaguuuuuaccacaauaacuuuuuuuaacuuuuuauuauagaaaauuuuaaacauauguaaauacaaagaauggaaaaugaacucccauauacccguugccuaguuucaacaauuaucaacauauagcuagucuuguuucauccauaucucuacccacuuucuaucuucucccacucucaacuggauuauuuugaaccaaauguuaaaacaucauaucauuucauccauauauacuuuaaaacauaagggcuuuuuuuuaacaugacaccauauaauuaucacagcuaaaacuuuaauaauaauucuuuaauaaccaaauauuauuuuaauuuccccaauugucucauaaauguuauaauugauuuuuucgaaauaguaucuaaauaagguccacugguuguauuugguuucuuaaguaucuuuuaaucuuagguucucccuuuuugguuguuuuuuuuccaaccuccuagcacuuuauuuguagaagaagauggcuguuugucuuguacaguuuccuauauucuggauuugcugauugucucccuguauugucuuuuaaacuuguuucucugaauucuaaaucuucucugaagugauaauuaaauauaguggucugaaagaugcaaguuuuuuugucuuuauuuuuccacccaguauuaugcauauaauaugauaccuggcugugugucucuuugugauguuaaggagcuaucagccuuauccauccaugauaaaguucuucagaaguuuaccaaagaagauuucaagauuaaauuuuaaauuggaugcugcaagauuuuaugaaaaaguuaaaaggaaagcuaaaaagagaaauaagagagcaaacuauauauguaugcuuuauaugugucagugugcaaggaauugugcaagacuauaugagagauguauguacaucaaagaugauauuugauagaagauaugcaaaacuuuguaugugagacagaaggaaacaguccuaaaggaaagacacucucaaaacuucauucccuaacaaagcgaauuguagcuuugaaccaugucucuuuaauuagaguugcuguugauaugaauaaucaaaggucuugaucaugcuauuauuggcuuugaugcaauaaauagaaugguaauauuuuugugagaugggagguuguauaguaaaacacuuguguuccgaggcugaacaguuugcugaggcgcuguaagauuauugugaagggcauaaauacuuaguaacuuugcccccuaccccaauuuagaauuucuguaagagaaagaaaaguaguguuaaaggaagaaaaaaagcuaugcucgacuggguuguagugauuggauuaugcaauauugauuuacugucauaaauugugcacaaccagauuuugcugacuguuguaaguugagcuuauaacgugucagaaauccaaaucuguuuuauuucuaauaugugaguagaauuuaaauuaauucaacagcaauggccucuguguucuuuucaguaaugagaaguaucauuuacaucaccacucuguucuuuggauaaauaaauuuuuuaaaaaauaaggauuguaauagccagugauccaaggccacuaacccuaagugguucuuauugcccguccucuaucucccauggcucucauuucaggaaacaacuacuugguacuaaguucuuuccuuuuacuauucauuuugcauuucagcuguuuccuuccauuuccauguguuuaauccaccuuucccaggcuauaguaucaccuauauuugauuuauucuaggcuucagcuucccuauuucuauuuucuuauucuucuuauuucuuuacuauucagacagaaauguguauuguagauauagaauuaaugcauaccccaaaagguacccaagaagcuugccauuuucucuucuagcacaaggcuugagugccaugcuaggcuuuuggguuuuugcuacgaugaggcuuaaauccacucucugcuucuacucugaaauauuccugagcuguuauguuaaccuuagaagacacagcuacauuggaaguuaaguccacugacuguaauauacuugaugggcacuuaguuguucaauuauucaguauuguucaauauucaauaaaaacaugggaccaaauuuugagaaguuagaugaauagcuggaaucugaugaugaggauggauugauaaaagaacaaguagauggaagaaguuggaaggaaaguagguuuguaggugaaggcagcaaaaaucaguuaauuuucaguaaaauaguguaacuuaguugcacuuaaauauuacacaucuacaccagaaagauacauucuauucaccucuucauuauuauuuaucacagggauuaugaucaagaacaguuugcugauaaccaaauaccacuguugguaauagggacuaaacuggaccagauucaugaaacaaagcgccaugaaguuuuaacuaggacugcuuuccuggcugaggauuucaauccagaagaaauuaauuugguauguauuuucacuaaugcaugcuuguauuauuaucggguaaagacaaaacugaagacauauucaaauaauauauucuagugaaagaagcuuuauacuugaaaucaggcuauuuggauucuagucuaaacguagucaagauuggaaucaacauaucuagacugagagaugugcacagucacuucagccuuuuauguuggucuguuggaauguuccaacuuuauucuaugaauaauuuaaaucauaggcuucuuuuuuugaaacagagucucgcucugucgcccagacuggagugcaguggcgcguucucagcucacugcagccucuaccuccuggguucaagcgauucucaugcuuaggccaccugaguagcugggauuacaggcauguaccaccauguccagcuaauuuuuuaaauauuuuuaguagagaugggguuuugccauguugcccaggcuagucuugaacucuugacuggauuugcccuccuuggccucccaaagugcugggauuacaggcgcgagccacugcaccuggcccaugggcuuuuucuugagaaagguuuuuaaaaucacaccaaaauuaaaauaaauugauuaaaguggcacuauaagcauauuauucuugcuuuuaaaaagccucuuagcuucuuaaacuacaaauuuuaccuuaaagggcaacguaacaaauacaugaaaaaauugcaaaccuuaaacuaggagugcuucauaaggacuaauuuauguacacuuaugcauauauagaggauugagucccuugaugagauaacuagcucaaugagaacugagcgcguaaaaaagcuaagaaaugguugucauguaagccuguuaggaucccagaaaaagauccuggccagcaauuucagucauggucauguuguucacaaauaggauuucugcaacugugcacuggcauuccagaaaugcagugguggugguguaauaguacuagugagcaacauuuauugagcacuuacggguugaaaacuguuuuaguuauuuacauacauuaucucacaugcaucaucuucacaaucaacucuauaagacagguacuauuacuauccucuuuuuaaagauaagaaggagagacguaacaagaccaaggaaguuuacccaggucaauuaggguauucagauucagagccugugcucuacaguuaagccucuuuugcacuuaauuaauccuucaacucaccuugagaauuuggcagcugaaaaaacucuuagaaaucaucuagaccaacaguuacccaaaucugauuguguauuuauauuaccaauaguaccuauggaaaauuuugaauaaccgucccacagcuggagcuuuuuauucaucaagccuggcaggaggaccaggaaucugcaguuuuaacaaauaacucaggugcuucugaugccuuuauucuaugaaucaauguuuaugaacacugcuugguucagccccaccucuacccccagcuucugccugccauuccauuguuuuuuacauucugcuuugcagcggagagccccucauuuuucucagcugccacaauggaauauuugaugugcauaccccagguagucagcacugaaccaugauauuccaaaggauucuugcuauauagauauauaauauucuuguugaagaagugcugagauuacuuugaacauuauuuccaaagagaaauuuaccauugaaaacacuuaauuuguuucagcgcuuacuuuaauauauuuuagaauguaucuguuucuagugccuguggguuucucugauaaucgcgugcauguguguguguguguguguguguguguguguguguguuauuccuacuugccuuacaaagccaaggccaucuuuuaacugugagucagauguaaagguacucagguagugagacuuuagcacauacagucuccaaagaguucaaauauaacauguuuuuggccuuuaucaguguacagcuucaagaacacagcacacauaacaauaggagagggucagagaaugcagggaagaaaaaaugaggaggaaaauugaauacaagaguuucaaaaagaaauagcaaucagaaauucagcaauuaaauauaaagccucaaauaaaaacuaauguaacauuauuagugcuaacaucaguuacuguauaaauuuccuuaaaacuguagaaaaguaagaauuaacaaauguauacaucaaagguggaaucagaguuaauaaauaacugccugaauacaugcaaauuguuuaaauuauaaauaggugaaccauuacuuauuuucuaaaauccuguuaggcuuauuguacccuguaaaaacuuuucucuguuacguauuuacuuugaagcgaucauauugaaguaucuucccuaguuaauaguccuuucucaagcucagucaagcuauuuggagcuauuaauuuucaggcuuuucccucagccaugauaaauggcagauggcucuuucagcucuaaauuucuuaucccaaaaaucauaguguuucucuaggcuggucgaccugaaauuauggaaccauagaauuaagguuuuggggguguuuuuuuguuugcuuguuguuugcuuuaguuuuuguauuuaguacuucagcucuauuuagaauugucucaaacuuuugacauucugaugacuagcuaaucaauaucuauuuuauaaaacauuucuaccacagaucuaagguuugucucuuauaugccccaauugcuguagaaauguguucaaacacuauuucaaauaccauaguuagugcaaugauguuucagucuacauaauccauauauggaauuaucuuuauugugguaagugcuuguugugccugaaaauucaaucugcuagcauuuucuuagauugaagagaggaggacuaauauuuuacuacccaguauguccagguauggauuauuuaauuuuucacaaaaaucccgugaaauaaaauauuguuauccccauuccacaaaucaguaagcccaaauuuaaagguuuaguacccuaaccaguguuacacagaguagaaauguugggauggauauucugauuuauugcuugcuggcuuugaagaccccuaauuucuaguacucugugaucuuugacaacuuuguuguagccucucuuuuuugugguuuuagagaauguauuaucauuucuggcuaaaauuuaaagugugagccuugaaauguugcauaugaauaaaauaggaggcuucauuagaaaggaaucaugugggccuggagauugcaaaaacagaauaaauguaauaauaguaauuucaguaauuucuaggggcacagagggucuauagcuaaaagacaaaauuucauacuugcaaaggagcuuacaugauagcccuuauaguuuggucuuagguacauuucagguaaaaaucaaaguacucuaucucucaaggucacaagucaauggugacaagcaaaaaaaaaaaaaaacagcuagacuggaauuccagcggauaguaggccuuuuaagguuuuaaaguuauuguaaugauuaauguuccagaucguuuugucccuucugggcccauuuuuuuucccuauaauaaaauuccaucaaagaguaguaauauaucuuuauuaucaaacaauaguaguagauguuuauuaccaaaaauaauauaucuuuguggccuaccaaaagauguaguaccuugcaucuaaagagaaauccuuggcaauuguucuguuuguucuuugcaccucuaaauccuuauuuucuugcuuucuccgauucauaugaacugcauaguacuaaauuaguugagcacuggugauuaacuaguacuaaaagugaaaugcuuacuguuuuucauggcucucucucucugguuuucgggguaaauguagguaggucacuccaguaguaccuugguuuugauauuaguaaaauauuaguaaucuugucuuccucuaugaauuauuugaugaugaauacacugauuugguauacucuaaaauuguuuaaauuacaaagauuaagugaccuuauuuuccuuuaauacuuuccuccuuugugcaccauaauuugaaaauuauuugaauauuuugugagaguauugugccuaauaguauuaugccuacagaaauaugcaacaggauaaguuaugaauagcaacgagcuuggguuuccuaacuuucaauuguggaucuuauguuuuaucuucuaggacugcacaaauccacgguacuuagcugcagguucuuccaaugcugucaagcucaguagguuuuuugauaagguaaugguuucaauuaaguuauuuuuaaacuuaauuuauauauuaugagaguuuaaaauuuuuuuguagaauccuaugaccuuuauuuuuuuguccaaaacuucacagccuggaauaauccuuguuuugaucucucuuaucuguugguauaauugcccaaggccugcugacguauuuauuccaucaccaguguucucuaaguaaagggcaaaagcuacuggauuuaaauggggguuuuaaaaagauaucuaauuccucucuuuaaaagaauuucuacuuacccauuuucuagcucuuuuuuucacuuauucacccucccacccccauaaaggcacugaacugaggagauucugcuuaaagcccugaguucuuuuugcucuccuagcuguuaauauucucuacauaaauguuacuguuaccuuuuaagguaaugucuucuugauuuccuaguguuucccucucagaaauauuugcauuccaauuauugacucucugcuaacauuguuuuauuguccucagcuggaaggaaaauguagaaugacucagcauacugguaaauuagagcacucuuugucuuuccuucacaaagccauacaacuuuauugcacauaguauugaccaaguuuaaguuguuuguccaaugcucacauugcauaguaagguaaaacaggaugucuuucugcauguauuauugaaaaagguuaauuccuguguuauauuucuuuuuaagugacaucuccuaagaaaaucaucuuccccauagcucuucuuuaucaaucauuuuuuucuuuuaacuauuuagggauuuaauaauuggcccuuuuguucagcauuggauaagccccaccuuuagauaauuugggauuuaauauuuggccuuuuuaucagcacuagauaagcuccagcacccuccucgauuaauauuaggccacuaggaaaauuuugcuucacugcaaaacuucuuaacugauaugugggaaauaggguacagaugugccuagaugcugauuucccucaguucucagagcagccaggguccucaggguggggggguugggugauuggcaaccgcuuccauuuucuccagugugcuauacaaauauuagcauuuucuacgugugccaugacaugaaaaauguugugcagcacugcaaggagccagauuuuuugcccacauuguuuucaaacuuaaaauauaagaauuuccauuugguuuagaucuauggccccaucaauacaaaauucugucccuuaugagcaacaucuuauagaucugcccugaccuggaaagaucccacaguauguuguuuaaauuuaaaauuuuauuaguucuaaaauuaaaaaauaagauauacuaaauuacauccuagagaaacuggguuauugauugguauaauccgaguugucaggcaaggcuuuauuuuuuaaaaaaucaggaguacacauugcaagucagggguaaagaauuaugaccaaaaccaaaaagguaacuucucuuuuauugccugaaucacaacaaaauguauguggguuaggagguuggccagaccuccagacugaggugguugccugaaaccaaaggagcugacaaccagauuucacccaguuuucuauacaucaguucuuccagaauuuagcauaaagauuuauucuccagccgggcacggugccucacgccuguaaucccaauacuuugggaggccgaggcgggcagaugacgaggucaggagaucaagaccaucauggcuagcauggugaaaccccaucucuaguaaaaauacaaaaaauuagcugagugugguggcgggcgccuguagucccagcuacucaggaggcugaggcaggagaauggcgugaacccaggagguggagcuugcagugagccgagaucgcaccacugcacuccagccugggugacagagcaggacuccaucugaaacaaacaaaaaaaaaagauuucuucuccaaaaggaagucuaacuccuucuccagccucuuucaacuaguaguaauuccucacgcuccagaauaaucagauuuuccuguccugccauagagaggaaagggaaucagucuccuucuugguuuuugugggauuguuuuaagauguacacuaaugauaaaccaacuuuucuaccucugggguaagugaaugcaacuuugcccuggugucuuguggcuaaaaauaauccagcuauagucuccaagacagcaagaaucuggaugaauggcugucgcaccagagagagcaagcuggucuuggucuuggaucuggaugaauggucuugguguugaaucuggaugaauggcuguggcaccagagagagcaagcuggucuguucucauucagaggaacucuuagcugcauaauuucagauuugaaugucuuagaguucaucuccagcugaucuguauuauuauccgauuaacuuuucuuaucacagcaggucuauguaaagaaaauacagcuauuccucaacuugcgauaggguuauaucucaguaaaccccuuguaaauuggaaacauuguuagucaaaaauacauuuauuacacccaacuuaccaagcaucgcagcuuagccuagccuuccuuaaacaugcucagaacacuuauguuagccuacaguuaggcagaaucaucuaacacaagccuauuuuauuaaaaaguugugaauggcucauguaauuuauugaauacuauacugaaagugaaaaaagugcccauuguaugggcacucaaaguacaguuucuacugaaugcauguugcuuucacaccaccauaaagucaaaaaaucguagucaagccauccuaaaucagagaccauuuauaauacuuccucuguaaccauugcaguuucucaagugucagaacagaauuuauuauucuugaaaauguuuuucaucaucuggaaacauggugcucuuuaggguuuacagcaguuuugggaaaaaaugaaaacauggugcucuuaaacuuauuacauuuggacauauauuuugaggguuucuuuucaauaauggugauggauuugugcagauacaucugcugcuugaacauguuuuuucuacuuaucaaaugcagguaauucugaaacuacugaaguaagggugcaguuaguuaaaaaaaaguagacaauuuacaacagucauuagacugcuuuugauguugugucaucugucuauauugaggacauauagaauuugucaccacuuacuauagggauguggugguuugcuauguuaaacaguccccucuuuaagaaauagacaagacuauuguagcaggcaagugcuuuuuuuauuuuauggaugcuguuuaguaccuuuugggacugacugcuaggaaacuuagagucagauuugcugucauacucuaagaauugcauaggaucuuauaucauucuaucauuauuuaguuuuuguuauucauuuauuuuuugaucuaucauuaaugcguuuuggaaugaggcaggcuuuuauggaaauacucucacaauucugaucucauuaacaccagauuuuuagcugacuguacuacaugucuacugcuauggaaaagauucuuaguuuggauauauuccuuuuaguaccauuaguggucguugcaguuagccacuuuuugcagguaugugugcuaagccuuuaaaaucuuuguuuuucacaggucauagagaagagauacuuuuuaagagaagguaaucagguugguaucucuuuucuugauaaaauagauucuuaaauuuugauaggugauuuccaaauuuaaguucagaaguaguuuuaaaaaguuggggaaagcccuuuauaggcacaagcaacugauuuccuucuauccuguuaaauacaaaaggagaaaaucagaacaaagggaaaauaaggaucuaggaaacaaauauaaucuaggaauaagauuacauuauaaaauagaagaagaaaauaauuugcuugggacuccaagaguauacguucagggucugucacaauacaaauaauuucuauaaaagucuaguagguauuaugagauuuaccuucauucuuucugauuuagaugacacuaucaccaauuuguugggaaauguuuuccauuuggguaagauuuauuuuuauuauuuaaucugugguuuucugaguaaaaccucagaaaguuguuuuuuuaagaaacagcaggcugacauacagaaauggaaaagaagggaaaaauuacuauuaguauuugaacuuuuauugcuugagacuuaaugcaauuaucuuucuugccuacagauuccaggcuuuccugaucggaaaagauuuggggcaggaacauuaaagagccuucauuaugacugaauuacacucauccuuuggaagagugagcaagcaguggcaguuuuucacagcucaucuugcuguguucaauuauuaccaucacagccuuuuaacaaaaucaucuuaaaaugcuacccuucagccuuacccuuuaauggaaaaaugaaaggaagugacaauacgggagguccaaacuuugucccuguucucuguguuccuuaccuuucugucccuguguauagauuauguaaaagccuuguguaaauaugagauguugucaaaaugaugcaguaaaugagcaaugacaguguacugcagagaaaauuuacucuugccuagaacuggaggguuuuuaugggucuguaauuuucccacacucauugcugaaagcuuaauuaaguacuucaaaaacguaucuccauuguuuuaccuucuugaggggaacggucuuguuaaccagcccugaguugucuaccccaaacaaucucugucauuuucaaagaugcaaaaugguguuauuuaauugucuccaccauugucacacacaggaaugccuaauaauagcaacccuugucucccucuucucuccuuugcaaauggcucagugacuggaagaggcggacuaauagccagaguuaaauauaaauacaaauuaauaauacauagagaacagcaauaccagaaaaaaagaauucugguaaaaugaugugaaaaauugacagcucccucacucuuaagguugcugcuauauacagucuagguuuucuguuuggaaauagguaggguaaaaucuaagaccugcacaagggcagugagagacauuuacagccuccucucuauuuguuuuuuuaaggaaaagucaacuccugaaaugucccuuagcuauaaucagaaaacuaagaauauuauucugugucaacaauguauuuauggagagaaguaaaaauaaguuccacagcaacacauuuacaugaauuaugaacuaggauucuuggauuucauaaucacuccaaagcuuuuuggggaugguguguguguguguguguguccguaauuguucaucauuacuuuuuuuaaccuaucuuuuugcuugcuuaaucuucucugccccaguucuuccugaguauaugaauuugauuucuaaaaacaauuuauucaacacucuaucacccguauucucucucuggcucugcugcaggucucugcacuccugauuuugcuccauacuuuuaaauaacaauaauaaauaua

SEQ ID NO: 21308 - RNA, 213601 nt, Homo sapiens
gccccgccccgccccgagccuggguccugugugugccacaggggugggguguccagcgagcggucuccuccuccugcuagugcugcugcggcgucccgcggccuccccgagucgggcgggaggggagagcggguguggauuugucuugacgguaauuguugcguuuccacgucucggaggccugcgcgcuggguugcuccuucuucgggagcgagcuguucucagcgaucccacucccagccggggcuccccacacacacugggcugcgugcguguggagugggacccgcgcacacgcgugucucuggacagcuacggcgccgaaaggcaagaagggaaggggucgccggggaggcuccacacuucuugccggcccgggggcccgggguagccaggcgcgggccaaggaggaagaggggacagcccuggcucucagcugccuuugccgccgccguccaguuugaaguggggcauuuaaagaccagaacccgcaggccggggaggagggagagggcguccaggcagacggcggugaggacugcagcaggcggccgggaggcgcguccacccaggcgccgagcccacagugucccucccgcgcccuagacggacggugcugcgggcacgggagggacacuuuguccccucccaguccaccuuccuccugcagcucagacccgaggggccgggaaggggccugagcagggaagggacacaggcguccugaaacaaagcuuuggguugagggcagaggcgaggagccagagaagugaacuccuccuuuccguggccgcucuugucauuuuucucuuuucucuuuucaaaugggcuauuuguguguuaauuucauuugguucuugggaauaacgacucaccgcguugauuuaaagaaagguguucguguguccguacuuggugguuuuagugugggacaugcccugcgcuuuuguugacaacagagcugucccuuacguuuguguaggauaaucuuuauguuuauguaacuuggagaaaucuaacagagugaaagugaaguuucugcguaaggcucccaaaauguaugauaggaccuucaguuguucugguauuuugaauuggaauuaaggcaggaggggaagaacauucuguuuuuaucuaggugggggaaaccuguuuaaguuuuguuuguucuuuuuuuuuuuuuuaugaguugaguauuaguucagccuuagcuacuugaaacgugagcaggaugcaucuuuaacucuuaguauuguaaaagcaaaucuaggaucacugcucuuaaaacuacuguguguaaagauugagaguguaaauucacaagcuuauugauaaagaugaauccggaacuuuugguuuugcucuaaucgauggaggaagaugcagugguacaaguuagucucuaguuuucugguggguaaauauuuucaaaaccaacuaacuuuucuuuuuuuaaaucugccuuuuaaagaacuaaaauuccagauggcaaacucaaugaauggcagaaacccugguggucgaggaggaaauccccgaaaaggucgaauuuuggguauuauugaugcuauucaggaugcaguuggacccccuaagcaagcugccgcagaucgcaggaccguggagaagacuuggaagcucauggacaaagugguaaguucugucugacguugccugugcgaaacacuauucacuuugucugugguuucuccagauuuauuuauacuguuaauuaauaccaaccauuguuauggcaacaaucuuuugauuucaauucaucauuuuucuucaacucuguguuuuuugaaaaguuggauucaaagacuuuuuuguuuuuuaaccuuucauccuuucuacucuuuaagguucagaguuccucuacaugacucaguauguaaaguuuuaccauuggcugcuuuuuguugguguauggccauagaaugcuuggaaguguuuguucugucuucugugagguuguguugcucuuagauaacaaaagaguaccagcagguuauuuaagucuuugaccacucaugacaaucaucugguaugauacugaaaauauuuacuggggaaagaaacagauuaguucuuaagugaagaagcaguaguugagggaguuuccauuuucaucuuugagaauucaucuucauuaagaaacuuuuuuuguuguuaaugggagaguuaacaguuucuuucaucuacuauuccauuuugaaacaggaaaccuuucgauggcacauuguuuauugugaaaggaaaauuuauguuggggguggugaggcugagaguaucagaaaccucugugguuucugcauguugcuuucagacaaacuauaauuucacaagaagaaaucaugaugggugucaguauccagagaagucaaucugaauaccuuacagagauuuacucagaaacuguagcugucaguauccuaccuuacuaaguaugauuauaaaauaaauuuaagauguagcuugcugcuuugcaaaaauuaauaauucuuuuuuuugaagcaguagcacuguccuggauuuauuaguaaauguuuggaacacauuaugacuuuauuucauagauaucuggggccaauuauaaguuuaguugaggcaagacucaguaucuuuauaacugaagaaauggagguuuuaaaaacaaauuucuguguaaggaugugccaaagcauccaugaaaucaugugauaacauucaucuuugcuuugauuugcuccugucuguaaauauuggcuauaaaagccacuaucaguaguaguagcaacauaugaaugugacaagauuuccauuauuuucauuuauucugauggaagggacacacagaugaaugacuggccugucauucuacaggcaauggugcuaaaugcagagccagaauauuuuugccagauaaauagccuuaguuuugggcuucagugugaccuauuuacgcuucugccaauuuauucaaauuguuauauuaaagugcuccagacagaaugaugucauagugucagaauauugcaacuugcugcuugggguucaguuuugauuuuagcauuggauacuuuagaauaaggacuauucaauuggaaaaauagcauauauuugucaagcacaaugcugccuaucuugucuuugcuaaagagugugcauuugaaggucacucucacugccuaaaucauuaguugggguaagagaaggaauucaagguuuuucucuaacuuaucugcuacguaaguggacagcaaaugguucagauucuauaaaggggcuguucuuuuucccccacccuccaacuuugaguggucaguguuuguacauuuguguuaggacaucaaaucaaaaagauuuauauaaggauguggugagcuauaguuacuauaaaaucauuauuuuugaaacauuaaaaaugauguacacaauuuuggucuguaacugguuguuaacauaaguuuuauucacuuuuaauuauuucaccaugaguuaugguaaaauagaugguuauuugauaguuaaacaucugcuauuguuuauuuuauuaacccuucuguggguuuagguuuagucucuccaauugagaaacuugacccaacaaggaaaucuauuaucaaaagucucuacuuagugggaugugggugcggguguuggcaaauguacauugccuguuugucuucauuauuugucaaagaugaaaaugguuguguucauuugugaauguacccaggggcuuuguggagagaaauugcauaaauuauuaugaaagaauucaguauguuuauuuuuacuguaagauacaguaaauagaaaggcauugauaauuacuaauuggcaguauauaaguguguaguacagaaacaucccccucuuuuguuuaucuuuucuuauuuguuaguggugaaggaaguggcucauaauaucaacauuguccugaugauuacaucaggaacuuuauuauuaguucugaaguuaaucccuugacacauuaccuuuuuaaaaaaauaacugcaauagcaugaauuuaguuugugaauaacagaaaauagcaauuuucaagucuaauugguagguauguaaaaggcagaguuaaguguauaguuaauauuuuuuucuuaugaagccucuuugcaaggguagaucuuggaaguauaaauaugaacacaagcuucaauuucaguguguuucagcuaccaauaaaguaaaauaacuauuuuuacagggaauaaugaagcagucuuggguuguaggggaaauaucuagugaguauguaguuuuaccauuucuuggccucuggaauuuaaaauggucaauugaaauucuuuccaauuaauguucuguuuucagagggcaggcuuuugcucuaaggucacugagaauaggagagcguaauugcucaguuguguuccuuauaagauguagaguguuuuguaacagaaaaucaguagcacagaguuagcauagucuauguuuugaggaaaagaauaguagauaguagcauaucccaaaacaucccauuacagauuuucuggccuuagcucuguguauguguaauuugauagccgacccagaagcccucacaucaguggaugcuuauuugauacagugauagaaguauuaaucaugaauacauaucuagguucaagugcgccagaaugaaauguggagucuguucugaagcuacucaagagacaagguuucuuaaacacuuaauaaacauuuuuugagggccuacuguguuuccacugagugcucguuacuggggauaugaagcuagacaagacauaaucccgccuuugaccugucaaggaacucagagaacaguaucagagccaaacacauaaauggauaauugccauguaguauggaaagggcuauauuacaaaccccaaguacagugggaacagaguagagaacauccuccuuguuuuucuggccaguguugagacaguuuucugucuggauucugcuggccauugccuuuuaggaacagcauuauuguguucuuguuggaaaugcugaggugagaguaaggaaaugauuacuaaucaguaugguuggaaugauaauuuauuaaugugagguuccugagcaugguuuucauaagaaucuuagccaggugauggaaaauagaagaaacaauuuuccaucuaauagauacuaaauguacugagcauacauggaugcuuaggaaauuagaaaauaauuaauugaugcugaagagcaaagcacucugaguaccugccucaaauuuuuguuuugcuguccucgucauuuauuuuaaauuacauuaccaaaagaauuuaaaaagcauuuaggaagugaugaugcccaguaggcuuuuccugccuuuugcccucagucuauuuaguacauuuuucaagcuugaaauauaauuuacacuccuuuuaauuuaauugugaucauaauauauuuuaaaguuugucaaucaaggaugcuuggauuauauauaaauauuuuaaagaauacaagucaacuuucuuuucuaagcugaguuccucauaucucugaaagauauuccauguggacuaagacagguuuuagaugccuguuguuuguguuuacuaaguuggagacucuuacauuccuagagccuuaaaaccagggauaucauucauuugaauuauacuucuugacguauuuccuuuuccucacugaaguuguuccaccuuagcagaaucauggguugugguagacuugguuaggggauaauaacaaauugucuggacaguuuuguuuaguacucaguucaguuuugaauuuguguugugauaaaugaagugaucccaaaguuugguacaugacuucuuagaaaagcuauugauaaagugaaagauuuaaaggaaucauaugaagacuuaccuugguuuaucccugugauauaaggcauucauauaaugcaggccuuaaucaguuaguagucuuuuaaauauuacagaauuuuuagcauugagauuuugaaucuauuucuuucuucuuuuuagaaggugcuuuaugugcuaucuguugauuucaucauucauuuaucaaaucucaacuauggaaagacagacauuuccaaauagcuaugccauagaguaaaauguaguaagugcuuuaagguaguauaaauaaagugcugagauguaguacgugguagaggugaaccguugcuugcuaagggugaaaaguugguguagaaugaagcauggaggaggugcuggccagcucauggguuggaguccagugagauggaggacauguuagguugaaggaaugauagauuguugaguaagagaggggaaguuaggguaagaugauagagguuuugauugcuuuugucaaauaauuuugucuuaauuuauuugguagaaaaccauugaaggcuguuaaucagggagggaaaacuucagggcugugcuuugauagaauacuuacuugacucuguaaagcuugaauuaagagaaaaaaacugaaagcaagaguaaugaucaagaggaauuaaaacagucugggcaagaaauaaugaaaugcuggccuagauacuuggaaguagguguagcaaguguugguucagaugugggaggcauuuuggagguaaaaucuacaggucuuggugaccccuuagaauuagaggaugaaagagaaggugcagugaaagugacucuugagguuuucagccuaguugacuccgaaggcagugaugcacuuaaugagguaaggaacguaagaaggaaaagaggaagugugcggguuaguuuuuggccaugcuaaguucaguguaccagagugaauuucauuuaaaaucagaaaauuaaguguacaguucaagagagaaguagaaacaagagacacauauuugguagauauucucauagagauagcauuucaagcuauauaacugucagagauuucggaggaagaauagagggagcaaugcagagaaaaagucagauaauugaauucuggggagauugagggguguaauuaaauaccagagaaggaaagagaauccuacauagauuagugaugagaaagguagaauuaaaccauaaugacauccuagguacaaacagcuuuaagaagaagauaaaaucugaaguucugauaaaacuaaguucagauucaaguagagaaaaccaaacagggugaaaaauuaagaagucauugaauuguaugauuagaggccauuauugaccuuuguggagcaguuuaacuuaugugauggggugagauuaaaaugaguauguggauuauuuaaaaauuguucuagaacuguaacaacaaugaaaaggaagggaguucuguuagcuugaggauuugaacaucauugaaauaacucuguguguguguguguguauguauguguguguguguguguguguguaugugugcacacaccauaggagagguucaaagauuggugggaaaaaaaaaagauugaugggaaaggauguaguuagggaauggccuaagaugcaagggaaaaagaaauaguugaagcaguagcauucuagauuaaacugugggagggaaagaguaggaacaaguagaaggguuaaucuuggcgaauaaauguaacuuccacuuacacaggaggaaagcaagggaauauacagagaaguuuugagggaauuuguaaauuuuauauuggguugucaggaagugauuuaaggcauaauauuuauaauguuuaaaccauguuuuuaauuuuuauaucaugaaauaugcaauauauguauuuuaacuagucuucuagcauuuaaguggguaaauaaguaaaaaauuaaaauggaaaucaauucucaucuuuaauauuaaguuuaucuuauuauacacuugcugugacuuagaggaugccacagugcuauuuuuaucuacucugcuugggcauauauuaauaauauuauuacaauuuuacuaaagguuuuuuuuguuuuuaaguauuuguagguugcuaauuuuuuucaaguaaugaaagacacauuuugaaaauauccaacacauuuuauagguuuuuaacauaguuacauuuagaugauuguugagcuuauauuaucuuacaguaucaaugaaaaaaguauuaauaguuauaauauucuaccuguuaaaagauuuaaaaaaauauuaaagcccuacgucuuuuccugagagccucuuggguuugaagaaaccagaggauuccaugucagcugacaggaacacugaccugggcuuagccuuauuuccugcuuuucugcacagaacauuccaggcuuuuuaaggguuuuaggcagcaugaguaacuuuaugagcuaaaagagcuucuaaaaaucaugauccucaacaaacuguucagugcccuuggucuaauuuucauaccuuugcaaaaucugcagggauuuugccuugugauggaauguaaaauauggaagggagaagaaauauuaagaaggagauagggcuaacuauguucuggacacagugcauagcacuuuacauuuccucuuguaagaauuauaauauccuaagagguuucccgaagaagaacccugcccaagguuguaaagcuaguaaauguuagggccagauccuagguuugcuugauucuaaugucuguguucacaguaugaagagugaagcacacugcuccauggaauaauaugaugcuuccuuuuuccaaaggaaguaaaucaaaagggcauuuccccuccuccacuuccauauuugauauuaucaaauucuucuccaaacuuuguacucauuuuuaggcagcuuuauucaauguaguuguggauaugcuauuuguaauauaauuuuccugagagguucguccuuaccuuguuugcuuccuccuccucuuccuccuuucugccaucaaauauuuguugcacaucuacuauaugcaaaguuccauauuaggugauagagagagaccaaugagaaagacuguucuucacuuucaaggaaguuccauucucauuuggaagaaagagagugaacagaauacacaauugauauuuuaauuacaacuagucaguucuuuaauggugcuucuuaaugucaaucuucugaagacaucuucguggaaaaccauaaaggucuugguaauuuucuguaaauucagcugugcuggacucaugaucaauuuuauaugccaacuuuguuuugcccaauuaauaaucuauuaaaaaaguguauuuuuauacuuuuuuacacuguacauuuuuauacuuaguaaaauacauuuuuauaauuuuuauauuuaguaauuauuugcugcauuaaaauggaaagaacccaaagaacucuucgguaccuguuauuauaaagagagagauauauauauacuuuaggucacuguaauaagaaaccucuucuaacauuuauaggaggaggacagggcuuucuuuuuuuuuuuuuuuuuuuugacacggagucucacucuguggcccagguuggagugcuggagugcaguggcacgaucucggcucacugcaagcuccgucuccuggguucacgccauucuccugccucagccucccaaguuccugggacuacaggcgccugccaccacacccugcuaauuuuguuuuuguauuuuuaguagaaacaggguuucaccguguuagccaagauguucucgaucuccugaccucgugauccgcucgccucggccucccaaagugcugggauuacaggcgugagccaccgcgccuagcccagggcuuucuauauuguuuuuaagaaugaggcaguucacuugagaguauaugacuugauucaguguaacugaaugcuccaugaagugaggcguguuuuauaaugaaagucuuauaguauaggcacaauuccuuacuguugaaauuuucauuuuauuugguaagaguucuuuccuauguuucacaggcugguuugaaccuuguuugcaaggaauguacuaucugaucuaauacauuuuuauuaccuuuuggcuggaaguuuuaauuaaggcgcagucagaaaacucuuuaaaugcaagauuauuccaagaauaaguaaugacuuugaaaauucuuauagcauuaguaaauccuguuuuuguauuugugcuuuugcuuugauaugguugaauauauguaucuaaauacauauuuauguauuggaaugcauagccaauauauuaauaauauauuuuuauucaugugaaacaaugcauguacagagagagucuccuuaaauauuucuaauacauuuaagcaaauacaaaacucaguuguauauugguauggagacaguuccugauucucaaguccagcuaucaggguucugagcaguaaccuuaguuagguucuaguucuguauuucaauauugacacgucaaaaggaauugguccugguaauuuccaaauuuuuugagucaauggcuauaguggaauuuucagccuaauuccaauaauaaauguuuugccuuuuaguucaacagaaaagagcaauauugcuauugaaccaauucuuuuaugcaccaaucggugcccuacaaaguucaucauuuuauaaugugacuacagauuuguucuuugucaaagcucuucuguguuaguaccaagcuucauucuaggaagcaauuuagguauuucuagaagagguguaaccauuugaaucugaacuugacccugguggugagcuugauuuucucucuaauauacugccuuuagaaaagcaauuuuucuuuccuggcuuuugcagcuccuugcacauagcagguauucaauaaauauuuauugaauggaauugaauuugaccugcuuagaagucauaguccugauguaggguuauucauuuuuggcagaagcugucauaaaucacaggguuuaauaguaauccaacugaugaacugcgcacccaguggcauaccguaguucagcauuguauguugcacuuucccaagugcaaauuuagaaaacaguuuagccuacagggccuugaugaacugacucuggccuauuucagaucucucguacuacucacucacagccuuccuuccuaugcucugaucuuuuagaauaacugcauuuacuucucucuuaacaugcuugcucucuggugucucuuaagccuuagcacacuccuuugccuagaauacuccuuuuggcaaauuuaaguauguauuuccugacacucuuauguggagaugagugagcugcugcuuuucuccuguagcaguuuguacuugccuccaucauagcacuaaauucuccuguaauucuuuuccuaagccaccagucuuucccacuaggcagcugcuugagggcaggugugugauuuauuccuuucuguguucccuagagccugaaacaaugccugccacauaaauguuuguugaauuaacaaauggguccugaaguuuacguaaauuugcaaauggaauaaaauaaaaauguaaaugaguuuagcagggaucauuaauuauaugccuaauuuuaauuaaauugugauacaguuagaaagaucagcccgagauucagaagauacaagcucuuguauuggauuaaugauauuuuaauggucccuuaaucuuucuaguucuuaguuuuuuuaaaucuggaaaugaauggauuggguggaaucuuuacuaagaucccuuagagcaagaauuacauugcucuuaaguuaauuauagagaacuacgucucuucugccagacucuuugcaucucuuugaaucaggaaguauguucuagucaucuauaauuuccuagcucuaagcucaguaccuggcauauaguaguucaagcaauuuccaccugauaaagcaauaaauucccacauggaauuacaguuuuaaauaaagcaaaugagaaaaaaguucagauaaagaauagugaauuaaauauuuguaaaacauaaacguuucugucaaagaauauuuauguggaaugucuggaaaaaaaauaccugacagaaauuuuguauguaucaguuaaaaaguucucuaguagaggaaaugaauuugaagcuaccugguccccaaacuagaagaaaauaauguaucagucugugacauguuacaccaaguuuuauguugcugacauuaaacuaugccugcuguagaauguugguggcaauauucuugguauuuauguauacuugugauaguauuuuugguuuaaauaauuuaaaaaccauauucuuuuucaagcaggauuuguuaaauaauuggcauauuugggacuuaaucuuuagggcagaaugaacucugauuauacuaacguaucacguauuaaaaaggggguaaaaaaagcucugucagccauuuucacuauacuuuguaaagauuugcuguuauuuaguaaaugagaugacaucuuaccuuuccaaggacuuucuuggagauaaaaauacuauuauuacuuuuuaacuaagccuauaccuuuggauuauuaauuugaauacuugauacuuuagaguucaauuguaaaaauaaaggaaauaauacaaucaaacuauuugugaaaaaaaaauagcagucaaccaauccauuaauuuguugguuauguacucagcaauucugcuuuaaggcauuguuuacaaagaggaagaauauaagaucaugcccuggguuaaugugaaaaacaucuuaaauuagaggcugaugguuggaaauuugaaccagauuuuucucuccaucuacucccucugaaaaaaacccugauccccagugauuucuuuuuuuuuuccuuuucuuuuuuuuuuuuuuuuuuuugagauggagucuugcuuucuuguccaggcugagugcagugaugugaucucagcucacugcaaccucugccucccggguucaagugauucuccugccucagccuccuuaguagcugggauuacaggcaccugccaccacacccagcuacuuuuuguauuuuuaguagagacaggguuucaccauguuggccaggcuggucucgaacuccugaccucaugaucugccugucucggccucccaaagugcugggguuacaggugugagccacugcgccuggccaauuucuuuaagaaaguaagugugauaguguguauaagaguacccuuuaaauuuguuaguuccuugauuuauuguguucguuaugcuugaaguuauuauaguucgauuguuuauuugucccaggcacuuuuaugggugcccagaggcagauccauguuuuauguccccugaaacuuauaugauuugaaagaaucuuucuaaauauaaagaauacgaaaguacaaacaucaaauuguuuaugaaagugaauuuuuuuuagaaugagaaaaauccacaaagcacuauaguuuuuaaaaagccgguauaucuacaagugauuagagaaauaaucuagacuaguuuuuggcucuguacauuuuauacuuugauuaucuuccguuaccgcauauacuuccaguuuugggugucaugaaacacauucaaauugccagauuugaauuggauuucacuguucccaugguaggcuagucagcauugugggcaccucagguauuucuaaaaccaucuuuuaaaaaaaguucuauuacagauuuaaaaaauauuguauuuauuuaagguguauaacaugaugcuuugauauauauacacauagugaaaugguuacuacaucaaauaaauuaacauauccuucaccuuccauaauuaccuuucugugguaagaccauuuaaacucuguucucuuagcaaauuuucagaauacaguauuauuagcuauaggccucaugcuguacauuagaucuccaguauuaauuauccuacauaacuucaaauuuguacucuuugaccuucuucucuccauuucuuccccuccccaucccuggggcccacccacuguucuacucucuguuucuuuguugcuuaacuccuucuuuuaagauuuugcaugugaaaaugagaucauauauuaauaguauauucuuucuuugccugccuuauuucaguuucauugggauugcugacaguaauuaaaccauuuuacaggagugacuguaugccucacauauaccuuccauuaaacccaaaguaaaugugucuucaauucaaauuuccauuagccagauuccaaaaauacccacagccacuccagugccacccaacaggaggcuuuagccaauuauguuuaagauauuauacucuuaggccggguacgguggcgcacaccuguaaucccagcacuuugggaggccgaggcggguggaucacaaggucaggaguucgagaccagccugacaaagauggugaaaucccgucucuacuaaaaauauaaaaauuagccaggugcgguggcaggcaccuguaaucccagcuacuugggaggcugaggcaggagaaucacuugaacccgggaggcagagguugcagugagcugagaucgugucacuacacuccagccugggugacagaaugagacuccgucuuaaaaaaacaauaaaauaaaauaagauauacucuugacaauuugacaaaaaaaaaaaauacaacgagggccuuagaagagagccauguaucuuuaugaucuuuaugugaacauuuaaccuuuuguaagagugcugucccauuacacuauauaaugcuacugugcaauucucaauuauuucauuugaaaguuauuuauguaaagaguugauuaugcccuuucuggagggauaagaaugugguggacuaacuuacucuuggcuaaaucacaugaacauguagaagugaauacauuaguuggauuacuaccuucucuggccggcagaagguacuuucaguucugcaggcagccccugaacgccccagugguugggcagcaccugugaugggaugacugaaccguuauaugccacauguuuauaggcgugguagacaguauggggagguggaaaagacugguucugaccugacacacauuuacuacuuaauaacucaguuauucaaauugcaccucuuuguuuuauuguccucgggguucagaacaguacaccaaaacgcuaauuaacaaacuaugagacagcaacagcugggaauucaguguaguaaaauaacauauaaaugugagacauugguugucaacagagaaggcccauuuccucauuuuuauuuaaaaaaaaagacuaucagugauauacagugauuagcauacuggaguucuuuuaagcuaugcacaaugagguaucuuagaauuaaacuuuagagguucaaaauaaggauaugauauagaaaagauugaaugguaggagaacagaauaggauuuauuuauauuaugacaaacgugacuaucaguuaauaaauuggagauaguaaguuaagaucauuauuuauauuauggaaaaaugaagaaauaggacaugguucucuaacuuuuuaauuuuucugugaaauaaaauauuaugacuuauuuuauuuuuaucuuuguuuuuagguaagacugugccaaaaucccaaacuucaguugaaaaauagcccaccauauauacuugauauuuugccugauacauaucagcauuuacgacuuauauugaguaaauaugaugacaaccagaaacuugcccaacucagugagaaugaguacuuuaaaaucuacauugauagccuuaugaaaaagucaaaacgggcaauaagacucuuuaaagaaggcaaggagagaauguaugaagaacagucacaggacagguaagaagaauauuucagauguuuugguguaaaggucauuuauguugcuuuuuacuuaauaguuaaccuaaacgucaccauguaauuguuuugggguaaaugugagucgcuuuguauauagucaugugguacuuaacgauggggauacuuuacaagaaaugcauuuuuagacaauuucauuguuguguggacaugauagaguguacuuacacagagcuagaugguauuaccuaccgcacaccuaggcuguaugauguagccuauugcuccuaggcugcaaaucuauacaguauguuacuguacugaauacugugggcaguuguaacacaaugguaaguauguguguaucuaaauauaccuaaacauagaaaagguaugguaaaaauacuguauaaaaggccgggcguggugggucaugccuguaaucccagcacuuugagaggcugaggugggcggaucacuugaggucgggaguucgagaccagccugaccaacauggagaaacccugucucuacuaaaaauacaaaauuagcccggcgugguggcacacgccuguaaucccagcuacucgggaggcugaggcaggagaaucgcuugaacccaggagguggagguuguggugagcugagauugugccauugcacuccagccuggacaaaaaaaaaaauacuguauaaaagauaaaaauggauaaccuguaauaaccuguauaacaugcauggagcuugccagacuggaagugagugagugaacggugagugaaugugaaggccuaggacuguuacuguacacuacugcagacuucagaaacauuguacacuuaggcuacacuaaauuuauaaaaaaaauuucuuuuccaauaugaacagccuacugucacauuuaaacuugauaaacuuuuaauuuuuuuuaacuuuuugacucugguauuaacaauuagcuuaacaaaaauauuuucuuucuauauuacccuauaagcuuuaaaaaauguuaaaaaauuaaguuuuaaaaaaaauuuuauaaacuuuuuaaaaacuaagacacaaacacacacauuagccuaggccugcacagugucaggaucaucaauauuauugucuuccaccuccacaucuuauuccacuggaaggucacacaauauguaacuuuuucagauuggcuucuuucaccuaacaauuugcauuuuagcauggagcaauaacaugcauggagcuaucaucugugauaauagugccuucaggaauaccuccugaagggccugccugaggcccuuuuacuguuagcuguuuuuuaauaaguagaaggaauacccuauaaaauaauguuaaaaaguuuauaguauaguaaauacaucaacuaguaauauagucacuuauuauaauaucauuaucaaguauguguuaugcauaauuguaugugcuaugcuuuuaugugacugguggcacaguagauuuguuuacaccagcaucaccacaaacauguaauauguugcacuaugaccuugugaugacuaugacaucacuaggugauaggaauuuuucaguuccauuauaaucuuaugaaagcacuaacauaaaugcagucugucauuaacugaaauguccuugacugaaaugucauuacgggguucaugacuguauuugcuuuuaacauuaauagcuuuaugugaauuuacuuaugauaguagcuaguucaugagacaguauucucaauguuuuaauagacuucauuuucagagucauuuuagguuuacaggaaaauuauucagaaauuacaguucccauaaaucuccucugcccaagcaguuucuccuguucacaucuugcauugguguaguguguuauaguugauaaacuauuguugauacauuauuauuaacuaaagccuagaguuuacauuaggguccacuuuuuguguugugcuguucuaugcuccauaaaugcauaauguaauauauccaccauuacaguguuauauagaauuguuucacugcccuaaaaaugccccgugaucuacuuacugucucacuucccccccugaacccauggcaaccgcugaucuuuuuacugucugugcaguuuugccuucuccacaguguuacauaguuggacucacacaauauguaacuuuuucagauuggcuucugucaccuaacaauuugcauuuuagguuccuccaugucuuuucauaacuugguagcucauuucuuuaugccacugaauaauacuccauugugugguugcaucacaguuugguuuuucacucacaccuugaaguacaucucgguugcuuccauuuuuuggguaaucauguauaaaguugcaauaaauauuuguguguagguauucauguggauuuaggcuuuuaacucauuuggguaaaauaccuagcaagauugcuagauuuucaggguaugcauaaguuuagaaagcacauaagaaacuuucaagaaaguuuguaagaaaccccuugacugguuccaaaguggcucuacccuuuuucauucccaccagcaacgaaugacaguucuuggugcuccacauccacaccagaauuugguauuggagacaaguguuuuaaagacauaguuugauugaaucugcggaugugguagaugugggugggagauguaacuuccaucuguguauuuugacuuaagugagaaacugaacugggcuggcaaagacugaauugacaucaaccaaauccuaauuuuauagccaggauucuucauuuagauauccucauucaaguuuauuguuuggccauucuaauguuaaauuucaggaucuaucuuaaacaaaauaaggaaaaugauagaguuuuccauuucugggcuauuuuaaauauauauggaauauucaugauagugauaguuuauuuagauuuccaaauuggaaaaccaauauuaaugaaaauauauagugucuuaacauguuaguuaaauuuuagugugagacucuuaaccucucuguauuuaguuuucugacauaggaaaaccuuuaagaaaccucuaauauuucuuucaggucagaaaaacuggccucauaggguuguaaaauagaaaauucaguuauggagguaugugaacucuaaauuuucuaugaauacuggccaaauacccauaacaaguaaaaccaucaaauucaaacauaaaaaacccucuuccagguguaaaauggcauaauuauauauuuauaauuuauaauuuucucucucaauuagagaugaacccaaacauacucguagacgucuaaccaauuauguaacuuugggcucgucacuuaauauucuugggccacaguuuauucaucuugaggguggugaaucuuccuguugccuuuuagcauuaauuaaugcuuuaaaauucuccaggaauaacaagaggaauuugaguugccacagugugacagaaguaagguagagaaauauuauagugauuguuuauucuuguacacuuuucaagaagugcuaacaucuugggaagucagauauuuauguuaaauuuuuauuuuucacauuguauuucugccauugaccuaauaaaacuaaguucuuuacaaaugucuuuauaauucuuuuuucaaauuuaguaguuuugaaauucuuccugauccagccaagucauccauuaaauuuuacucuuuaggguaucaguacauugacaaggcauauaacuccuuugacuaggaauuugaguggauacaguguuuuaauuggauguaaucauauaugaugugguaaacuuguaucccacuuuuacaucuucuguggaaacuugaaacauuuucuaacucaguagauguuuuauaauuuccauuugauaauuuugauaguuuugcuuauguggaaacauuucaugggagacauuuaaguuuuguuugauaauguauagauucccauagauuuugauagcucucauaaugcugacuauucacaaugaggucacucauucuguguauucuugccugcauuuuaaguguccaagugaauuuuguucacuguccuaaaugcaacccuaagacaaaauuuauugguuucuaugcugauauagcauauccuuaauuggauauuacuguuauccuuguucuguuuacugacaauguucuguggccagcuguguuuaugcagaauuuacauuugauaaauguuucauaacaauucauaauaauguaccauucuugguacaccauaacaggcacauaaacuuucgaacuguguuucuuuuucuaguaauauauuuggacacauucacuucuagguucccuuaggauuccaaaugcaaacugagucuaaaaugugccauugcacauggagcucugaggcauuuugcucuacagaacacagaagagucuucuuagcauguuuucauuuacagaguggccucauucugaauagucagcauuaugagaucuauugaucuaugaaaaucuguacauuaccaaucagaaccuaaaagucucccaugaaauguuucuacauaagcaaaacaaucaaagguaguuaggcaacaaaguauaugguuuaguagaaugacuccaccuaaucgguaugacaacgcugguuacugggaauauuauaaauucacuacagaauuguuucuuugauucuguaaguagcucacuagggacauuacuauaauugagcuaaaaaugaaggacaguaauaguagaaacaguaauuuggaguuaauugacuuaaucaguauuacuucaugugauucugcccgcuuuauugaagaaauugugcuggaugaguacaugaaucaaaaugcauauuuuaauguuccugcaccucuguugugucaacaauaaaugcggauuguuauacauuuaaggggagaugagaaaaaauuuaggugucaauucugaacugauugcuuuuuaaaauuuuaguugauuguuaaugaugaaugaguagcccgaauuuuaaagcaauuuuacauaaauguaauaaauagaaagauaaagaaguaaauggcauucaauacauuuccuaguuacuuagguccuguguagaaggagagagguagaaauuauagucacauaauuguauaugcuacugaaguagauauuuagggcacagugaaagucuuuugccuugagaguagauaaugauuucuaguagagaaaaggcaugagcaggcugcaugccucccccgacugauacaguaaaccuucaucuuuuauaucauuuuucccaaauuguuguuguugcuggugcucuguuguuuuguucuuuuucuuucuuucucuuuuccugcaaacaguucaaugucacacugaguuggugcuacuccagcugggugucuaaaccauucugagcugacauuucugggaagaguaauucagugauuucugacaagcauaaagcuugcauguguauguguguguauguguggagagaagguaaagaacauguggagaagucuguaguuugaagcauagagaaaaggagaaacucuaaguauuauauuacuuaaaguuuuaguggcgcaaguaaaaauggaugugaagguugucauugcuaacaaauguauaauugauaggaggcauuucuaugauuuuacuggcaguuucaucaguuaaccauuuuaauaguaaaauuuauuucuucugaaaaguguguauuaaucagcugcucugcaaggucugguguuggccacuguguuuuuuaaaacacucagaugauggccgaaggauacugagauuuucccuauuuuugaacugcuugagugagccagggugcuacaacccauuuuccccuccuacacacugcuagacaaccacuggaaaaaaagucaacugagguggaaaaaauagcucugccuuugauagacugugaagaaaauaaagauuaacaaaagcucuggccagagaggaaaacauagauguugccuuaacauuaacauuaaugucauuucagagccuuugaaucaugccuuaauaaccaguguuguagaaaaaauaaaugacaaaauggggugugugugugugugugugugugugugugugugugugguggaggguuacauguucuguaguuaaaaaaaguauuugacauagaaaaauuagcucuagaagaagcuagccuguauuuaaaaggcuucaggagcauccggcagaaauauuuuucuccauugacuguuuggcuaaacaaagaauaauuuguaaucugcuccauuaauaaagugccuuuccccuuaaaggacuacagaucacuaugcuugcuguuucuacuuguguugguuauuuacaagauaguguaccaaaaaacauuuugcaauugguacguugaagauacaugguuaaaaguugaaucaaaagcaacagcagccacaauaauaacaagagcaacaacaaaacaaaagcugcaaacaaaccuacuuucuuuccuuauguuacuguaugacaucauugcuuugaguaaagaauacaguaguauuaauuuaaaugcuuaaauuuauauuuauacaaauguugauagcauggucauugaaauaguuuugcaaguccucacagguuuucaguuuaccauauaaagagauugaucuguauguguaauuugugcuuuaagugguaguuuuaauaguuacuggaccucacaguuuaaugggcauguuuauaaugcuacaucaauuaccacauuuucucauaguucuguauauugugagaagaaaaugaaaaaagugcuguuuaacuaaguacaggaauguggagccaggaaaucucaugcucugaugccauuucuucucccaguguucuuuguaacuuugguuggcuuccugacuccaauuuacauuuuuucaguuauuaaauuauuuucugguuauucauaacauuuucaccucagacauuucaaugucacaaaugaaaauuaaguuguuucagacuaaaugcuacuguugcuaccucagucuguuaauauuucaacuuuaguaguaguuucuauaguaaaaauauuguuuuuguuauuauaacaauuauuugcaagagaaucuuaagaagguuugucuuuuauaaauaaauuauacuauauuggauaucuaugaaauauguaaugauacaugaaagggaauggcuuauauucaucauuaaaauaauuuuacauuuaaaaaauuaaccuaguuuuucuguuucuccuuuuuuuguuuacuaauggugaaaauugcaauuauuuugaauuugaugaggacaaaggaccaauugcaaguagaaaauauuucuaaauaaaucaaaauaggcaacuaauuucuuuugaacacaaguauuuugauauaaacauauacauuuacucauuuuuucuauauuuguuugcauucaaggcauuuuuuccuuuuaaaugggaaacuagaggaaugaaaauaugaauuuuugauacuucaaaauaauaauuuuuaucuuggauucagaagacaaauaguaaucaaucucuuauguagaaguaugucugccagauaggaaguagaauuugcuuuagaaagcuugaaaaaucuucugagauugauuuauuguaaaugaauaaaaaguuuauuuuaucuugaugagaauguuuuuaugcauauuucaagcaucugaguggugugaauagacuuuucuaaaguuuggaaaugaaggggcucauuucuuuaacacaccaugaaaguagaggccacaagaaaguuauuuagacaaauguuuucaaaguuaaacaaagggagucuguuaggggaggcaggugagagcuugcagaaucuuugacuguuaaggacuuuauggcccuguguauuuggcuaacugcaccccugcugcuuagcuagcuagauacaauguaauuuucuuguugauuuuucaaugaaaagugaaaguuuuuuuuuuuuaauagcaguuuccucucuaggguauauuuuacaaaauacaaaagaaaacgaaauuauucagauguaauuaaaaugaauuccaccauuagcuuuuuaaauuuuaauaaaaugcuuacuuguaauacauuuauuugcuauuuauuucauuuauuuaguuuaguuuuuuuuuuuuuuucuaagccccauguuaauacuguucagcccccaacuccugguuucuuaguaacuaaaacuuauugcaaguauuuuaauuucuucuaaaucagauuauauauuaugcacauaugauauuuggauauuaaaauugaggacuuuuuucccccacagaugagcauuuguuaaauguuuauauauuccugagaaugauaccaauuauuauauauauuaagcaaacucacaagacucaagugaacuuggcuuugcaguggaauaccguuuauguuuuucagucuuagguagcuuauuaaaauugauguuuuccuuucaguaaauaucuggugacauuaaaauuugauaauuaaaauccagaagcacucaagaaagaaugccugcuuuuaguuucauaauaacaauacucccacaaagaaaguugaugaaugaugucuuucaaguggcagaguuguuauuuaguuaaagaaagcuccuuuggcaguuucuuacaaaacuaaauuaaaguuuguuuauaaaacagacaagcuacagugauaauccuauagccucaagagugcuuggaaucuagcccaagaagagucuuguuuuucagugauuuaacaaagaaguggaguuuccaagaauccaaacagauuagcauucagugcuaauuggguaggguguaaaauaguauucaugucugauuguuuugaugugaaguacuucauaaccauuccguuuucuaaaucuuuuaaaaauauuaaucuuuugucucuucagauuuauuguuugagcaugaguuuuuguuugaggauauauguauacaucaaugguucauagaugugcuguaaacagcaagacacaugagaucauuacaaaaagugcccuuuauagauuaaaauaauaaagagagauugaggcucuguuguucaguggaaacauugaagaacaaauuaaacugaaagauaauuuagauguucuauugaaauguauuacuuugaacaucugaucaugugauuauaauauaccacuuucacauauaaucacaaaugugugacuguauuuguuucuucgggcugcgguaacgaaguaccacauacuggguggcuuaaacgagagaaauuuauucucucacauuucuggaggcaagaaaucugaaaucagggugucagccagcagggccuugccccucagaacccucuagaauagguaauuucuuugucugucucaguuucugguagcuccaggaauuccuuagcuuauggcagcguaagucuguucucugcucugucaucacacaguguucucuguguauguacguguguguccaaauuucccucuuacaaaaacaccagugauuuuggaucagagccuacccuugugaccccaucuugacuucauuacagcugcaaagaugcuauuuugaaacaaggucauauugacagguaggauugagguuagaauuuaaacauaucuuuuuaggggacaccauucagucccuaacagugaccaaauauggcaguguacauuuauacuaaggaggggaagaaaguugaaacccauuagaacaugucauggagguuugaaaaacuuggauuaauagaauauaauagcaaacaaaauuacuuguaauuauuuuuuguaaaggucuguagcugaaauaaguuuuuuucagguguguaaugcaugguuaauuuaugcauuaguuuuuauaaauauauuggaaaacauggcauauucugcauuucccaauaauacauuuuuguauuuauugauauaauugaauuuguaaguaccuuuuuuuaacauucuuaccgauuuuaauguauaaagugccaucucucuuuagaaauuauuaguaauacaaauauguacauuuaauuuacauuuauaauauuaauagcccugguuauuucuuaacaaucccuguuuucuuuaauuuugugauaaucucuggaggauuaauuagaauaauuauaacuuauuaaaucuguuuauaaacuuuucccuauugcacauagaaaauaaauaauugggaaguguuuuccauguuggugacaaagagaaggcaacaaacaccacauucauuuugucuuuaauauuaaaauauggaguauuaaacaugauuucaauucaaauuuuaggaaaucaauuugaggauuuuaguuuaaacaagaguaaaugauuguuucugaaaguggcauguugaaugguuuaaaccaugggucagcaaacuguacagagccagauaguaaauaguuuagacuuugccagauggucucuggcaauuagucagcguugccucuguacuaggaaagcagacauagacagucuguaaauuaauugacauggcuguauuuugauaaaaauuuauuuacaaaaaugagccagaccaaauuugaccauugggugguccuucgccaacccuuggcuuaaaguaccuaucuaauuuuuggagaguaaaauuuuaaaacuauuuuaucaacaccaauccaucauauaaguugcauuauauguaaguuucaucaacacagacugaguauauaaguuggcuaaaaguaacaauacccaucuaacaguacaaugcugucagagacccaggcucuuucuggcuuauuguaauucauuuccuuagcauguuggguuuuaucuucauucuguucccuucacaguuguggaauuccuguugcagcuucauuuuuuaaggacacaaggcaggaaaggggaagggcaacuccacacgugucugucuucuuaucuugaauugcaaagcugucccaguaccuuaccaccuacuugcuucucuagcagauucucuuccauauuauuuaagccacugggucacuccagguuacaaagguagcgguauauugaaacuuugaaauuucagccuccauaguaaagaagggcaagggagaaacgguguuuguuuagucagucuaaauugucaaaggagauagccagauaucucuuuuugagagauaaacagacacucuucauuuaaacaugguauaacuuggcuuuaaggcauauuucuuuaaaaauauauugucaaggacugcgaagagccugaagcuacuuugccauacuuucagggcuagcagaagacaggagaauauuuggucggggaaaaugaaccauuuauuagucacagagggacagcauuaggcaaggggucaucacuugugccaggucaccaacccucaguuucuauaggacaguauaaagggcaggagacaccugcaugugcaguggcuggcauuacagaugaaucccaagccuaaggacccugaauuuuuauaauggacaguaaaccugccugacucuugcucuggaaggagacauuaucuuuauugaacuggacuguaacccucuuuuuuuuuuuuucuccagaggaaaacacugucccuauuaucuaaggcuguuugauacacaaauguuccugaaaggauaauuugaaaggcuggcaguaucugguugcaagacaugaaaaaaugugggagaccuauagauacuucuccccaaaauauuuauguucuguucuuucuuaaaaaccauaauguaucucauguucucaguuuugaaugcuacuuaagaguaaggauauuuacucuauuuuggauuauugguaagcuuaaaaucuuggguucugggcugggcgugguggcucacaccuguaaucccagcacuuugggaggcugaggugggcagaucaugaggucaggagaucgagaccauccuggcuaacauggugaaacccugucuguaauaaaaauacaaaaaaauuagcugggcgugguggcgggugccuguagucccagcuacucgggaggcugaggcaggagaauggcgugaauccgggaggcggagcuugcagugagccgagaucacaccacugcacuccagccugggcaauacagugagaccccgucucaaaaaauauauauauaucuugguuucugccauuuuaauauauauaacaaauuauguauuugauauaucuaauauguauauuagaaaucucacauauaugugaaauaaugugaucuccagaacaacuguggaaacuuuguggugugaacauuuuuaauuccuuuuuuuuuuuuuuugaaaugaagucuugcucuguugcccaggcuggagugcaguggcacgaucucggcucacugcaaccuccgccucccagguucaagcgauucuucugccucagcuucccaaguagcugggacuacagaugcacgucaccaugcagagcuaauuguuuuuguauuuuuguagagauaggguuucaccauguuggccagacuggucucaaacuccugaccuuaggugaucugcccaccucggccucccaaagugcugggcuuacaggcaugagccacugugcuuggccuacauuuuuuauucuuguuugcauauuagaaaaaaaacuuuaauaauuaaagaaggaacaguuuuacaaagacuuuucauuucaagcucauuauccuuuaaaagagaagacgauuauauuuucuucuuuuuuuuuuuuucuugaguaauacuucauucacuuuucaacuuugacuacuguaacuuuagguuuagacccaaauaauugguuucaguagguaaggaagguugaaauuaugugauauaagaaugauauuguuuaucuuuguuaucagugucuaaaccucagagaugagcaccagguaguccaauuccauuuuccuguguggagaagcuaaauagauuggagguuacaugacuugacacacuggggugugcauguaauauucaugugugauauauuucuaaaugaaguuucguuaccaguuggcaugucugagccuacagcuguuggcauaugaaggguaucagaauuauaaugccuuuuucaacuuuguuucgggaggacucauuugaacaauuagcacauuuuaugguugugaaaaugaacuguuguuuuuucucuucauuaaaccagaauuaauauuguaugucaucuggucagucgaugcaacuuuuuuuuuuuucuaacacgaugcuuguauucauuaaauucagaaagacuauuuaaagcuuuauuuuucaaguauaccuuuuucuguaaauaucucuuccuuucucacucuguuuauguauauacaugugugaaauauuacuuguaacuuuuuaagcauuuaauuugucuugaugggcacagauuuuuaaaaaggaaguaagaaagauuaccuaguuuuuucugaacuauauuaaugauaaagcaucucagcucauuuuacagaugcugaaaacccuucgcguuuuguucugaagguuuuuguagggcauacugauuuucuaugaaguauguggagcugucaauuuuauucuuuuuuccagagauuucagaaaauuuucauuuaacuaaagauuuccauccuggucagcugggucucauuuaccugauuaaaauagguuugcauggauaaagucuuaaagcaaauucuccuuaccacauuuugugugaauuuuuuccucuuuaauacuaauuuuaguuuguucucauuacaauugcauauguaaaaaauacuuuuugauaaagcaacugaaacuuugaaguugauaauuuaucacaauacuuuuuuccccauuauaucaacacuuggcaaacuacagacugugagccuaauccagguuguauuuccuucugugaguaaauuuucaauggcggagccaugcucauuuauuuacuuacugucuguggcuacaauggcagagguaaguaguuccauagagacuaucuggccugcagagcugaaaacuuuuacucucugggccuuuacugcaaauguuugcugauuccugcauuacugauaucauuuucauaacagucuuaaaaacuuggcauuuuuaaacuuaaauacuuuuuucuuuuugucgcuuucuucucuacccuaucucugccagcaguucuuugugaauuaccauugugaucuucuaaaggcaaaaaaaaugguagguagucaaugacugauagcuauagaccuaugaaacuaacauuuccuaucuugucucaauauucugauguauauaaucauuuuaaaacauaauaaauuuaggccuuuuuuguuuuuguuuuuaacacaagauaugccacuaaugucugacaagcauuuaaucuaguggcuuuccugcauuuuccauggaucagaugcauucuaauccucugaaaugauuauuaaauacagauugccagccuuuauauaaugccugcuaaauuuaccaguugggaucugcacauauauugguaaagagugcccuagcaguuucugaccuucugucugcuuucagaauccacaugagucaaauuaucuccuuuuauguauaaucuuaucaaggacuauugagguggcacagguggggauggaauccuggauguguucagaacuccuuucauuuuacuaagcuuccuuuauacuaccagaggaauccacuuccagucucgagucacuuagaagagggggccgggcgugauggcucaugccuguaaucccagcacuuugagaggucaggagaucaagaccauccuggccaacauggugaaacccugucucuacuaaaaaugcaaaaauuagcugggugugguggcaugcgccuguaaucaggaggcugaggcaggagaauggcuugaaccugguagguggagauugcagugagccgaguucacacuacuacacuccagccuggcgacagaaaaaaaaaaaaaaaaagaaggauacauuucuguaagguuuuuaaaguuuuguuggaaaagauggauugcaauucucuucuuauguuuuucugagauuagccuaaucacuauccuuggaauuuaccuuugcuugccagccuuuuauccugccccuuucuccucccuuuccuauuuccaguuuaugcagauauucuuucuuauuacuggcauagcuaacauucccacucuauccccaugcccaucuuggcucugauuuucugaucauucuagcuaaaaugugucuuuuccuucugaccauagcauuuaucaaggccuuucauguggcaguuaaugauauauugucaaauauuguuaucuuuuuaaaaugguguuaggagccuggguaacagagagaccccaucucuacaaaaaaaaaaaaaaaaaaaaaaaaaaaauagccagguguguuggcccaugccuguggucccagcuacucuggaggcugaaaugggugagauugcuugagccaaggagguugaggcuacugugagcugaggucauggcgcugcacuccagccugggugacagagugagaacgugucucagaaaaaaaaaaaaaaagaaaaaaaggaaaaaaaaagguaauaggcuaugucucuucugugucucccaugguauccagaacagugcuuuauacuuggcaaacacucauaauaauauaugguuauuucuuuagaauuacuauaggaugauuugaaaauccugauguauuccuagauuacgagcugcuggggccuggagggaggcagaagagagauguuacaauggaaaguguugaagugucugaaggcuuguuuuuagaauuuguagguacacucugaaugucagcuucuucacauuugggaaugaguacuggcgauuuuagaagaaaagaaaaugcuuauaaggauaguaauaucauuauuauuuauguuuuaauuauaaauauauuucaaagcaacucuuaacuguauguauucucaaaauagcuuuacuguaauaacauucuuggacaaaguucaugaaauuacuacaguuuacaaguacuucuuuaauggaguguccuuguagcuacacuuaguaccuguaagauaaauuccuaaaaaauucacaucauucugccuacucucacaaacuacucaaagcaaugagcauauugcauagcuuucuuauugacuuauuaguucuguaucugagcuccaaugaguguuuucacuuccucuuauucuuauauuaacauuucuucaaagacuguuuuuguuucugugauguguuguacuuaugacccugaauacacaggacuuuucggcaacuggggaauccuccaaaaaucuaugcuuucgacaugaauaguccaguuucauuugguauguauuauugacagaagugcuucauccucuuuauagcuugcugugcagcagaugguuguuauauuauucaggacucuugaggcagugcauuaauacgcgugcacaauguuuuuuaagucuuauugugggaauugucuuguguccuuguugacggaauuccuuaauacggaugaagauuuccaaacuugaaaacuaguuuuuaaauuuuagcuaaggcuauuuuguauuuauguauugcuuaacugcuaucucuuuuucuuuccuuuuaaaguaaaggucggaggguuggaucuaauauucuugcuauaaaugauuuuuuuuuuuuuuuggucuuguuuuguuuugaugugagcauaucagcuuugagggacaucugagauauuuugaauauguaggcagggcuuuuaaagaaaggaauugcuguuuucuuacauccaccaugcagacuuagacuugacaggaaaacagaggcauguguguucucacuguguauuaucguugcgcccccucacauagcuguuaggguuugucagcaguuuguuuugacucacuagaccaagggugggggugguuuuguguguuuuuguaaguuaacuagugugggaugucaguaaucucagcuuuaccauuuuaguuggccaugaucccuucauguaagaaaccgucauauuugcccuauuucucaggccauacugugguuccgaaacuugcccguaaauauuugugaaauaguuuuucuuuucuuauaacucuggaggucaaaacccagcccuaagauaaacuccuguuucauauugccucugcggggugcucaugguauguccccagacuaauuugggaaccuccuugaauuacuuuuuaaaauuuaucuggauaguucuuacacaauuaaauuuaauuuuuauuuauuauagcaagauugaggacacucccaaauccacacuucauuuccugggagaucauguuagacacagauaacuaugcuaaauuauuuugauccagguaagcguguuagaaagagaggauggggcugcuggacuucauugagaggaucuuuugauuucagaaaccauuagugaaggaaagguguacuagacagagcugucauaaccuuuuuacuauuucuuaagagaagugguaccucugagaguuguguaacaugguggucuucccacaucuuuaucaagagauuaauuaagguugugaaguaaagcuuuagaggugaggcacaaaaggcaagcaguguuuaccucuaaucacucgagguaaccuuuauauuggaagaucaguguagauguauuguguaccagauaacauuccauuauguaacuauucuuuauuuacuuccucuacuguauguguggcaucauuccagcaucaaguuuaauccuucuuuguaugcauuuauuguaaacugucauuuaugugggauuaaaauaacuggaaagccuaaauaacuggaauucuuguagcauguuugguacuugacauuuaaaagagagacagauggcaaguaaacaaggugagagcaggacuuuauuugcuguacugcaaucucaaacugcugucaagaauuuuaauuagauguuauuuuaggaagcuuucaauuuacugcaggucauugaagcuuagaaagaagcagaauguacaccaaguauuuuaauauguuagcaauccacugcaauuaguuaaucuggagcuaguagguuguauuuuuaagaguguaaacauuuuacuggguuucagugugacuuagaguaaaauaauuuuucuguuuaauuuuaaaucauacuauuuuaaauuucuaaguugggcuucaguaucaaguugguugaauuaaagauuuaaauauuucuccugaugucuucccuucuccuuccuacuaaacugguguucauuuuucuuuauggugaucauuucuaauuucccacagcuucccuggacauuuccuucacugugagauaguaguuuuacacaucauucaacauccaguuguucaguuuucacaaaaagauuucugagaaaucugacuucaaaguuacucuuuucaaacugaagcucguuuuuagaacuauucaugauauaggaaaauacauucauaacugaaagcuuuuuuuggguuauucuuuguaacauuacaugccgcuuuucaccaaugaaaagaauccucaagaaccuggaaaaagcaauuccuuuuugcaguuaaaaugaagauaaagagccuugaaaaauggcugaugcuaauaguucauggagauuaauaagugauaugugaaaggcagacuguccuguaguugcaaaauguuacauaguuuguacaccuugucagcguugugauaacaugaagucauaguuuaauugguaaacaagaaaagcuuccaauaaagugucccauggaugaucuuuuccuuugagacugcagcauuucugaagaauauaggguaucuugugauacagcaagguaaaagcagggcacaucuucccuaugauaaaucugugcucuuauugucggaguuuaaccuaguccuucauauuuuguuucugaauacuugaguucauuuauguauaguggggaagauuuuguuuuugauuuugacuucugucaugcuugcuugcuuacuugauuuucuuuucuuuuuugagauggaguuuugcucugucgcucaggcuggagugcaguggcgcaaucuugucucacugcaagcuccgccucccugguucaugccauucuccugccucagccuccugaguagcugggacuacaggugccugccaccacgcccggcuaauuuuuuguauuuuuaguagagacgggguuucaccguguuagccaggauggucuccaucuccugaccucgugauccacccgccucggccucccaaagugcugggauuacaggcaugagcuaccguguccagcccuauuucuuuauuuaaaaaugacaaauacauuuaugguuguacuacaugauguuucuguauauguauacauuguggaauggcuaaaucaagcuaauuaacauagccauuacuucccauacuuacuuuuuuucuuuuuuaacuggugagaacauuuaaaauauacccucuuagcaauuuucaauauacaguacauuguuaaccucuugaacuuaugucuccggucuaacugaaauuucguauccuuugaccaauagcucuucauccacugccucaacugcccacccccaccccaggaaauugugauugauauauuuuuuaagguuguugaauuaauugucuuuuuugcaguuaaaaaauauauuaauaguaaaaugggcuagguagagauuuuuucagagggcaaguuaauucuggaccugacaaccuuaaggucuggaaaaauaguuacucucaaauuuuuuuuuuuaaaacgaaagguuuuacuuaauuaucagguucuaauucccuuaggauacuggucuucagugauuguuuaaaugucucagaggaaacuuauauaaaguuuggaauuuucauuuuaaaauuuguguuguuccaagauuucaaaacagaucuaaucuagauuauuauugauguuaaaugauguaaaauaaaaguauauuuaauuuuagaaauuuccauuaauaauaaaauuauucaaauuauaaggaauauacccaagaaugugaguucuuuucaaaccagaauuaaacucauuuauauuuauaauaccccuaaguacugaaaauaaauacuaacagcauuucuuauucagaaaacaaaacugguugcaagcagcaagagaaaauaucuugcugagugucgcuuugaaagccaaaugaguuguaaaaaaaaaguaaaaguuccuaguuuuuguuuuacaauaaaguuucuaauuuugucuuuaguuuuaacugaucauagaaauuaauaagccugucugucucagagagagauauuuguucugccuucacuauucugccugaagcaggauucuggaauguucuucagaaucaugcagaaugaguuguaauuauuugcuacagaaugaguugcaauauuugcuagucuucaaauucauucucauuauucaagauuauaugaucagaaugaauggaaacugcgauggcuauaaccuagagaaguaauaagacaaaaagcauuauuuacucauaugaaggguuuaucauucauauuucuucaucaucuaccuuucuagauucauuucacgacacucucccucaggucuuccuucuuuauccacucacaucauuuuucaguuuuucaggccuuuaggaccuccacaucugaggcuucaugugccugauuuuuuuccaacuaccuaacacaucuuucguaucauaacuuaaaugucauuuccucagagaggccuucccugagugaucauuaaauguuuugacacauuauuuuaucucaugguauucugcuguguucuuuccaguacuugucacaguuucuguuucuucguuuucuucaccacugucaccacagugccuacuucauuuccaacacgguguagguacucaauacagauugaaggaaugaaggauagauaaugcacucaucuugagcuacauccuauuuagugagcaccauaaaacuuggcaggcauuguuagaccuuuauauggacaagagcuuugaugguucguuuuuguuuuguucaguuuuguuuucuuucuggagauggaaaaagaaauuuaauagugauaaagccagagaaacuuaagcuggaccugucaaucugguaugguugagagguauuuauuuuaaucagcuguggauuguauuuucaugugacauuuuaaaaaggaugaaaagggucuuacagccacaugcaucauucuuuugccugcugauccauaauuagaaucagcaucuagaaucuguuuuuguauauaacugaaguaucagaguuacaaguaaaaccacuuuccacguuauuuguuguccauuaacugcugaagauuagcauauuuaaaaguuuuacugagaagcacauaauuggaaccugauguuuguuauuuauccugauucauguuauauuuucuucuuaguggacauuaaaauuucaaaauugcuauaacagaggugcuguugggguaguuucuuaguuguauaugggucguauauuguauaugggaaucuuuuuaugguacacaucuguuuucaucaaauaggugaguaguauucgggcauuaccuuauaccuucuuuaaagaauuuucauccauugcuuuaauaauuauauuaugccagcucuauuuaauauaauuaaauuuuuuuuuaaaauuuccuguuguaucaaccugaaacuacuuugacuagcauuuuggcugcaaccuucuuuucuuaacuguucaguaucccucuguguauuuuuauuugguucccuuaauuggaaauaauuuaaaaaacauaaugugugacuuucuugcuuacucuugaauaacauuuaaacuucagccucacuugucuaauuucaguucugagguauguucuacuuguugccuccucaaauugcuuugccuuccugaaaaguuuuucuuuugauucuacauauuuucaggggagggauaaagaucuaagcauaaauaucaccuccuuagaugggucuuuuuugaccauccuaucaaauagguugucacaguuaguauugugaauauuuucugaugauuuauuuucucccccaacaaauuuuaacugucuuucaaaguauaauugaaguucucauucuugaagcauuuucugaauaaucaagugcuagaacuugagcauuuuuuagcuuuuacuuuuugucagaacauuguaguuggugguguagagacaguucuaucuugaugcuucagguucucauuucuacuugagggaagcucacaauuuucaggaaucacggaggauggcauuugagcccgccuggcggucugagcccaccuggagauccccauccuuucaauggggaaauguauuugagcuauuccccaagcuaaugcucagguaggagauacaggcaggaaaagaugucauggaagauauuuuaaaggaaugggaguauacgccuagcuuagaauacaauaugugaaagcauauuguauugugguucuuuggugcuggauaucucaggaguggaggaauugaaggauuguguuuucauuuuuacacuuuuucucuucugcucuucugauuuuucaaccaugaacaugguuauguguauggucugguuugggggaaguauauaucagaaaaaauaaaacaagaaaggaaguuacucugguuaccaugcaauuucguauuuaaaugacaagguuuugcauuuuggauauuucaugucagccgugucuccucagcuaaguucuagucacuuagaaguuuggugucacugaauuauaauuuuggugcuucccauguuuuauauuuacacuagacuacaugcuauauggacaaugugcaaucaguuaauaucugaaugaaugaauugaccaacuuuugagaacagaguuugacauaaauuuggugguuuuugguucauugugcuuuaauugaaggagaaguagacauuguacuucacauuaggcuacucuuuagauaagcuuuccauuacauggcaugugucuuacuuucuuacuugauaauggcucuguuucugaaauuauauaaacagauuuuuacuguuuuuaaacuuuacaacuuaauauuagacuguaaauuauuuacuuauuuauuggaaacaaacuuuuagauacagaaauuggucuuuuaagacaacaacaaaaaauaccuaguuuuuaaucuggcuccugucuuucaugacuaagucugacugaucuuucuuguuauaugaugcuuuauaagauugauucuguauccggguuaccaacgcuuccuguaacagaagaaaaacauucagauccuuauagugcugagucaggggaaauuauuacauacaacaaaggaaaagucuuugauaggaaauauugcuucugguaggaaauuaaguacagaguacaaggaucuaaaugucugucauauaaacaaugggcaaucuuauuaggcaauuuuggacaccuauuacguggcuuuauuuauuuauuaauaguaggcuuuucucaucaugguucauggggauuuguaagguaacgauacccuggacagccuuccaagauguuuugauguuggcagcaaugcauuacuggggcaggggcaggggaggagguagaaagugugauaacucugcaucacuccuucuucuuuguucucauuuauaacaccuaaggcauuggaauuccccagaguaagaauucuagugaaaagggaagcaaauaaaauacaucugacaguugggauccuuggguuuauacaugugcugacuaauuacauaugaaaugagauauccccuuaaauuaaaacuauuugaagauaccacuucaaauauauguaauagaugauuuacacuucuuaucauggcuuucaauagcaagaauuucucuugcaguaggauaauuaacuagaaauauaaagaaauguuucaaaaguauaauaauguagaagaaaaauagaaaaauuugauuuuggaagaaaucuuccuccauuauuaugaagauagcugcaguuugguuuuuuuuuuuuuuuuuuuuuuuuuuuuuuuuuuugggacggucuugcugugucgcucuggcuauggugugguggcaugaacacagcucacugcagccuguacuuacuagguugagccauccuccugccucagucuccaaguaggcucccaaguaggugggacuacagguacaugccacuaugccuggcugauuuuuaaauuuuuuguagagacagggucucgccauguugccuaggcuggucuugaacuccugggcucaggcauuucuccugccuuggccucccaaagcgucaagaucacaggcaugagucaccacacccagcugauagcugcaguuuugugugugagaguugaucuucuugccuuuacugugacaaaacaucuuuauggaaagacaaacaguauucguuacguuuauuuuaccuguguauucaagaauguuuauuuuuuucauaagcuacaaaaccagauuagaaaaguaacuuguauuuccuaaaaggaggcauauuuuaggagcuauaugaacugggcauuuuuaauuuuuuuucauuacuuuggggaauauuucaggaucucaucagcauucauuacaugggaggacaggggauuaaaaaaacaaaauugauuguuaaugaauuuuuuuuuuuuuguauuuaggaagaagaaagacuguaacuuaaaaagaauuguggcaaauuauauauguuaaauauucuggucuagaaaugugguauagagguucccuagaagcuucuguuccacugugguuaaaauguuuucucaccuucuugaacugucuuuguaggugaugucaugaaaugucccaagagaacguuguauaaaacuuccuuugaccuuucuggacucagggcugagcuccuuagaccuacaguuucuuguuaaaaucgaguagguuguguuugaaaaauaaaguuuauuuguaaaauuauuucaguuuauauuuuauguauaaucaucucucuuacaaauauaugacucaaggaaagauaguauuuugcccuagggucaagagugaaauuauuuaaacuuauuagugcauauuuauuucuuuucuauuuuaugcuaaaaaaauguguggaacuaaaauuugaaaagauacuuauuuuguuaguuuagaaaauguuuaguauuucauauaaucuuaacuuucaaguauuuuggcgucuaucuuaauauuuucuccuuuaagaaaagacaaaaauuaaaaaucuuauucuaacuuaguuuaguccacucagugaaacagcauuuaauauuuaaugaaaauuguuuugucguuuccuuugacaucuguauuaaagauugcuaauugccuccaaaauccauuuugucccuuuccuaucauuauauauuuccccauuguuauccauccauaguaaagauagcauuuccuggguucacauguugcugauguggcccugugagcaaguuuugaugaauuggaugugaguagaagugagcugugcagcuucuagaucaugcccuuaaagggaagccacaugcccgcucauuccccuuuuuccugcucccugcuggcuagaaugugaacaggguuaugagucaucucaaccaugugaaggagggugauggaacagggaugggagaaggagccuaaguccuugacuucuccauagacuagagcugcuuugcuuaggcgagaaggaaauaaacaucagcaucagauaguauuauucugucacacuuagccaaaacuguguauaaaauacauuaccaugcugacagaauucaccauuucugcuguguuuuuuugagguuuaaguuucaaauuugcauaauaugugaaggcauuuucaugugaaauaaaacauuauuaacuauaucuuguuuucagagcaaccacuggauucaugcuaauacugcuuuuauauuacaguuauucaguauuaaaccauuuugugacuaucuguaacuguuagauguaugacccauuugaggcguaaacagagugcugucucuugauaaucuaaauuuccugucuuaaauuuuugugucugcuuugccucccuuucuuugucuuccucccucaugucuuucccuccccuuucugccuuuggcuaaugucugggccagugcugguaaagugcucccuggccaguccaugggaguuuaaggaccuuaacagagaccagguuccuggcguuacuucugaacacacacacacacacauacacacugguaaaauucaguuacuugcuuggggaguuuaugaguuuauauuguaauggauggaaaaaugcccugugcuuugcaaccuuuuagacuaaguaauaacacuuacaagaaauugugaguguuaugggaaccaacuucugugugggagauggguacgagggaaaaaaaaaguuucauaaugaugaaugagaaauuuucagaaagcauuguuugguuugucauuuucaguccagaagguuacuuacgucauuuacucuggggauggaauauagcuucacugaaugacagcauuugguuccaaguuauuuaguuauguuucauuguguugaaauacccuaccuuugccagaaucguuguaaacuaugugugaagcucuagguggggaaaaauugaaaggagcgccauauuauauuacaggaacaauucauguccuacucuugguuuccuuucaaagcccuguauuuguggcugugcuaauaaauuccaucacauucauuaugcauagcuguaaguguauguaaauaccacgcaucuugcauuuugaagaaaaccagggagugaacacacauagucuuucuugccugggauucauuuauuuuuuaaaauucauuuuauauaugaaugagaaaguugagggaacauuuccuuucauaccaacauagaaaauccucuaauaccacauccccugucuccugguccugggagcaguaaugggauuuucugggugcauuugcaucauguguaucauugcuuuucuguuuauguucagaagccuuuucugccaaggcuuccacaaucuucugaccccagcagcagguacauccuuguagaugucaguguaagucuuuauauuaugaagaguauuugagagaaugguacaagaggaugaaagggugaauggaaguugggggcaaaauaauggagggcuaaagaauauagauuugaucuuacaaaagcugucgagaaaccauugugcauucuuaagcagugaaguggcaccauuuaaaaugcacaugaaugauuagucuaauauaguuugucugacggcaaagacuggagaguggaguaagaaauuuguuggauuuuauaccaaaaagcuaaaguguuucuaggauagcaugucuuguuuaauauuuuaucuuuuuucaaaauggagaucauguuuuauacugccuuguuauaugguuuuauuacuucuuuaugaaugacuuaauagagcauuuuguguaugugguaaauauuuguauguucguuucucugaucaagaagcuaauggauuauuuugaaguaucuacuauuuuguagcacuacaugaguuguacaauuaacuugaguccccauaaacaaaauuggggacaugcuggauccaugucaugcugucaugcuggagccgugucaugcuggagccauuucaaacuccagugugcuugacguuaaauuucaaaagucaaggaaauuguuguuaaggagcuuaguugaagcuaucuuuucaagaauuuaaucuacuaauucauuuuguuuaauuuuuaggaauuuguaugucauuaaaauacucucaaaaaugcuguucugauuugaaaugaaauacgaguauaaaaauuggggucgaucuuugguacauuguuuauuguacuggaaaaugaaugcuuaacauuagucugugauagugauaucaugcuauuuuguauucaagccuuuauauguuuucaucaggaagagucaggcaaaagcagacaaaaauuucaacuaauggcaaagcacuuuguaccuuuaaaacaauuuaaugaggaguuguuuuuacucuaaaagcugaggcaagagauacauggcaguaaaaucugcuauuguuaaucuacuguagucucaaauuuuuauucauuaauuuauuuauucaucaguuccuucagugauauuuguugagcgccuacucuguccuggcacugcuguagucacagaggacaauuaugaguuacugagccugacuccucuccuauauggauuagagagugaacauaaaauaucaggaaaacuaaacaguuuuuacauuuugcuuugaauguuuuuuuacuuuccucuccgcuuccuuuccccccuucucuucuuucucuuuccaucccagguccuccuuuuucucacuaucugagagucggaggaaacaaggagaugggaauuuggaguggaagauagguuuaaggagauaguuaucccacucugguucuaaauucuugcacaauaucugauauggcauuagcugaagaaccaugacaugauugauuucuuuuuuucaucccacuaguauauguuacaggcucucagugugccaaccuuguuugagacacaaaggauuuaguagugaauaaccuagaugcaguccucauggagcagacgcugugauggagaagguagaccacaaggaaaucagcauauacaaacaugcuauaauuucaguuagugauaaauccuauaaagaggaauaaucuaggauaggaggagagaaaaggagagaugccuuuauaguaacgcucuagguacucuucugauuacacucuaggauuguguauauggcucucucauguccuaacacuuuugcaaagaauggggauauguuucuuuuaguaggucuaagucuaaacaagagaagguggaaugaugaggucuccuucucaguggcuggagugaaguggaaggguauaggaggcuccccuuucgugaaugcccuugcugucucaucagggacaccagaugaggcugagcuguuagcuucccucuccaaauugucauuucugccaccuugaaucccacaguuggcauaaaaaucguauuuuaagauguuauuacuauaauuuaguugugaauaggaauggguuaugugauaggcaucagggaagggcacaaagaagaaaggggcccagaguggggagauugcaauucgcuaaagucaggcugacucuacuccacagcccuccugaccuaaggcuguguuuaugauauucaguccucuuacgugacagaaauaugugguacuugguuuagguuccaggugcauauuuguuaacuaaaguugccuugcuuggguggcaaaaaacuagccuguaguccauuuuacaagcauaagcggugaagguguuuaagauuugacuuugcauccaugguaacagucuccaccaauaguacauguuacagagcccuuuaggccuacaauuguacuguaaagacagacuguagugacuugucuuucuuaucaggaccccacccuacauggauccuugaagagugagcaggacugcagaaggagcucagguggauuugacagcuuauaaaccuggaguuuggggaaugcugaggcuucaggaagaaaacaccaguaagcuuaaguuugggauucccacuacucaggaggacugaugauggggaccaaaguuaggaaagcagaggaguuuuggagaaccuaugaguucaaaagggugaaguaggaaaggugagaaugugagggagaaaugucagaguuuauuuggauucuuuuaaagaauaaaauagaacacaguggggagauucagagucagcuugguaggguugaguuugagggccuaagaaggaagagagugauggagacauuauaagaauggaagcucaagagaaccauguaggugcuuuguacccugguauggagaauuucugggugcagaguucauggacccuggcgaguaagagcucaacacaagagauuaguugcuacuugaaauaaacaugauaauuguggcccagacagaaaagccuccucuuuuucaaaggucaagauugcugagguacaugacucagaccuugcauagcaguaggaagaguaaccagcagcaaagcaauaaguuguuuaucaaagggugcuggugacucagucaggaggauuuggaauagaaugauugauuuggaaguagguuaagcuaaccaaauaauaugaaucuccuauguguuucuuaaacugauuauuuugaacucaagauucucuucuaguguugugaaaauaguuugugauaugaaaauguauaugcucaauugcugugaccacuaagggagacagguauagcaagagaaauaaugguucagucuggaggggaagccaucccuucucgcccuuccccuacguuguguggauggaaggucuccaagagaagcaucuaugagauuaggccagggagccuucuguuucagggccaccccauucugugugguuuuauuugucagagacgcugauccuaacagaaacagcuguuucagugaaguucaagcuugccaucuauuuucaguagaagcaggaagaaugucagagacaauguuugcauuuuagggccuuuuuauaggagccuaagauaaagcuguuuaaaccuucuguccucugucauuuaacuuaucaaauucaagcagagccuuuuaauuucaacacacuuaacuucuagggaugaauagggcauugaacggauucuauaaacaaguacuuuucugagcgauaaacaggaacaaaagcagcacaaagauagcaugucaacaagguaggguguauugugagaagggcaaggcuugagagccuaaucuaugcuauucuggggaagcaacuauguuuguuuguuugauuuaaggagcagugaaguuacagagagcagaaaaugcugauguaccugaaggccauuauucacuucuguagacagugcuacugggugagaagugaauaauauuaguaauauauguucauuaauuaaauguagcuuuuaaaagaaaacacaagauggaaaagugaaacaaaauggauagaguuguuuggguacuaagaguaguagaguagauugaagaccauuuaaaugggaggcagauuuucccaugcauaucuaaaaagguccuaguguuaucccuucacuccauuuuagauuuguuuguuuaguuuggcccugaguaugcuagaacagauaauaaccucccagcaaauguaacugagugggaacauuauuuuaguucacuuucaaaagaagagggagauccaauucauaauacccaaaauagagaguaccgguuaguuccagaauugaccagccauggaaagacauagaaacuuugccuguuagaaugcucauccugagaauaggaccugagcuuuuagagguguuagaugacuagaaggccuuagaaccauuaaggcauuuuauuucuuucacauucagccagcuuuccuugagcagcuuuucuaugccucuugcauuuauaaauacuuaaacauguuaucccauucaaaaguguaauuuguugauacauugguucaacacugccauuguauaugugugugugugcaccauauauguucauauuauaguugcagaugaauaaaagauaaugauaaauaauaauauaaguuauuuauaauagugucaauugguuaaauaacuuauacauccauaugaugaaacauuuccauuuuuaaauauaaugagccacauuuauaugugcugguauggaacaagcaaaaaaaauguuaagaugcagaaagauguguuuaguaucauaacauugaggcaagcagagauacacacagaugcagacuucacaucucuguucauuuauauuugaacuaugagaagaagugagaagggaugaaaucaugaccuugaaaauaagaagcuguuucuuccucugagguaggagggaaaagaaguuggguaaagauaugaaauggugaaacauuaguugaggaagaaaggacaaaucagugagcaaaaauccuguuuuuguuuuuauaaacauuucaaucccgggcaaucuugagaaagccagggucauagguuggaugauugcaguacuuucuuguguguucaaagaggaaaguccaaaugcgcauuuggcacuggcacuucugaaaagcccugaccuuuguaaucagguucuuuuucuaccugcccugcaaagauuucuuuuuguuuuguuuuggcaguaguguuuaugugaaccuguacccuuacugugaaauuuuaacuuacuguauagacugguuugugugaugggcuccuaccuauuuuaggacuagaaaggacugauuagaucauuugcucuggcaguuggcuuuuaggaaggugaauguguaagccuuugaacuguucggcauugaaagauuuauggaucucuuaggcaguuauaucaccauuugaauaguaggugauagauagauagauagauagauagauagauauagauauagauaucugaucuuuaaaggaccaggauuguagaauaauguuagcuagguauguaaauuauguuguguuuggauguauuuuguuuuuggauguaagggacagaacaaguacauggaucaauuuucuucauccuauaaauuugguaaaacagaaacaauaugauguuuauuucuuauuuuguauuuguauaaaaaauguaaguguuggggaucauugucucuuaugguaccucacaacccaucacuuuauauccuaccuucaaugauauagguaaaagguauauuuuuuaaaccagauuuuacaaauuuccauuaaaauguugaauuuuuaguuuuuauaaaacuaaaauuuugaguaaagaacaaaaaggaacagaaaauagugaagaaacagaaauagagaacgaacuuccuaggacuuuuuaagcaaaaugaauauucaggcuaauaguucuauuuauuuccuagaaguaguacacagucuaguuuuucuuuuauacauuuucuugauuuuaggguauaaaauuaaaaaaaauucugaagaauuucuuucugugcucuuugagguuuugcauuuuuaucugguguuuguguaaaauuaauucaacuuaauuaugggagggguuuaaaacaaaugauacucuuucuaagcugggacaaguuauuuuccuuagucacuauaggaacaaagaaggaaugaguggcagaguagaauugcuuuuguugagcaugagcucugauaucuuggcuguacuguucauuuacacauuacaaauauuuucuuagauucuaaguaaauguuacccccugcccccgaaccuugcuucuacuauuuuaaauucuuucugcuagcugcuucuuucugaacccuaacacagggguccuuaaccccugggccacagaccgauaccgauaucaggaacuggacguacagcaugaagcaaguggugggcgaaugaaggcagcuucaucuguauugacagcugcccccacauugcucacaugaccaccugggcuccgccuccugucagcucagugguggcauuagauucucauaggagugugaacccuauugugaacugugcaugugagggaucuagguugugcuguccuuaagagaaucuagugccugaugaucugucacugugucccaucacccccagaugggaccaucuaguuucaggaaaacaaguucaggguucccacugauucuacauuaugguaaguuguauaauuauuucauuauauauuacaauguaauaauaauagaaaucaagugcacaauaaauguagugcacuuggaucauccugaaaccauccccaugccccugguccauggaaaaauugucuuccaugaaaccggucucuggugccaaaauaguuggggacugcugcccuaacacauguaggguaagugggauuucacauacagguauaaagauaacauuuucauuuuaggaauauauuuuuccauauaauaauaggaaaauuguguaucaaugaaguuuuggaaugguuugagacucucuauguaagacagugaguccaacugaaaggaagcaugguguccguugaaugaauuuugcuucuuaucaauuccugcaaaguucugaugauaucacauuuguagaaaugagagcaaagauacaaacaaacaaaacaaaacaacaaaauacuacuugucacuuuugaggagaaauugaauuguuucuauacaucuuacuuucccuucauuaugguuuuucuuucuuucuuuuuuuuuuuuugagagguggagucuugcucuguugcccaggcuggaguucaguggcacaaucucagcucacugcaacuuccuccuccuggguucaagugauucuccugccucagccuccugaguagcugagacuauaggcaugugccaccacgccuggcuaauuuucgcauuuuuauuggagacagggucuuacaguguuggccaggcuggucucgaacuccuugccucaggggauccaccccccuuggccucccaaagugcugggauuacaggcgugagccacugcacccggccucauuauguguuuugaugaaucuguuaauuuaugcuccaacuuaaauauucauauuuacuuuucucuucaaguguuuucaccauuguugacuauauuuaacugauauaugaagcuagauuuaaguuauaucuaacauuuugcaaaguaugcuugaagcagaauggaguuauuguauaacuauacauaagcagaaguucuauuugcagauucacagaugcaauuaugaaguuaagucagggauaguugaguugaaacaaacuuuuucacuauaguuuugcuuccucauguagccauuuuauuuuuuuuuacaaauuaaucuaaaucucuagacuuucauuuuucuauauccuauauucauaaauuacuaaagguuuuaaaguaauagaauagguuaaaauagcugcauacucuucuuagaauuuugcauaaaacuaaucuucacaaucuauuuuucugaacaucuguaugcuuuucguauuuaauuuauuguuuaaagaauuuuugcgguuucucuuguguuuagaguuacguaaacagcauuugcauuagauucagugguaauauacaguugcauuauaauauacuuacuauaaaaaguaaaaauuauucaugauuuuuuugcugguaaguuugaguuuuuaacguaaauuaaguugccuuaauuucauaaauuucagugcaauuucuuagcauuuuuauugaagugaagaagcuauguagucauugugccuuauuuuuaaauugcucugguacuuucaguagggaauauuauuaacaugaaccccauuucauuacuuuuuaaauguccuucuaguugcccuaaauguauuguaaguaccuggagauuuuaugucucaagccuucuuuuuaucaguguggauguauaaucuccauaaaugucaauugguaaugaugaugagccauuaaaauuaauagcuuauuugcuaaauuugaugcuuuuaagucuaggauucgauuuuacaugauuagaccuauaaauacauuuuauuauuacaaauuuauuuguguccauucuuuggaauaaucauucugagaaguuucuuugggauaaguuuucauuaauuuugaugaaauuugugguguuuuugaaacagccacuuuaauauuauugugacauauuuaaaggaaagcacauggauuucuggaaaccagaauuuuaaacaagauaauauaauuacaucuuuugggaaaaaaauuguuuauuuucacuaguguguuuuauuccaggaagcaaguuucaucaucaugauuuaaaauaauaaauugaaagacauaaaacuuaauaaugcaaauuagcuuuuguugguugugaugauguacuuugcuuuacguguauuuauauaacaccucggauacccaaaauauuuauuaaauaccagcaucuuucucacauuaaccugaaaacuuacaguagucacuuuucugcuugccuuuauugccagacuaguggcauacacaacugucuuuucuuacaacuaaugccuucaguuauuucuuagauaugagcuuugguauguuacaguuuucagaacuugcucaaguaaggccucauucggccucauuguucaacucaguggcuugggcucuguugcaucucccgauaguuuuuuagaauauucacuacucuaguuuucagugacaucgucugucuugguucuucugaacuacuuaaugugcauuccucuuguaggguucucauccuccuaaaugccgguauucuccaaggcugcuucuuuuaguguccucaagcuucaagucacccauggcuacucauccuuuucuucuauuuaccaucuucaguuagucccaaguccuagaaucuccucucccuuaaaaauaaucuuugcugcuccuccuuguccccuguucuugcaacuguguuauuucauccuucccuuacucaugauaagauuacugauaauggcuggccuucuaauaucuugcuccccaaugugcuaaagcuagagaagucuuuaacacuuuaauccucuucugggcauuugcuuuucuugcaaaagauuaauuaucuucuuuuuaaucugguuuauuuuacauaugccgucuuauuucucacuacuacggacuugucuucuucucauuuucaugccuucauaauucuaaaaacaugucaugcuaauucucccacucaucuggaauccuacacacccaguuccugucccagcucuuccauaagccuuuagaccuugcugauuucuccuuuugcugaaccugucuucacuuuuaauagcaugcauacugauguauauauaucaaaaacccuuuuuuuuuuaaacauuacuuagaauugugguggaguugucacuaaagauuaaaaguagguuccauuaauaagagaccauauacuuuuugguauccaccgcagcagugcugggcccauauuuuggugcucaguaaaguugaugauugauuuaauugauuaaauaggugauacuucaacuuucaaauagagacuuuguuuuuaaaaaguacuuagcuuuauauuaguugaacagcuguguacaugaacauguaaaguagaacuuacuuuaugcacuauuuacuccuguaguucuaaaaauacugcauuuugcuucucuuuuuuuguaaacuacuuucuggagugcuuuuauuauuuaaaaauguacuucuuaucauagggauuagugagaaguauuuaugagaguucuguuaauguaccuguaaccuuagguauacccaggagcuuaacauugcaaaaaucaagcuuuugaagaaagaauagcuuaagugcuaaauuugaaauugccugcuuaguaguuuucuaaaugguuuagaaaaaauuaguugacacguuuguuucaagugauuuuggagcagccaauuuguucguuuuuuaaaauuaauaagggcagucaauuuacuaauuuuuacuaauuucaugguuuugcaaagagaaaaacaagaucagaugacaucaugcaauuuuuuuuuucuuuuuuaaaaaauauacuaaguucugggauacauguucagaaugugcagguuuguuacauagguaugcaugugccaugaugguuaacugcacccaucaacccaucaucuacauuagauauuucuccuaaugcuaucccuccccuugcccccuaccucccgacaggccccagugugugauguuccccucccugugcccauauguucucauuguucaacucccacuuaugagcgagaacaugcgguauuugguuuuuugcuuuucucuuccuguguuaguuugcugagaaugaugguuuccagcuucacccaugucccugcaaaggacaugaacucauucuuuuuuauggcugcauaguauuccaugguguauaugugccacauuuucuuuaucuagucuaacauugaugggcauuuggguugguuccaagucuuugccauugugaauagugcugcaauaaacaugugugcaugugucuuuauaguagaaugauuuauaauccuuuggguauauacccaguaaugggauuauggggucaaaugguauuucugguucuauauccuugaggaaucgccacacugucuuccacaauggcugaacuaauucacacucccaccaacaguguguaagcauuccuauuuuuccacaucgucuccagcaucuguuuuuuccugacuuuuuagugaucaccauucuaacuggcgugagaugguaugucauugugguuuugauuugcauuucucuaauggccagugauacaucaugaaauuucuuucaguuucauuggaacugauagaaauugucauugauauuccauuguaauauaaagccauuaacagccuuucuuccuguguuuuuugcuaaucauccuuugaacagaacggaugcuuuugucuuuccuuucacuacuacauucuaaaagaacaaagauauuuuuaucauucauucaauaaagaguagguaccuacagguguacaaagcauuuuuuguagauuuaaaucucaaucugcacugaaggaguucuuaaauuagggcaauaauguagguuuacaaaagacaguaugauuuugcaugaaaaugcacugggaagugcuuucauagauguauaaacacauucugaagagagagaauuucuuaugccugacagggcuaauuacagauaauuuugugaaggagcuagcauuugaauucaucuucggaagcaguugggauauuaguggcuaaggauggaaguggagagacuguacugugugagacacaggggcaggagauacaggguguguggcauuagagggugggggguggguacaaaauuuggcucuggagauaagugggaccauaucugggaggugacugaaucuuagacuauggauuuucuucucauauucauuggacaugagggauaauugaagagaauuuucaugaccagagguguguuuaugaaaauuugucagcacuguugaguauaaauuggagcaucaugaaauugguaaugaggacgguccuaaacaagacguuguaguaguauaaguaagaaauaauugaagccuaaacugaagauaauggcaguaggaauggcaguaggcaaaagaaggaauggacacaagagugauuucaagagacucagcauaacuugcugccauauucauuuauauuuccaugaauccuuuuugucauuccuuaaguacauauuguacauguacgcuauuuuccuucaauauauucagugguggaaguuaauugauuaaacaauuuuaguuuuguagcaucaaagucuguuuacucuugugacaaauaacugaguucagguuuguuacagaauuuaaaagaguuaaauauaccauuugcauaaacaaaacaaaagggaaucaacagucucaguaauacugauuaaugauuuagguauauugauaaauccucuuaucuggguucuauguuguuaguuuuauuuuccgucacauuuuguuuuucuuaucucugaugcacguauaaacauaaagcacacaaaagcuuuaguugggagaauuuaauucuuucugaaauucuauucggauuuugagucucacucuuugauuucucaaguucugagucaugaguguuugggcauaaaaaccugaugaucuuuuuuuaaauuuucauuagaaagaauuaaacaagcaaacaaucagaauugcuuaauugaacuacauuugaaaccaaauuauagagguaguuauaauuuuaucaacuuuuucuguccuacgaucuuucuuauuagacaagucugauaggcuuuguaagcaguauauaugacagguuuucauugaaaugcugccaguguugaagaggagaaaagcugauuuuccagaagugagaaagacaaggaaacagucacaauuuuuuaagauuaguugaggaauaccacacuuggcuucuuguuauugaaguuuuuugguguaggucuaacaauaaaaaucuuguaauauugguuccauauguauagcugcuuacuuguuucauguaauacuuucaucacaaaaaauauauaucuaauauuucugugauaaauuauaaauacaguauugguuuugguccuuggaggaauaaccuuacaaaccuuuaaagacuuuuaauuuuaauuuuuauuuucuuuccagcuuuauugaaguauaauugacaacugaaagacuaguugguaauugaaauuaggacucauuuuuauagucagacaauguuaauauuuaggaggagaaaugaugauuuauuaauaacuuuacucaaaauaccauugcauaaaaauuauacauauaauaaagugauuaaggggcacccacuuuuuauuuacuaauaacuuagaauauucaguaacuauuguuuguaaaaugaauuuucuuuuauccccaugucugucauucuccauucuuaaaauauuuuccucugugaaacaagccagcagggauaagccccauguuuuguuugaucuaguuaauuugacuuccuucuguuugcaauguguuauuauaaggugaaauauuuucuggaguuguuucuuaaucauuuuauuacucuuccuucuuguagggaaauggcgugccauuguuuccuucuuuuguuugcuaaguuaccugaauuuuaucuaagccauaguuuagguggguuagcuuuaauaguauuugaaauacugcuuuugaauuaacauacugcuuguuuacuuuauccuuuaaaauguacuuuaccauuuaauucuuuuaguagcacugagacauaaauagggcugaggaugauuuuauuuacauuuccuagauaagaaaauugauagacuaucaguuuaaguaacggccuaagaugacuaaguugaaaugagaaauuaggacugacauuaagauauugauuuuauuucaaacagcauucaagaagaagguuaguaguuauuuuagauaaaauuaauauagaaauaggaagcacaaagaauaagcaccccacauuucugauagauaccacaucuaaauaucaccuauaagaucuuccugagucuagcccuucuuacuuuuguaucuucaucucacaggguuucccuuguuucuuugcugcauccaugcugacucuuuuuuccagucccuuugcaauugcucugccuccuuuuaaaacaaaacuuuugcccuugcucauuucuacuuggagcugucauuucuuccucuuagcaucaauaacuccauuuugcuguuuagaucguaucuuccucagaaaagauguuccagacuucacuaagucaaauuccuuugcauagcucuuggcacaguugugguguuacuuuugugugcauguuaguuuuauuccuuccuuuaucccacugaucugaguuuacagaucagugggaugugacuggucuguuuuuauucauucuugugcccuaggugacuaauagcauagccauugagacauaguaggugcucaguaaauauuuguuggaugaguguuuagguuuaagaaaguaucuuugcaaacauuugcagcauuaucuuuuaauauuuauagcuagccagucauauaugccaauuucugcaucuaccuauuuguccucuuuaacuguauaugccauuagcagcaaagcaguaauauggauauuacuggcagguuuaagucauugacagguaaguuaaaacaacaaacaaacaagaagggaagggagaccaaguauuuaaaaaaacaaaacaaaaaaaaaggaaauggggccaggugcgguggcucaugccuguaauccuagcacuuugggagggcaagguggcagaucaccugagaucaggaguucaagaccagccuggucaacauggugaaaccucgucucuacuaaaaauacaaaaauuagccaguggcaggcgccuguaaucccagcuacuugggaggcugaggcagaagaaucacuugaaccugggagguggagguugcugugagccggguucgugccguugcacuccagcccggagaacaagagugaaacuccgucucaaaaaaaaaaaaggaaguaauuuucguaggguuguagaauuacagaacuugauggaauacugggguuuaucuagggaaaucugucugucucucuuuuaaagcuuuuuauuuugaaacuuuacccaguuugccucaguguuaacgucuguagcacaauaucaauaguaggaaauugacauuacugucauccacagagcucauucauauuucucuaguuaugcaugcauugauuugagaguguauguguguguguaggccagucauuuuuaagauaauagaaguuuauaaacuuguuuccgugacuuacucaaagccaccaggccaugaggugaaauaauugguuuuuaaacucuauauugcugucugcccaacagccaugaauucugucauaaaauucuacagauaucagggauuguucauuagcauuagugccagauuuagacuaauccuacaauauugaaagauacuaacuauaccuuuuagcuaacuguguuuauaaugacucaaaaaauuuaguucuaucaacuuggaucuaugucaaaaauuagaauuaaaauccuacuuuuguuuuugcccagcaggacuucucuacuauucagggaaaggccuaauuaagguuuccugaaaaauacucuuuaaucacuuggauuagaauaaaaaagaaaugcuuuuaaucacauacauaucugcuaaugcuuuucuucuaguaucuaauggcuuugauaauaaaaaguaguaauaaaacuggagaacuaauggauuuuaaacauguuucuauacuguacauauuauaaaauauguauacuuagugcauuaaguaguaucuuaaacuuauaccuaugaaguacuuacggucuaaaauugaucaggaggcaaccuuacuuaguauuuccuggaaguagcaggcauuuacuccuaacaagaaguacaaagaaauuaauauagaguuugauucagcguuggagucugauuuuuaaaaaucaaacuaauuucugucuugcaaauaauuauauguaauauuuccuacuuuuuauaauuauagaaacaugacagaacuauaaauuauuuucugaaucuauggaauauuauugauuuggucaguaaguuaucuaucauuggacauaaacagaagaguauauagguuuccuuugauuuuuuauuuugagguuuagaauuaaagucuuaugaaguuuagcuauuucuucgcuaaaugcuuuaaguuauacccgugcaaaaaccucugauuuguuuuuguaauuucacuaaaauaggcuaguuggugagcugugguguaugucuuaggaauuuaaaauaaaaauaaauauuaaacugcuuaagugaaucugguucacacacacaaaaaauccagguauuuuaauuuuuuaccaggacauuuuuuuaaaaagauuuugggccaagaaacuuauuuuaguaacagcaugcuauaguaaaugcaauuggaaauguaaguaauuaauuuuauugaauaaaauaagagcaaaacauuucccaauagaaaaucucuuugaauuggcacuauuuccagcccaauugauuuuuaaacagguauaaauucauagcagaaccagcuuaacuuaauuuguagagcuccuaucaagcaggucucaggguguacacguucugucuuugguggaaguguuaguuuauauuucaucuugaagccaguggacauuuuaaaguuucuuuuuuucuucugauguuuacaaauauguuucuuuaguaauuuuaggcuugcuaguuugcuaugcuagcuuauauuuuguuauuagggagugcugauucccuguuucuaaaugucccaucuuuuuuucucacugaauuucuucacuucagaaacaugauaaugggacauuaaaaucacauauguaguuuaccauugcuuuauuguuauuauagguauuauuaaacaguguacaugaccuuucccccaucugaucccucgucuguuugagaaaguagauaaccaaccaggauuuguaaaggaaaacaauaagaacaguguuuggcagcuugcuggggcagcuugggguuuauacauauuucuuucucucagacuuugaguuuaugacuccaccaaucauaaaaaagaguaagcauaaagcagaucuuuuaguagauauucugggauuaaaaacaaauccaagaugguaaugagguuauuguuuugcuugugauucuugguagacuguauguauguuuaaaaaauaagucucaaggugcuguuuguagacucaugaguggcuggcucugugaugggagcaucuacugagcugguaguauagccuccugcuaaucaucugccagcuucuaagcugcucaaggaguuaaaugacuguugauacaauuuuuaaggaguggaauuccguucuugucauucagucuauguuaauaaucuccuaugaugaaacucaaguguuggguauguuuguuuccugagcuccucauagacagaauauguguuuauauacauaauacuuuuuaaacuacuucugauguuauuauaacaagguugaguauaauaaaaccaaaguuauguuuuaagauuugcuuuauguguguauuugucugcuucuaucuguuucuccguugcauugguuuauccagauaucuuucuauacauucacugcugugucacuguugcccagaugggugcgugcagguagcugaacucaauaaauaugagcuaagugaaugaaugaauguuccuaaaugguggguuauuuugucuuuugagcagcugacagugauucugaucuuacaaucuaaaagcuacaauuaaguuaaauaauacauaguuuuaggaauuuuucuuaauuuauuuucagugcuccuauuuuugaauauacucuugcauuuuuccuaaagugauauuuaaaaacuguuacaggaaagcauuuuuaucaguuauuucuauaacugguuucuauaaaucaaccaaauaaacaaugaauacuuauuuuuuugaaauauaugcaaugaauaauaccuauuaaugcuauucucuucuucaguguacuuuaaccugaaugcauauuucuguugguggcucaaauagugagauuuaagucauagauuuuguuaucuacaaggaacaguuauuauauguuuaccauuugcaaaacaaaagaaauaugaaauaugacuccugccuucaagaaacuuaagaauauaguuggauaaauauaguguaaugacauaagacagcuuaguauacagcaugaaacuggcauaaaguuuauauuaugaaaacacagaucuuguccugauggaauuucaggugaaugaguacuuggacaacuuaccuguaaaauaaagacuacaaaacaaauacacagacagguccuuagagaaacacauauuacuaaagaugugggacaggaauaguuuaaagaucuuuuauaaguuuuuguauuaagcuaaagauuuuuaaaaauaaauuuucuucuuuaaaguuuguagguauuuuaagaaaacaucauuuuauaugaaaaauggcuuuguagaagguuggaaaguuaacuuaauauuuucuuuuaaaauuuauauggaagauacuuuucaucuugguuuuauaaggcucaguugaagacaaguguuagcacugaagcuuaaauaguuaagcuggccaaacagccaaaggaugaagaauauuuuuuaggaaaaguucugugaacuuagguuccuuauugguggcuuguuuucuaauuuuauaacauagagugguuacauauuuguuaccuacacaaugauaguguaaugacugagcacucacugacgcaucaagggaucccaauucuagucuugauucuauuuccaacuaguuguaucaugcaaguccucugaguuccuuuacuuaucuaauaauucauggaguuacaccacaguaugucuaagguccuuuccagcucuaugcugauauauacgauucuacuucaaaagaaguuauuccgaauaaccuuugcacaaacucacaguauagucuugagaaggaucucaguuuuguuuugcuuuuuuuucuuuaaagcaaauaaggacuuuuaaaaauaaauucucauuauguuuugugccauauauaauuacauauauaauuauaaaauguauauaaaaauguaugauuauauccaacuaugaugaaauuauguuuuuccauuaaauuauauguguuucucugaacauaggauuuuacuucacaaauaagacuauguauugaacuguuaaaagggcucacuggacacauaccagauucucaggauucuuuucaagauuauauugcuaguuagugcaauaauaucacugguaaugcagaauaucucuaccuacgaggucuggacauguugcccaaccuguucacgaacgccugggcucaggugauccucccaucuuggccuccagaaaugcugggauuacaggugugagucacuguguccggccauaucacaguuuuuugaggaaaaguagaaucuuuaagaaaauaagugacuaaucuuucucaaaaauuuaaucugguaaaauuuauuuaggugacauuugaauguauuagcagaaauuuacuugaaaaguuaaaguuuccuuucauauaaugguauucuauuggauguauguaugauguacuguucaacguacuaauugacuuaaauguuuaguuugguguuacucaaaauuaacuuauugcuauaguuagauagcggugagugggccuaaaagagcuuguucgugucccugugcagcucaauaacaguagucuagcaauucauaugguuccauuuuuaguuuuguaacaaaaaugaauugcuuaaaaaauuuuuuuaaguuuuggaagcaacaaugaauguuuuacacaaaucagccucaauuaaauuucuuuaauucugguaaauuaagauuuaguuuucuaaguauuccauauuauugaccaguauuuuaacaguuuucggauauuuuugccauaucuccuuuuugugcauuucuauccaucaauuugccacugaaaauuaaaaguaaccuguugcaggguaguauuucaaugaaaaaaaauuaaaaguaacuugguaugacaugccuacuucccauggcaugucuguguucuuugaguugguuuucagccagcuauuuggcaaagcuuacugggggguuaugacucaucauaucuuugugaccuuuaaaaagaauauccacuugcuguaacagauagggaucucacacaauuucuguuuuuuuuuuuuuuuugagguuuuaguauuaggucacaaacccauauaaauaguuaccacuucuauuuuuguuuugaaguggaguuuuaugaauauuugagaauauagacagcuucccauugaggauuguauuccucguccagagguuucauuucagugguaaauacgguuaaguuuguuacaagguauuuacaugaguauguacagaaguguauucauuuaugcauuaauucaacacauacuauauguaaugacgucuuaaagugagaauuaaaaaucucucugaauuucugaguuuuuaaacccagaaucaauuucauucacauuguucuuucuugagcaaaaugucauuuuaaagugagaauuaaaaaucccacugaauuucugaguuuuuaaacccagaaucaauuucauucaucuuguucuuucuuuagcaaacuuuucuucuguagaguuccccauauguagaccaugggaggaauaggcacugugggaacauagugguuuaugugacuggcuuccuauccuuaagaguaauuuuuuucuguuuuuuuuuuuuuucuuucccuuuucucccucccucucuuucauucuuucauucuuauuucuuaagaaucaugcaguggagauacgugaauauaauucaagguaauaaaagaauuaauguccuacuacugaugguggcaaagugguaugcggcuucagagaauagagugauuaauuccaauuucggggacuggagauaguuucacuaggagaugaauggauuuugauaaacacccaugugagggaaggcucuugcagccugaagccguaagacauguaaaggguuuuuaaugaaccuggcaguugagggaauaaaauauaguaguauaagaauuugagucaucggcugggugggguggcucaugccuguaaucccagcacuuugcgaggccaaggcaggcagauugcuugaggcuagcaguuugagaccagccugggcaacauggcaaaaccccgucucuacuaaacauacaaaaaauuagcugagugugauggcacaugccuguaaucccaacuauuugggaagcugaggcacaggaaucgcuugaaccuggaaggcagagguugcagugagcugagaucaugccacugggcaucccagccugggugacagggugagacucccucucaaaaaaaaaaaaaaaaaauugggggccauauguuuugaggagagauguaauaagaaauguggcugggauuuucucguuuggccuggagagaaugaaugucaugcucagaaaugcgaacuuuauaaaaauuaggguaccauuggcauuuauuucaggagguaaaugaagugaucugaccugugcuuuagaaagaugaugguggcagaguauggaaaauguguuaaaggugauagauuggaagcaguggaaccaauagguggccaugggcuauuguuuggauaagugaugguaagggccugaccucucaaacagcaacuacuguggugguggguauggaaguuaccaugcagugaagaagaggaacugauaaauauaauguugcuuacuuuuuuuagaugguugguauggaggguauuagagaugggauacucucccacuguggaguaaggauaaaggaaggcuguucuacuauaggggaauauauaaaugaauucaaggauccuuaaagauccuugaaaauaaagaggagguaaaaacuaaagagaaauagaaacaaagaauggauauaacagauguugggagcuggugaacuuuaaggacaacaguauccaacagaaguaucauguaaguacagguaauuuuaaauuaucuaguagcuauguuaauauuaacauaaaaauaagcaaauauaaugaauuuuaacaaucuauuuuauguaaccuaaaauauuuaaaauauuaugucaggauguauucauuauaacaaauucuuaaugagauauuuuacauuuuuuuuuuuuugagacagagucuugcucugucacccaggcuggagugcaguggagcgaucuuggcucacugcaaccuccaccucccagguucaggcgauucucacacccuagccucccuaguagcuaagaucacaggcgccugccaccacgccuggccaguuuuuuuguauuuuugguagagacgguguuucaccaucuugcccagguuggucuugaacuccuggccuugugauccacccgccucagccucccaaagugcugggaccacaggcaugagccaccacgcccggcuuuacauuuuuuuaaacuauuugaaauucaguguguauccgcauuuauagccuauuucaauuuagagcaaccacauuugaagugcagaguagcacacauccugagugaccaccauuugggcauuugagauuuaagaagucaacuuuuuaaaguccucuaugauuuuuauguguauauuaaaaauguugaagcuaggcaguuuaagugugcagucagagugccaugugagaacuaacuucauaaaguuguagccuaagagaaaagcacacagacuccugagugaacagaagaaacuuacucucgacauuacccuaaaaaucacuccuguaauugagugucuuguuauuuucaugaacuguuuccaguugacaguauuauuaagucagcaauguauuuuugaggggaaaauguaacuuaaaaauuauagugaaaagauaagugaccccuucaaguaguauaacaaauuuaaguucauucuauuaucuuuaagaauguguacccggcuuuauuaacuuuguuauauuaaucaacuuccaaauuauuuugauuuucuacuaagaauggacugucuccuuacucccacccccaguuagaauuuuggaacaaauaauuaaaacuauuacuucauagauuucgaggauagagaguggggcucaagugagccacaacucccugugccuuaccugacuuucgacuugagaaugguggaaguuauaaacauugcuuugaguuaggcuucuuuuuacugacuuuugaaucaugaggagguaggugguccacuccaugaaaaugaacucugaacgucuuuaugcuacccuugacacuuugaaaggagccguauuuaauaggaaauagcacuuacggaggagaaucugagacaugcaagccgccauacaaagauaaaucaacaggggcuugaaaaauaaauugcaggccucauaaauucacagccucucuucuaaaauacuaagccuaaagaaauaaguagaaguuccauaauuauucuacaaauuguguauucugaaucucuuggguaauuaucacaacuaaaaauuacguauuacaauaaucacaaccagcaaauuaccugaaauugcuugcucagugaauaucuuucaguaaccaaaauuuguacauaaaaugacuaugcaugagugcuauuuauaaugagcacuuguuaauauuggcuguguaaagacuucuccgauuucucuaauuuaauuuucaucaacacuacggguuuaaauaguaccugcuucaguaucuaagcaaagggguuuuauuuuuagaauaaagcaguuaaauuacacugguguaauggaacacuguaucaaaauauauacauauauguguauaaauucuaagaaaauacuauuuaauucauauguuaaucccuuugcuaacuucauuacaauuuuuuccauuaaaugaaaauuaagugucuucuaaauguuuuauggaguucaaauuaaguaguugaauccacugaugacuauaaaaugugugagcugcuucaauaguuguauccugaaguacagauugaaggugugucuagauggagccagcuguacaucuuccucuucuaagcuucucucccaaaacauaggggcaaguaaaugauuuuuauagguagaugcuuuuaggauuugaauauuuuugucauguauugguguuagcuguggguccguuacaaaucccgugggaccuucauuggugugaacauuaguguaugggacuuccagucugaucuuuggcacccaugcaacuuucucuuauguuuuuaguuggcaacucuggagaauacugguuccuaagcucuuuuggcucacagauaccuuuaagagucuaauggugaccuagggauucucuuuaccggagagauguacauaagcaugugagcgauuuugcauaaggccaaggaggaauuagugagacuaagaagcaaacugggaacuguuccagcuggagaggacacuggugucugccuguuuagguaacugcaaaucuuaugcaugaaagcuacaguaaggaaagaggcuaggggcaggggccgaguaaugaagaaaagaaucugacauccaggaugcugcagguaucuuuggauguaugaguuucucccugggguauuucagauuuauuucauguuaguggcuugcuugugagauuuuucuugaagguuauuacagugauucagugaguuauuguuggcuaauugauguuuuuaucauuucugguuuaaauguauauauacuuucauucacgcauuugaacaaggcuguucucagucccuuuuagaauccaggcaacuuccucaucuuuccccaccauccuguggaucuuucaggauuuuuccaagguuacagcucaaagugucguguugacaggcuggagcuugucaccauuucuaaaguauguuuuugaaugaauucaauauccuugauucuuaucccaaggaguuuuaacacacuuuuugucauuguuguuguuguuagcaguaggcuagcuuagaauuguaacuugcccaugccaaagcaacaacaacagauugcaaaggaaucuucaaaaugggcggugggcaaggcccagccuguuuuaggaaguccccuagcuguuugcuguaccacagugaagaagaaagugaagaagaccauuucauguaaaugaaugcagugauguggguaagcacaucaaaguucuucguaaaaugaaaaaauuguucagaccugucuuaaugguuaaugcuuacuuaaaagucuaaaugacuaauuugacuagccauuuguuagaggauuacucauuuuaacuuuugaguuccuuauacuuaaaguagcuaaacacauuuuaaauaaucuguaauacauuaaaauauuaaaaauaugcuuuucucauuaaaaauacuaucuuuuaccacuuuuauaaguaggguauuuuacacagugauuaaguaucauuuuaguuuccucuaccuagguuuuauaagcuauuaaaguuauagaccauuuaucuguuaauaauggcugcugcugcuuuuuaugcuauuuuccugagugcguuaaagguuauuuuuauuaauuagccaauauuucagcccacaguaaggguaaauccucucuaaaaaauuugguuuucagccugcucaacucacaagcgauuaagaaaaaaacaguugugagaauucauuagugaaauauuuaagaaacauguuuuaagucucuucccgagauuuuuuuuuuuaaagcaugcugagauagccuucucucacuuucucccucuuacuuucacaugacauauaagccaaauggaucaguucuuuuugacaaagugugcauuguacugucauaauuuguuuucauguuuauuaucuaaauucgauuuguguagcaguuugguaaaacccagauuauauguaugucuuuucacuuuguuccuucuuucuuccugugguaauuuacuauaauuguauuuucccaguaagucagaucauauuagagacauuauuccuuaauuaucaguagguguccuuggaauauugcuuagcucacaggaaguggguggggggguuuguguauauuuuguuuuccuagaaauuuuuauguaauucuagguuauugucaacaaccugcuuguaaccagacaaaaccuugcuauuucaauaagucuaaggcuaguuguucugucaaacacgugucuugacagugagucucagucauggugaugcaucagaaaucaucuggcgagcucuuaaagcaauaccagugcuuugguaccgcuaaggcugugauugaauugagccaggaugggcccugguaaugguaggcucuacaaguuccucagaugauuccgauaugcagcucaccuugggauucguuguguguuagaaggaacuaggaagcauccuccuacucagugguuuucagccuuggcucacauuggaaucaucugggggaacugaacucucuaauagccaugucccuuccccagagauuuuauugauucucugggauacuggucugcacaugcggauuuaauaaaauagccaggugauuguaacauacagguagguuugaaaaccacugaccaccgcuucuguuuuucagaugaggaauuugaggcccaaaccaaagagauuaggugacuuguccaagauccacagaaccacaacuagaacucagaucuucagacuuguuaucaaauguuuuuaccaggacaucacauauuuuuaagaaaaugugggcuuugguauuucagauguacuuuuaaaauuaugucccuggcugcuuagucuaaaaaacaauguuuauuuuauuuauuuuaauacuggaaauaugaaaggacaugacuaagauccagccauuaccuuaguuaugacauaagagaccuuaggagcugagaauuagaaacguucauguauccuauaacuuguccacauuuucuagaagcaaaucaggcaaauaaauaacccaacugaaauuuucuuagguuagauuaacuccaugucacuauuucuauagcaggaauuguaaaugccuguguuuauaacaugggucauucucuaggagaauguuuaaaaaaacauuuuauuguuuucuggguuauagggugaauauuauagaaauuuuggaaauauaugaguauaaauaaaaaaaucacuuguauguaaucuuaucauccagagauaacagcacaaacguuauguugcaaaucaaaauggugaaaugccuuuuuaaugcuuguuaugcggguguuuuccaguugugcauagaauaacuuuauaugaaaggcacugaaacacacuucaugaugcaacuguugccucaucuauuuaacaaaugguacuaauugugccuauuuauguaguuaauaaaaauguaaagauagcugaaaaguagcuuuuccaugcucuaauguucucuuacauaacgucuacccaaaauauccuuguuuguuuuuuccugcccuuuguuuugcuaauuugcuuuuuuauuuugauaauacccucuuaauguuuuuacuuuuuucuucauuuucuuaacugcagggauuucuuuuuuuuuuuuuuuuuguucuuugucauuauuuaccauguguuucuuucucucacugcuauucauuauuuucccauuucuauuuuuauuauucuggucauuguuaaacauuucauuuuuccaucuagauacuuuguuagaucuugaaggauuagcaacuaauugucauccuugagaucucaucuuaacuuuuaaucaguauugauauuucuuuuaaaagaaacaagacccuuuacuguucuggaguccaacuuaauuagucaccuuuugucuuucucugugaugcuccugccauccagaacaacagcauaaugccugacccccucugucucacacacauauaaggcaggcaguuaggagauuuugacaucuaggcugcagcuuuucauugaaaaucuugcagaaaaucuuguguuugcauaaaugcaugucacucaaaauaagcagcaaaggggaaaaaaaagaguagcucuuggguuuuaaaagaggaaguuuacuuccccuacccccagucucaauauuuaacaucugguucugacuaaagauggggaggaaaaacagacuuaaaucuccauucauccugucuuaccaccaaacagugugaucacugauagcauuucuauuucuguuguggucuguaugaucagauguuuuuguuaaugauuuguaagggaagauaaugccuuauauuucucugagugguuauaauguaacgugccaacauuucuaaucucuagauagggcuagauuuaaucauuauuuaaugaaacuuugaaggaaauaaguuauugcuggaccucauguguuucugucuuauuucaaagagaaaacaaaaaacagaaaccuuuaauuaaucuacugauaauauuuauuuuauuuuaaaauuuuaauuuauuucaacauuugaauaaguaauacauucaaaugggcagaagugaaacagucuugugagauaccuguuuuuuaaaacuccauuuuagaaaaggaauuaacuaggacuuuauaucucuucguucaauauaauuuuaaagaagaauuguugaaaaguagauauguuuugccauuugcugagaauauuuuguacguuagcuugucucuuacaaaaacuaaauguguuccuacuucugauaauguaugucaauuuaaaauuuggaauggccaagguaaguugcucugcaucugcccuucauauggcuccugagcacagcucagugacuggcccuugcagugcuucuaccguuguaauggguaaaaccaggggaaacugccuugcucuugagcuugagcagguuaaucaaaaggauagagcuuccacuucucauuauucuccuuucuacuuugaugggcagaauaaggggaugcucauggaagagaaauucacacccaugaaaagcaaauugcccugaugucugaaucacauuacaaauuugaauuaaauuacaaacuuaaaucaagucuaauguuaccuacauuguuguacaugccaucagaaauucaaaagcauuuuauuggacaacugaauauuuauugaaguccagaauuuauuauguaaacuuggugguuagauuuuucuuucucuuucucugucuuuuaaccuuuauuuuagguucaggaguaaauauguagguuuguuauacagguaaacuacaugucauggggguuugguguacagauuauuucaucacccagguaauaagcauaguuccccauggguaguuuuuugauccucucucuccuccugcccuucacccucaaguagccccuggugucuguuguuccccucuuuguguccauguguucuuggagagaacuaaacaucaagugagagcuaaacaagaggauauaugguauuugguuuuuugcuccuacauuaguuugcuucagauaauggccuccagcuccauccauguugcugcaaagaacaugaccucauucuuuuuuaugacguguaguauuccaugguguauauguaccacacugucuuuauccagucuaccauugauggcauuuagguugauuccaugucuuugcuauugugaauaaugcugcaguaaacauauacguucacgugucuuuaucguagaaugauuuauauuccuuuggguauauacacaauaauggaauugcuggguggaaugguaauucuguuuuaaguacuuugaguaaucaagauugcuuucacaguggcugaacuaauuuacacuccuaccagcaguguauaaguguucccuuuucucagcaguguauaagauucccuucccagcaccuguuauuuuuugacuuuucaauaauagccauucugagugcugugagaugguucccauugugguuuugauuugcauuucucuaaugauuagugaugaacauuuuuuccuaugcuuguugguugcauguaugucuucuuuggaaaagcguuuguucauguucuuugcccacuuuuuaaugggguuguuuuuugcuuguaaauuuaaguuccuuauggauucuggauauuagacuuuugccacauauguaguuugcaaauauuuucucccauucuguagguugucuguuuacucuguugauaguuucuuuugcugugcagaagcucuuuaauuaagucccauuugucaauuuuuauuuuuguugcaauugcuuuuggcaucuucuucaugaaaucuuugcuaaguccuauguccagaaugguauuuccuagguuaucauccacacuuuuguaguuuuggguuuuacauuuaagucuuuaauccucaugaguugauuuuuauguaugguguaagggaaagggucuaguuucaaucuucugcaugcuagccaguuugccuagcacccauuuauugaaugggaaguucuuucuccauugcuuguuuuugucaacuuugucaaagaucagaugguuguaggugugagguacuauuucugggcugucuauucuguuccauuggccuuuguaucuauuuuuguaccaguaccaugcuguuuugguuacuauagcccuguaauauaguuugaagucagguauugugaugucucuagcuuuguuguuuuugcuuaggauugcucuggcuacuugggcucuuuuuugauugcauaugaauuuuaaaauagauuuuuuucuaauucugugaagaaugucauuguggaaggaagauaaauuuuuaaaaaaucacgguguuggccuggcauaguggcucacuccuguaaucccagcacuuugggaggccgagguggguggaucacaaggucaggaguuagagacaagccugucucuacuaaaaauacaaaaauuaaccaggcauguuggugggcaccugcagacccagcuacucgggaggcugaggcaggagaauugcuugaacccgggaggcagagguugcagugagccgagauggcgccacugcacuccagccugggcgacagagcaagacucagucucaaaaaaacaaaaacaaaaacaaacaaaucacaguguuaugguauucaccauaaaagaugaaaaacaaaaaaccauaagccaacuuucugauauuagccucaguucauggacuucggcuauuucacauugagcuuugggcgacaaguuuugacagaaaguagagguuccucuccuguggucaugagcuuguguuucaaggaguuaauguuaagggugcagaagucucuuucuucuuuauccagagaauaagggggaaauaaauacauuuuauacacacauacucaacauauaucuauccacauauuuaugcauauuuauagucauuaauauguaauauuuccacauaucuaacuaaguaucuguuucuuagauaaaggaaauuauaugauguauacuuguguuuuugguuucuuucgaucaacauuaugauggugagauucauccuuauugcugcauauuguuguacuuuguuaauuuucacugcuguuuagguuucuaguuugugacugguucauaauugaucugcuuauugauggacauuuguuuugaauaauguugccauuggcucacgccuguaaucccagcacuuucggaggccgaguugggcagaucacaaggucagcagaucuggaccauccuggccaacauggugaaacccugucucuacuaaaauacaaaaaauuagccgggcgugguggugcgugucuguagucccagcuacuugggaggcugaggcaggggaaucucuugaacccgggagacagauugcagugagcugaguuagcgccacugcacuccagcccggcgacagagugagacuccaucucaaaaaaaaaaaaaaaaguugccauuauucaaaagaagguucugugcaugucuuuuggugcauauaugcaugcauuucuucuggauauguggaguaagauugcuggguuguuggguauguauauacucuguuuugguagaauguauguauauauuuuuaaauguaguuuuauguauuuaugugguaucuguuauuaacauuuuuuagucauuuaauaaugaguuguggcuuguuaauuguuuagcucacaagaacgucuugccuacuuguauuggggauaauacgauaagguacgcauaguuucaguggaacuuguaguucaaagacucaauucuagccccuaguugguuugugacauugggucugucacagcuuuagguuugcaguuucaccuuuauaaguaagaucgaaauuaauaaaugaucucugaggugacuuccaucuguacaauucugugauuauuucaaaauauccuaaaagacuguuacagaaguaugcuuuuuaaaaauaugcugcugacucuggggaaacaaacugcuccguaagguuaaugucagauuguaucuuuuuuacaguaauuaaguaguauuagguuaggcagaaaucuauuuggauuuuucaguagcaagccugacuuuuaguaauaggcuaguucacauaagaccgauauuaaaauaacaguuuuuuucuuuacaugguaacaguugucaagaaauuucacagaaaauauucauaauuaaauuaaagcacuacaaguguauuacuuacuguuaaguaauuugaugaccgggaauuuuaugcccaaauaaaucuuuguauuuuguguuacauuuucaguugaguucauugagucagaugggcaucaucagucuuauuuuuaguguugcauggguauauuuuaauaauucauucuuuuucucuuggccuuuucccauauauaaacucuauuugcaaguuauuuucagaguuggaaaauaaugagcuaauauuuucauacuucauauucauagaugaauaacuaguuauuagcaggccauauuuaauuuauuuuuguaagaagcuucuuugucacccuuuuuugcauuucuuuuucaaaguuuguaguguauauugaguuguucuucaccugugauuagaggcauguggauguacugcaaaguggaacagcuacaccucggauuuuccugagaguugcuccugaugaguuccuuagcacccauuugugacguggaacuggaaguuauaauaggcauuuuagugaaucuuucaugaaauucaguuuauuucauuuaaauggauacuuuuuuuuuccugagauucuuuuccuuguucuucuugugugaaaauauuaaugacagguaaauaauagauuuuguguuaaugguguuauuugaugaacuaaauaagaguccuaugucaaucccucccccuuccuuuuuuuuuuuuuuuuuguuaaacauuuuagcaucucuuaaagcaucuggaaaccagagguuuauggaaggaacaccuuccuccaucaguuccuuaugaaaagacuugcuuccugcaucccagcuuuucagagccccuuaguucauuuuacccuuggcuuauuacuccagggccagcuucccagagagugcugggcaugcuugugugcuccaccaagaguucugccuuucacuuuccuucucucagguaccagaauguagcggcauuuccuguaggauucugcagcugcuccuuucaaaucacucucuggccuuguucugugauguugcauucaacaucccaccacagacugugucaagaucuuucucuuuugauuagagguucucaggacaaaauaaguuaacagugcucgacugacauuuuccaaggauauuuaugcugguggaagcaaucaggggaggcccugauugcucuuuaauuauuaaguuacaaggagauacauaagaggaggaaaaaucaguuccagaggauaaagcaucuuaguggugcauuuggagaaaauacuuuuuuauuucuuuacugguuggucuuaccuuuuuaaauuuguuuccuccuuuccugaccuuaaggauagaacuagacaccgcagauggauuguuugcauuuaggaaucucagagguuaauggugauugauggagauuauugagggaggaacuaauuugcuccuuucucgaauuaggcagaggugagucacacuuagacugaacuugugaugugccugguccucuuccauuucuuguagugggaggaagcaaggaaagagccgcccucuuucugaccuuuggcagucuguugacccaucggaagaauuuaauuuuucucccaggauagaaauguggggguggacugggguguggugaugagggaauuaucagucugauguugauauuuacaaaugugaaaaguacacgcugucccaggacugggcugucaaagacuaggggaugaguacuucaggguuauugagcaagagggaugacaaaugaaagucccauaaguaguugcccuugaggucugaccugagagagaagcuaacucacucuaaaacaaugaugcuccaguccaguagugacguuagcagccuccccacuugggagggacugacugauagauaugugguuugggacaacagagaggaauugcuuucacaaaucuuuaaguaaguacugagaucuugaagaugcuuuagauguaguuuuaccuagaggcagagcaaugaaaaauaaaggaucuuuugaggguccugcuaaaccagugcuuucagacauuaaacuugcauaagaaucaccuggggaucuuauuaaaguauauauucugagucagcaauucuggggugggaccugagauucugcauuuuuaacaagcucugagguaauugcuaugcugauggucuaaggaccaaauuuugagugccauuauuagacacuuauuuaaauaaaauucaaauuaagauucaccacuccguguaguuuuuccuucuuuacacuuaaauaugaaaaugcuguaaacaagauauuguauuauuccuuguggcauauauaaaauauuauggaauguacgugauaaaaauagauauuaauaaaauccaaauuaaacucaccaacuaacauaauggaaauaaaugcugaucagaaaccaaaugcuaggccacccauugcuauuuacagauauccccaugugguacuguauucauguaugugugacaccagaugucuggaaaacagauuuuugugacaaauuuugacacaggaaauuuaucuugcuccauaaaacuuaauggaaaaauguaaugcuuaacuucaguccauuuuaaaagaacggauuucaguguaguccauagaaucaagugggauuuauucuugagagcugcuaggagucucuuuaucaagagaauuaccuaagacaacgucaguggguggcaugguauuugauugguuauugauaauauguguuuugaguuugccauauucgcucaguauucuauuuuagaucaugaauaaaggauauauuucuuuacuacacuaaauauuuaucagaugaaucauuucuggaagugagggaauuaacugugguauuuugaaagagaaacacaucuuuucagaaguacaucaacagugugauuucugaauguguuucaaacgguuaauacaccaggggcugagacuccgccaaaguagaacaucugcuucuaagacauaggcuucuggugcauucuucucugugcacuauuguuuucuuuugcuuguuuucucaauuuguuaaaucuagauuauauuucauaaggauacagggaagaaacgcuccuagcucauuuguuaucuuacaacagagaaaucuucaacagaucuuuuaaauuuggguaaaaaucuaagaauuccuaaugauuaaauuaugccuggugauaacguauuauugaaagugguuuucuguuuugaacuccccacucaugcaguucucccugguggaagcaugguugcacaugcagaccucugaauuccugagcagcauggauagaagggguccugugcuggugcagugggcagccuggauggggaggcaggguccuaucuaugauguguucuugcuccccuaucagccucuuuccugaauacacaucacuucuaucccuguagucugucauauugccauacuggucuacaucuguaugccuucaucugccaggcuuguugccuggcacguucuucugcauuugcucugcuccucuuaacagaguugaacaccucucuuuaguuccuguguuuuggaagcaccuugaaugaccuuaguuguacaguuagaguguauguaauuguguguuuuuauaucuaaguaaccacuagacugucgacucccagaaagcaaggacugaacuggucuuuaucuuauauuuccauuaccuaauguaguggcagauuuuagcagguccucaaaaaagguucauugagugaauaaacuuuauuaaagucgauggaacuccauauauguugauuauaauuuucaugcauauaaaaucaaucugaaaacagggaaaacugauaguuguguaaguaagcuauacuuguagacaaagaagcagcaagcugugacaugaguaagauguguaagaaaauguaaagauuuucuagugcugcuuugcagccugaucuuuguggauuauuuguagcacuuuuuccucuauuuuaauauuuaauuccuuaagaaauaauuaagcaagaaaucauuuuaaaaaaguauacaaucuuccuaucauuuugauguuuaacagaaauauuaaaauuuguuuuuaaaauuauuuucuuauuuuuauuacgacaaaauaaucaguaucuucagagagaaauaaugguugauucuggugcuuaccauauagauuaaguccugcaagucuuggguauagcagugcaucuauugaauaaccauuucacuaauaacauuuacacagguagacagguacagugaucuguuaagcaauauuuuuaaauaucuucuuaaaaguauuguaaugaaaggucagguacagcuggaugccgaaagaauuacgcuaaaaaaaucaguauguaucuuuaguguuaauaaguaggauuauuaauagugcuugacuuuuaaacagagaccccauugaauagaacuagacaagccaauauccaggaugauuucuuaucuagacauaugucaaaucuaguuauguuaaauugucuucagaaaacacauaauuuaaauggcagcguaauuaaaagacacugcuguuaggucuauaaacauucuaugucuuugcuuacauuuuaccacauacaaugucagggguuuuucuaccuuugagaacuuaaaacuuguagaaauuaagucuauugucaguagaaaucaguggauuagcuuaaugguauuuucacaguucaguucauugugugguuaucuaaguaaauacguuuugggaauuaauugcaguaaauuccuucugauucaaaucuggguaugcugcuuuccaaauaggauaguacaaauuuuuucuaaaaacguucccugguugguuuuuuuaucagagaaaauacagaacuuguaaaauuuauaauuuuuaauguaaaaacuacuuuguuuaacaagaauaaaauucuuaaauaagauguuugauacuuucuacccagcuucaucacucauuucuauucucagagagaaaagagcccuauccuuucaagugcuagaauugaguaucgugauaauaguaguagauugguagcucuaauagugcuaauaacaauuaacauuauugaaugcauacucuuuaucaguuuucuaagcuaauuauuuauugcuguauagcaaaccaccccaaaauuucguggcuugauuuaacagcaauuauuauuugucaugguuuuguggguuuaccgaauguuuuuucugcuucauauaauguugguugggaugcuaguucagcuggaagguccaguggcuuuacugucaugccuagcauuugguacuuggcagcugggaacauacuugggucuuucuacgugauuucuuggacuuccucagaacauggcagcuaaacgcaagagcauuuuuaaagaggcagaggcagaaacugccaaacuuuguaaugccuagccucaaaaauuuauguagcgucauuucuaccacauucuauugaguaaagcaagucacaggcuacuucaguaaaaggggagggaaauagacuccccuguguugggaagagugccaaagauuuuguggccauuuuuaauuuuuuacagauugagcuaaguacucaauccuuuacaaaauuagcuaaguacuuuuacaauguauguuuuagggaucagaagacugagacuugaagagguuaagucaguguccgaggucaucuaguuacuaaguaccuuaagcuuuagagcaagcuuguccaacccgugaccuggcccaguacagcuuugaauguagcucaacacaaauucguaaacuuucuuaaaacauuaugagauuuuuuuugugacuucuuuuuuuaagcucaucagcuauuguuaguguuaguguauuuuacauguggcccaaggaaaccaaaagauuggacacuccugcuuuuuuuuuuacuuuagagcuggagcuuuucaccguuguaauauauuaccuucaaugguauaggcagauaaauuuguccuucugcuccaaagccaauaucugaggaaguuuuauuuauguggcgggauaauugucuuugcagucagugagauuauaaagauauuuggaucacauuauugaggagccaucaugugguaaaaguagcagucucuccaaauuuggaaauuucugaguuguugggugauaugaaagguaaaauuuuuacaucugauguuauccugcgucuacuacaaauauuagcacauugccucaccaagagcaaauaaauaagucagcuucuuaaaccauaaguuucccagugggcauauuccauucuacuacaauuuauauuuuucauaugguuucaguguucuaguguuuacuauucauuaacaugaaacacagauuuuaaauugccuuuuuaaaaauuauuucugcugcuuugugguuuucuuuguuuugagggccauguuauucauggaguuuucauuguuaaaaaaagaaaaaaagaaaugucaguaaugccugugaugguaaagaacaaaauaaaagucaaggcuuucaaauauacuaauugaaaguuuuuaugcuuaugguaauuugaguuuucuauguuagauucuuggcauacugccuucaggauuucuucagucuaagacugaggcauauugaggaaagucuguaaguugaaaauaucauauagccuauuguacuuucauguuagcuguaaguugugaaauggauucacaguuuuugcuuaaagcauauagacauuuuagcgccagaguuaucuagucuccugcugaucagaauaaaagugguagauagccccauagaauguuauggggccauagaacguauguaccacaacccccugguuuuauagaagaagguuuagauaagagaagcuuucacucuuguucauaucauggaauagugugaagggcagaguugugucuagaaaccuggucugucagcacuguguuuucuuccacuguaucccaguauuuccuuaauuagccuuguuauuagaaauguaaaccaaguauccaagaagguccugucaccaccacucagcuguagaauaaguuaaauccagcuuaacuuuugcauuugugaaagucugagaccuuuaaaaaaugcuuagucgucauuguauucagaaaguuuaagacuucuauagugguucagggaaauuguacugcugagaacuaguagguuauuacagccauguuuuucugugauuacuuuuuauuuuucauuuugaaagaaaaaaacuaccuggcauagucucaaugcuuuaaaaagacaggauuuuucugugagaccauugacaucuaaauuaguguucucuugaacuguuaucaugcauauuaagacauaucauauaucuaauaaauggaaguaaaauggaguuaauugaaucaucugguuggguucagcuauaccauuucuuucaugacguuauaugacaaagaacacaugugaugugcuaauuuaucuauauaacuauucugagauuucuugcuccuaauaauaauuuaguuuuaguugcauuuuuuaggagacuauuauaaaggaaggagauaaaucaugaacuagauuuaaggauccagaccccuccuucuguuuaaagcaauuuuagacuguggauuuaaguguuugagcuuucuguugucugguuuuuauuuuaaagauaugaaauuagaacuaagagguuuuucuuuuggggaaggauauggaaaaaauacuggugugccauuugugaauguacuaugggggaaggacuaacacuuuuuagaagauugguaaucaauggucaugcaagugguuuggcuugagugccccagagaugccuucuccguuugaaagccgaagcagcgugguugccaguggagccuuucagaguaccggagacauugcagugagucuggaaaucuauucugucuccaguaggcacaucucagguuuaucagagaacaucaauauaauggcuuuuuaaugacauuuuuguuucuuacugaaaauagggcaauuuaaagaauaaaagaaagaaaaaccauaguaauucuacuaaccagagguuacuauugauaaugccuuuuuguguauauccuguauuuguuuuccuauuuacaacacaucaucuauaaugugguauuuauagccuuuuaauuuaauagaacuaagauuguacugagcauaguaucgauuacccugccuuuuucacucuacacuuucauuuuacccacuuucccccccccgauccucucacacaguguuaugugugagaauagauuuccagacucacugcaaugucucccauccuucaaagggccccacuggcaaccagucuguguuggcuuucaaacggagaaggcauaucuggggcacuugauaugcacuugcacuaccacugguucccaguuuucuaugagguaucuauaucagaucauggcuaaaaugagugggaauugcuuggcaaauuuguguuuguuuuuaucuuuauauuugcacauacugaauaaagauaauuuuaauccuggggaagagguagaaaaaaucucaugauuuuaguuuucucuguuaguauugcacgacauaagcaccagagagaugacuuuuuuccuccuuugguucauuuguauuuuacuuguccuauuccaaaagaacaguauugaaaugagacacagguaucaauaaggaaaauuuccagagccagaagaaggaaggaacugucagggaacaauuagugugacgggaaacuauguuaugcuuccucagaaaguaugacaaauauguuacauuuacuugaguuucuggaaacugcacaugagggauauagcauuaauuuccuuugucuuguugguauucuguuuuaccauucaugaagaaagaaaaaaaaugagagaaaauaaaaggucucagaacucacagaguaaagauauuuuucuaauugaaagucaaacuucagaguuguaauucucuguuaaaguggguuuugguuaaaaauuauuuucuguaaacuaauuuuauaggcuauuccuaucugucuguucauuagcacaguuuuggggucagcaaauuauuccuuauaguuuaaaaauauuuuuuauaaucuuugaaauuaacaaacuuuuauuugauagcuauuuuaagaaguuguuacagguguaagacuuuuucuucucuaacaaagaugugcgcugauagagcugaaacacaauaucuauguaaaauaaccauggugcccuucaaggaaaccuuugugcccuggcagauaaaguguuguggcaugucacauaugggaagggguagggaaaagauuccauguggguauuuugacguaaagcuggugcauuugagaauucaacaggcugagacauagaaacauuguaucagaguagggugaacgaauggcuuaacucacggaaagcagaccauuuggauagcuuggggagaaaacagaaguagugugagaaaugguggaaaggacacuagaaauacuugaggaguuucuaacuauauucuauugaguaaaaacaagacaaaagccauccuugauuugucaaaagugauaaaaaugguguaacaaguagaaauaggauuuuccugcuggguuugggguagaacuuggaaaaaaaacugaucaauuaugucuuuuugagccauguguuuaaaauuaagguggaggaucagaagcaauaaauauggauuaauugacuccauucagauugccacuucacuguuuuaugauagacuacugggaauagcaaauaauaagaaacuuaauguagauuuguuuaaaaaauuuguuacuacuguuguuucaaugucaaguuuauuuugcuuguugaugaaacuggucuuuuaucacauaacucuaggucauaaaaguauaguuugaauuuccaacauuucuaauguuucuuuuucuuuugaaaaauaaucaaagaaaaaguucugcuauguucugguuacuucuguaugaaucucauagcaaucaugauuuuccauuguguuuacagaacuuucauuguguuuuaucguaaaggaaugaaagaauggauuauuuuuucuuuuuugucucaauggaguggucuacauuuuaaagguuuauuuuacaaaaggauacuuguuacauauuagguuucaucaaaagaaguucaauacuaaagauaaagaguuuuccuuauugaaauauauauuguuaagcuuuuaaaccaaaugaaaguaugaguggucauauuuauacuguaguagguuuucauaauagauuuuccggauuaaaaccauuuguugaaaucaucaaagagauguuaauccugcuuuagcauuaaugcaaaguuaaaauaacugacauuaaaaaaaucauuugggaagcuuuauugaauauauugagauaagguuuauuguaguccuucucuucaugcauacugcuguuacaauuccaggagguuucaaaauccaugugaaugaccccauucaacccucaaacuguccaauuccuggccuaauucaccuucacucugcuguagcuaccaguugcaggacuagcugcauuuuggccagaacugcaucacccuggaaauuuuaaacacacucucucucuucugauugcccucuuuuucugguuccaucucagcuuuauucccacugcauuguucuuuaucuuuggagcucucuaaaucccuuaaauucauuggguauaggauucugucaucuucaucuuuguaauaucagugccuagacuaagccuggcguauaauaggcacucagagauuugaagaauaaaugacuaaaugacuguaucaaauacuugcccauuguuugcuguuucugaauuguacaaggccaucaugauaauugaugaucuuaauaaugugagaauaugauucucuuaccuuaguaagagagccaucaguuuauuggaugauaguuauauggaaaaagaagaaaugcuacugugauaaauauuuauaauuuuaaacaagugguaaguagaauuaaugauaaauaacuuacuuauugaagguuuucaaaaaauuagaugcaucagggucuuaccuacaugucuuauguauuuuuauucaaaauuuuuagaaaugaggaaacagguuaaguaaccuuuucuuuaucuuuaaacaggcuaaggauauuaagccaguacuaacaaacuuaaggaccaaacucgucaauauguaagauacuagaaaaauuaaucagaauauauuuugaauaucuuguggaagcuucucaaaggauauuacauugagcaucauaggcuggcauguuauuucauguuuuaaguaaggcauuuguaaguuguccauuuaaauauauuuauuuuagaaagcaaauauauuuguccugugaagagcauccuuauuuugagggauagcuucuugcuguuaauaaaacuucguagauaacauguuggaaagaauaccacaggccgggcucaguuggcucacgccuguaaucccagcacuuugggaggccgaggugggcagaucacuugaggucaggaguuccaaaccagccuggccaacauggagaaaccccuucucuacuaaaguacaaaaauuagccaggugugguggcauacacccucuggaggcugagacacgagaaucgcuugaacccaugagguggagguugcuguuagccuagaauagggccacugcauuccagccugggcaauagagugagacucuguaucaaaaaaaaaaaaaaaaaaaaaaaaagaaaagaaaagaauacuacagagagaucaaagaaugcccaaaguuaccucucccagucagaauuuuggguguaaccucccuagcugugcuagugguggaugagguguuuaacaaaggaaauguaagaucuuccuuuaguugccaguucaguguaguuuuuuggaauuaguuugcuaaauuucuuuuaaagugaucaguuuaguauccaaaaaguaaaauggagcaaguugaaaaauuguccugccuguguuucaguuuagguuguuccuaggcgcacugcugacuucucuuaugacuuuggguagauucagucuuuauugguauuugaacuuuuaaugucuguuguguacucuccuuagacacauuuaaaacuuuaaagcauuugggcagggggaauggguaaggauccaguuuuauuuaagacugucaggacccaucucaauaguaguaucuauucccaugagagaaaaaugaaaggcaaggcuuacaucagccuagucuccucacuuaggaaucacaacauuccuaaggucagaaacagugugaaguaagucucugaacccauuuuggagggcaguacaucagaaauacaguggaaauugcucuuuagcuggaugugaguuucauuuuaagcaccacuguuuauauucuuuaugucuugccuuucuuuuuauauugaguuuguuucaccuuguaaaauuaagaagagcauguucuagcuuuuaaaugugagaauugaauuauuaauaguuuuuggguaaaaguaucaccucccauuucuucuaccaaaagcagcacauccucacagacuuuucaccucacugaaaauggucauuuaaaguuuuuacuaauucagcauuuaaagcuuuuuauuuccuccuugauuuauaacacagcuguuucuugaauagaaaaaacucaaggacuacaugcaaucuaauuagauuacauucuuugugugagucuccugcauuuaguggaggccacuaaucaaaucuugauauauuuucuauuucuuuuauuuauuuauucauuuaauucaucaagucaagauggcuauaauuagagcagauuacuccuaccacauuguauuaugaugaucucuucauguuuuuuuguuucauacuauaugauauucauuaaggguagcauugugccauccuccaucaagcauuauaugcuuccuuugugcuuaugauguugaccguagcaaccuuaaacuguuaagacuuguuuauaaacggugaagcuccaucauuccaacagagucagcaugcuaauucacucuaguucaaauccacauucuaguugaaucccugcaauguaacuugacauuuggagaaauugauucauaccauuuuaaagaaauaugauauaggugacagaauccaggaugaagagguaccuuguugcuuagaugaugacguuguggauucauuucacaucucucucucuuuuuaauguagcucuucucccuccuugguuuuuauuccucccuccuucuuucuucuucaagccuccucuaauguuaacaucuuuggcaguuuggccaguguugacaacuacuuuuugauuauuugguauuuuaaaauauuugguauuuuaaaaugcuuuuauuggccaggcgugguggcucacaccuuauaaucccaguacuuugggaggccgaggcgggcagaucaugaggucgagauugagaccauccuggcuaacacggugaaacccugucucuacuaaaacuacaaaaaauuagcugggcaugguggcgggcgccuguagucccagcuacucaggaggcugaggcaggagaauggcaugaaccugggagguggagcuggcagugagccgagaucgcgccaccgcacucuagccugggugacagagcgagacuccaucucaaaaaaaaaaaaaaaaaaaacaaaaaacaaaacuuuuauuguaaaauuauuuauuacaaacaaaaucccaugcaaagaaaaugaauaaaugugaugguuaauggaauauauguggaaauaaguagcuucucuuauaagugaaagaacugauaucgaaaauuccauguaaaauuaauuaaaauuaaaauuacauuuguaagauuauugagucuuuucuuucugggcagauuuuuauuuaguuaguuguuuggggauuguuuggguuuuaguggcagaaauauauucuucauaaguaucagauucuuuauuaggcagucaucauuuuaggucuuacaaugaugggaaaucccaugggcuuagggaagauuggcuaaguauggaaaaauuacguaauagaaaaaauuccaucuacaaagaugugugauuguuucuuuucuucucccuaugucuagaugguuagagaugacuguauucuuggauuguuuuauuuucaaaauugaaaguuuuuuuuuuuuuaaauggguauuaggcugggcacggugucucaugccuguaaccccagcacuucaggagguugagaugguuagaucaccugaggucaggaguuugagaccagccugaccaguauggugaaaccccgucucuacuaaaaauccaaaguuagacgggcaugguggugcauaccuguaaucccagcuacuugggaggcugagacaggaggauugcuugaacccgggaggcagaaguugcagugagccgagaucacaccauugcacuccauucugggcaacaagagcaaaacuccaucucaaaaaaaaaauagguaucaaaggaugcauagugggauggggaauaaagaaagcacauacuacauagcaaaacauuguaaacaaaaaagucacagcgucauauaaaaaagaaaacguauuuucuaugauaacaaauuuaaaugaaauuagauaccagaauaguuuucaguucucuuucucuuuuuuuuuuccuuuuaagcuccaacagaaugaguuugucaguucuuuucauaccuuggugucgauugcaaccucuauaaauauguuaaauaauggauuucuaagaugauuauuuacauauauauggagugugugugaguguauaaguauaaaguaaauauauauauucuggaauguguauguauauaugcauauauauauucaacuauuuuuaacaauaugagcuugaguuucuuucaagacuaaaggcaaaauguauuuuuucauugccuuauuuugugcaaaagccaaauaaaauuguggugauccauuugcagaagcaagaaaauagaagcauauacacauuuuauagucaaucagugaguauugauauagguccuggugauuauuagagcuucuagacuauaaaaaauguuacuauguuucuuuuaaaguuuagugucugcauagccaguggaucagauacccagaauggguggguaaucacuggcguuguguuucagacuuuagaucuaacaaguaaaaauuaaaaaaauaaauuggauaugauuaaaggacaaagaaucaaggggauggagugcagccaauucagaaaauaaagaacaguugguuuacccuaauuauagccauuuugauuuuucuuuuguauguaucaauuggaaguuugguaaaaauuaaaucuuuagcccaauuauagaaauaaauucauugcagauuuccuaaggugacuuuauacuuuucuuaaacucaaaucuuuaaagucgguuguaguuuguacgagccacaagucuuuccuuugauauaguaaaacaguuuacuuuuuauuuuuuaaaacaauaucuuauaucuaccaucaucuaaauugaggauauguuaacauaaaugacaaaaucauauugauaucaaagauucaacugauuaagagaaauuuuacacuuggauuaggaugaguugugcaaaaguggcugaaucuaauaaaaugauguaacauuuauguauauuauaaugaauuuuccagauuguuuauggguacaggucaagcauuaaaauaaggccuauguuaugcccuccccccuuucaucaaaaagcuuuccguagauaaguuauggaaauaggugacuguuuuuuuuuaaacuuuuuuaaggaagaugaauuuauugauuuuauagaauaucuuauugcauucuucuuauuacuacuuuucccacuuuugaucauggguaucuuuuuucuguauucaucuuauacaggaaguuauguaucuccuuuguaaauuagaaagagugucauccaaugauuuuauugucaggugcauauuaaaugaucuccuugguaaaaaacaugaguuauuauuauuauuugacaguuauuaaacacagauacaugaguaaauauggagcaaagaaacacaacuuucaaugacaaaggucuguugauacacuguaugguuuuauauguugcaaauuugaugacuuucucuguguuaauuucccucuauauuuuuauugaguccuaacacacuugccuccacucacaucccaacacacacacauacacacacaugcacacacacacacucucucucucucucauauauacaggugcacauacacaugcauaauagcugaagcuucaaaaugaaaacauaugcagaauguaccuauugauuucuggucauucugagcaaaagggaauauaaagaaauaaaguuuguuugaaacuggggaaguuauuuaguauuuuguguuuuaauugcuucuuaacuaucuaacacuaguaguuuuaugccgauuaacguaauauugaaaauuuaagaaauguuagcaaggauuauaggugauugauaguacuguuuuguaguaugaagcaugguuuaaaucuugucagaauccccagaacuuaacauggaaauuagaauagagcugacaccuguaucuccauucuaaaccauuuagucauauuacuacaauuuuuuccuucuaaaacagacuucaucaagucuucagaauucugaauccauuaauccauuugacucuccauuuauuucuuuucucuuucauuuuuuguuuuugagacauugucucacccuguuacccaugcugaagugcaguggcguguucaugucucacugaaccucugccuccuggcucaagagaucacaucagccucccuaauaacuggggcuauaggcaugcgcucccacgcccugcuuauuuuuuguagagaugagguccugccauguugccgaggcuggucucaaacucugggcucuagccauuuggccaccucagccucccaaugugguaggauuacaggggugagucaccacaccuagccugacucuccauuucuuauagcaguaccucuuaaugaggaaagcacauuagaauugcccacagagcuucuaaaauaugcauauaucuagaacccuuccucagaaaaucugauauuuagguaggaguggcaagcauguauaacaaaaacugugcauugauucagaugccucuuuaugucaugucccaacuaaaguuucuuacucugucucauguuauuuucuccuguuacccucugcucugcuuucacugugccaaaaaugauauaauaccaauacauuuucauuuuauacuuuuguauuaguacuuuuguacaugcuguuucuacugccugaaauaccuuuuacuucccucugcauccucccuuucucuccucuccaggucuuuuaucugucaaacaaugaguuuucuuccuagauucuccucugauggcaaaucuuuccuuacucccccagguagaaauagucacucucucuuuuauguuuaccauuuauauuugauuauuaauuuuuuaaguguccaucucuuccauuaaucugugagcucagugaaauuauguaauuuaucuuauuuguguuuauguuaaaugaauacauggauaacuaauaaguugacagcuuuguuaggaauuuaaauguacaauguuuucauaaacuuuuuuuaagggcagcauuaaguugagguuuucgugaucaaccaccaagacauacguugauacauacauaacauuguuugucuuaauauauauuaccauaaaaauuugcaugcaucuagguguuuauuucuuaucuucauuuuuuucccuugugccuacagacgaaaucucacaaaacugucccuuaucuucagucacaugcuggcagaaaucaaagcaaucuuucccaauggucaauuccagggagauaacuuucguaucacaaaagcagaugcugcugaauucuggagaaaguuuuuuggagacaaguaaguaaaaaucauuuuuauagcuguggaucuaucuuucaaggguuacuguauccucccuccaguuggauaugguauauauuuuacuugaguguuuugugaauguauuuuauuauuuuugauaagcauuuugauugauugguaauuuuuauagucaccaaagguaugccucaauaaugcaauaguuuuuuagucacuaaguaaauauuauacaauguuauuuauuucaugagcauucauugaguuuguucugagaagcagagguauguaagagucuuuauacaugagaagcugauaacuucuuauaauuuaauauguacuuaauauacaaaauaaaggguagaagggcauagauacuuuaaaaaauggcauaaguaaauugcugugacaauuuagaagggaauaguugcuuugggaucagugaucagggacugcuuccuggaggaggugguauguuaagcuugguuaaggucugaaaucgaggugagagaaggcccuggcacccugauccagccuuucuuuguuuuacugcauagagauuauauaugugugaacaagauaugaggauaauguuaucacaaagauguagucuguugcaaaguaguuaaagauguaugcccuacagagacacagauucuggugagcuugguagauaauggaauugaauaucuaaggucagcauaauuuauauaaaaguugcaaaacuuuugucauaaaugucucaguaaaaugaucaagaaugagcaucaggaggcaagugguuuccccaguaaccuuuuaagaauuaccuuuaaugagagcgcguccucagaauguccuagaauguaggcaaagcccuggcugaguaaguaaggaggaagugugacugcuuacauagauuauuguuuuaaucuugucucaaaggucuguauuuguccuuuaacugaugaaauuagacauaaaaauuguuaguauacacuuuuuuuaguacuuugauauguugaacugcgauauugguuuuccuuuguuuguuuuuguuuuuguuuuuguuuuuucuuuacaaaguacuauaguuuacuauagucaccaccaagauuggaauauaccuacauagaguaauguacauuucauuaagcacacaauuuuuuuggcauccaaaauauuaaagccuauuucccacauuguacuaaaauguauucugaauuauuuuuaggcacuaaaggagaaaaugccauuguugccauuaacauggaaauucuguguuguagcaaucuaguuauuuauaauguucauauauucauucagaaaugaagaauuuagaaaaaaguuuauccuuaucugaauuagaauaacacagacagcuaagacuauacuaauuaaauauuuauuaauuguagaaagcagaacaaucuugccagguucaggguguaggaacugagaggguuuguuuccuguaguugcaguucauguauuaacauuguaagcuuaguucaaacagucgguaaccuucaaaauaaacuuucucuuaaaguuuuaagaaaauauauaggacaaauugauuaugguauuucuuuuugaaaacugaaaauucugaugaguuauaaaauuguuuacuugucauaaggucaauaaaaaauggaaagauugcucacagguuuuuuuuaagagaggaguuuacuuugcugguacuucaagccacagaaaauuaugcauuugagacaucuuuauuucccuuuauuuauaaccacagacaucaaggggcugaaauuucuguucaacugcuacaugagugaaaucacuacuacaucaaaugagggauucuugaaauagugauuagauacuuucccuaccucccaagucuuuucacuuuugucugcuguuuuuacugaauugagaaagcugcuuaauuuuucuuuaacacuuuuaauuuguggaugacugccaaauuucaugcuccuuuuggaacuuauaugcauuaccauagucauacaaauuaauuauuccuuuauuagauaauuggagaaaguauuuuuuuauucuuccuagguuuuuaccuugugguuccauaauauuuuauugaaugaauggacauaugcaugaauaauguguauccuuucgaaagguugaauuuuuuuuuuccauuaugcucuaauacuguuuguauuuucccaaaacuuaguucuccugugggagcaugccugucauuuaucucacuguucauugaggccauguaagaaugcuuucauuuagcccaaccagugccuuuaaacuugaaaacagcauucuuuccuaaaacagaaccauuaauccauucaugagggcagcgcccucaagaucuaaccaccucuugaagguccuacuucuuaauacagucgcaauggcaauuaaauuuuaacaugaauuuuggaaggggcauucaaacuauagcacuguuguuuuugaagacaugguagugcuacccucucugcucagggcccaagcccagcagccaagaggcacugccugccuuguggcccaaggggaacaguaacacauguaucauggcaaauuuguugggggauucuguuuauggucaauuuuuaugcaaaugaauauauuuuaacaaugcagucaugcuuuuccuuucauagucuguugaccaggaguuagaaaucuguaggaaaagaaaagugacauuauugaauaaaugugucuaaguauguucagcaaaaugagaccaauacuaaacugaaucuucacacucuggaauaauaacuuauaauccagaaacuuuaagcaugaagcucgaaaaauauauuacuagcguuaaaaaaagaagcacaucaaugugauuagacucugggugacagucauuuuucuuagcgagucagguagcagcuugugacucauuuaaguacuuuuugacauugagaaaagugauugauugaaguggugauuuauaagauuuuagugcacuggucaccugagcagugcacacuguaccuaauauguaguguagucuuuuaucccuuaccccucucucacccuuccccaccacgaccccaaaguccauuauaucauucuuaugccuuugcuugcucauagcuuagcucccacuuauaagugagaacauacgauauuugguuuucuauuucugaguuacuucacuuagaauaaugguuucuagcuccauccaaguugcugcaaaagacauuauuucauuccuucuuauggcugaguaauaguccaugguguaaauaugccauguuuucuuuauccgcuuguuggucuaugugcacuuagguugguuccauaucauugcaauugcaaauuaugcugcuauaaacaagcgugugcaugugucuuuuucauauaaugacuucuuuuccuuugaccagguaucuggcaguggauugcuggauugaauggcaguucuacuuuuaguucuuuaaagagucuccauacuguuuuccauagugguuguuacuaauucauacucccaccagcaauguagaaguguucccuuuucacaacauccacgucaacaucuauuguuuuuaaagauguuuaacaacaucuauuguuuuuaauuauggucauuguugcagaaguaaggugguuucucacugugguuuucauuugcauuuccccgaugauuagugauguugagcauuuuuucauauguuuguuggcuguuuguauaugucuuuugagaaaugucuauucauuuccuuugcccacuuuuugaugggauuauuuguuuucuucuugcugauuuguuuuagguccuuguagauucuagauacuaguccguugucagaagcauaguuugcaaguauguucucccacugugugaguugucuguuuacucuccugauuauuucuuuugcugugcagaagcuuuuuaauuaggucccauuuauuuauuuuuauuuuuaugcauuugcuuuugaggucuuagccaugaauucucugccuaagcuaaugucuagaagaguuucuuugauguuaucuuguaggauuuucaugguuucaggucuuagauuuaagucuuugauccaucuugaguugauuuuuuaauaaggugagagauggggauccaguuucauucuucuacauguggccugccaguuuuuccagcacaguuuauugaauaaggguauccuuuuccaaauuuauguuuuuguaugcuuuguugaagaucaguuagcuguauuuggcuuuacuucuggguucucuguucuguuccauuggucuaugugccugucauuauaccaguaccaugcugcuuugguaacuauagccuuguguuguaauuugaggucagauagugugaugccuccagauuuguucuuuucgcuuaguauugcuuuggugauauggucucuuuuuugguuccauacgaaucuuaggauuguuuuuucuaguucugugaagaauguugaugguauuuugaugggaauugcauggagucuggauugcuuugagcaguguggucauuuuauucuucccauccaugagcaggugauguguuuccauuuguugugucaucuauaauuucuguguuucaguguuuuguaguuuuccuucuagagaucuuucaccuccuugguuaaauauauuccuaaguauuuuauuuuauuuuuuucagcuguugcaaaggggauugaguucuugguuugauucucagcuugguuauguugguguauagcagugccacugauuuguguacauugauuuuguguccagagacuuuacugaauucauuuauaagaucugggagcuuuuuggaugaaucuugaggcuuuucuagguauaugaucauaucaucagugaaugaugacaguucgacuuccucuuuuccaauuuggaugcuucuucuuucuuuuuuuuuauuggauugcucuggcugugacuuccaguacuggguugaauagaaguggugaagguggggaucuuuaucugguuacaauucucagggggaaugcuuucaacuuuuugccauucaguaugauguuagcuauagauuugacauauauggcuuuuauuacuuucggguaaaucucuucuauacauauuuuguugagggauuauaaaggggugcuguauguuaucaaaugcuauuucugggucuauugagaugauuauauauauuuuuaaaauuucuguuuaugugaugugucacauuuauuaacuuacauauguuaaacuguccuuguaucucugaaacccacuugauugugauguauuaguuuuuuguugugcuguuggauuaguuagcuaguauuuuguugaggauuuuugcaucuauguucaucagagauauuggucuguaguuuguuguuguuaugucuuuuccugguuuugauauuagcaugguaguggcuucauagaaugauuuacggaggauucccucuuucucugucuuuuagaacaguuucaguaggauuaguaccaauuugucuuugaaugucugguagaauucaguugugaaucuaucuuguccuggacuuucucuguuugcauuuuuaaaauuacugauucagucucacugcuuguuauuguuauuggguggcaguaaaccuuacccagcucuccugcaguuggugaggcugaucucacucccacagugcucugcuaacaaugcuugguuuagauccagguagucuauagacagaacucagaccugccccaggucauaagcuucuccacauagaaagcugccauggcuuucaaaaagccaugccccucuucgucuucccaggcauggccaggcacccagcuccuaugcuccugucugcagcacacuucccacuugccgcaacuccucccuccccauucuguucaagggaauuuguuccacucgagauuauauuacaaaauucaguugggagguucuuucacccuguguccuuucccugagcucauuggcugacuuccagagggucccugugagauauauucaggaauagcuucccuggguucaugcuggagauugggaaguccugcugcggcuccuacuuuuuuauuucccuaaaucuguuccagcuauuggaagggugaagggcuucuccaguggccuggauuuucagauucccugguggggauguguacuuggaggcagacucuuccccucucgcacucugaggacuuaggaguuuuucaccugucucacguaguaggcuauagccucccaauucuuucacagggucuguggauucuguuuuccuaaguuccuguguugguucuuugggaaaaaauucacacugaaucucugcacauuauucuguccuuccaagugggagaagcaugcugacacugccuccagucugccaucuugaaaaaaaaaaaaaaacaaaaauuagcauugagaagauuuagacauaaauuuccaaacaaauuauaauucaauuagaaacacagauucuaacucuugaaucuucuuacauagccucuccucuccauacauaaaauucucuucuucaaauuuaaauucaugcucugcauuaccccaacaaccuucugauuagucucccuaucuccaauaacaaccuauccuauuguucuuaggggaccagugagcugucuaaaaagcagagcuaaucauuccagucuuucgcuugaaguguuugcaugaauauuaauucuagguuaaagucuaaaaucacauuaaacaucacaagcuuuagaaacuuuuucgcuggcuucuuuuuuucuacuuaucauuucgguauacuuaacucaucugcaaagaaacaacucaauacuguucauauuucccaaugugugucucauuuuuuacuccucauugucuuuguuuucguauguugcauucacugcuuggauaggcagucacccaugcucuauccaguguugccacuuugaaagcuuuacuuuaguacccuaauggauaucccuacucugugcugccagguaccugagcucacaucugucaaaauauauuacagugaacugcugacaugcccccauuucucaauugagagguuuccaauagacuggaaaguuuauuuggaagcagagacugcaucuuacuuauuuuuguguuuuugagccugacacguuuccuggaauguuuaggcaauaauaauuuuuuuuuuuuagguggaguuuugcucuuguugcccaggcuagagugcaauggcgccaucucggcucacugcaaccucugccuccuggguucaagcgauucucccuccucagccucccaaguagcugggauuacaggcaugcaccaccacgcccggcaauguuuuuuuuguauguuuaguagacguggaguuucuccauguuggccaggcuggucucaaacuccugaccucaggugauccaccugucucagccucccaaagugcugggauuauaggcaugagccaucacgcccggcggcaauaauuguuaacagacuacaugaauaauugcauagauggacgaugucuauccucuacucucaauuuccaaugacuucauuauauauaaauugaucucuuuuuaaaugaucaguuccuacauuucuauuccuuagaugccucucuucccucuuucuuuucaucugucucagaauuuugacaccuuucuuuaaguucaguucauaaguccacuuuucugaguuuuucucauucauauacacccuucuacgugaucuauguuaauuacucuauacuuugguugcuguuguauuuuagacacauuuauauuguaaaauguguuuacuauguaggucuuucuugcuugauugcaagagucuucaaugacuuucuaugcaaaaguuggugaaaacagacacauuuauuagaguuauuguaugucagauuuuguguucagugcuuucacauaugcuagccucauuuucaauauaaucuuuaaacuacuuuguaaaugguuguugaaugagucuuuuacguaccauauacauuguagacauuuaguaguuauuaguugaauguaugaguauaggaugcaacuuuucugccauuuaagcucucucuuccuuuacuuauguucuguucuucagucaaauuggcuuauuuggcucuuucuggacacaucagcaauuauagguuucuaugucuuugcuuauauugcuccuucuacuugaagauuuuuauaaucucuggcauaacaauucuuacuaaucccucaaagauaauauugcucauaauuuuucccauuaguguuauuacuagaucucuucuuaaacuucgcuaagcucuggcuuaucuucugcauuuacuauuuuuaugguuuuauuacaaguauuugucuaguugucauacuucccccuagacuauaugcuccaugaaaucaagcuuauuuauucaucuuuguauuucuaaaguagcucagcacaauguuuuauauacaggcuuucaggaaccauuguacauuuaauucagaugaguugagaaguagaggaaugugcauuagcauguguaugugugagauggagccugcuugcuugauugauugggagacagcauacuuaggguuuggcaugcaggcucugcagccagauuaucugucccuggacagguucugacugcaacauuuacucacuuugugacuuuggggaaucuaguugguuuuucuaugcaucuuuuuccucauuuauaaaauguagaugauacuaauaauaccuaccaucaaugguuguuaugacggcuuaaaauagcuaaaccuuaccuguaaggcacauaaaacugugucuagcauauaauaaauauucuauuuuguggaauaauuaaccaauugaaaccuuuaaaagugguccaaauucucuaaauaauguaauuuacauuugacuuuguaugauggaaguuucauacucuguagcaaucuaaaagcaaaaaaaaaaaaagaaagaaaaagaaaaauuuuaaaaauuauuuuauguguaucccgagaugaagguagaauugaaaauaagaaacugucuugguuaccacagggggaaaaugguuuauuuauagcucaauuuauugccucuaugauugauuuccugcaaaagcaauaagggccuucuuugguuucccguauuuuccuuucacuuuuaauaugaaagaaaggaaaauacuuucuuuaccuuuccagcgagugagauauauauucuucuagcauauuaacuagcucaguuuucccucuagguaaagaaaacacaaccuaauuauauuaaauuaaaagaagugguacacaguagaaauuaagaguuuuuacaaugaaaauuuuuagcagauacucuaaagagaaagaaaaaagaacuaaaguaggauucaaagaaucacuaguuaauauuucuacuaguuagcuaccucccuuuguugccuguuaaaaaaaauuucagguaucuuuaugucaauaaggaaaauaaaaacuuacauaucuauuggaggccuauuuuguucaauucauuguaacaagauacaaaacaacuaagaugccaauuguaauuuucuaccuguaagcaauauucaguuuggggaagacaggauauaaaaagaagauaaauacuuaaaaucagcucuguaccauuagaaaaucacauaaagaauaucacaaauaauaaauuaauuuacuaguacaugcauaccucagagauauuguggguuuaguuugggaccacugcaauaaaguacaucgcaaugaagugcauauugcaauaaagcaagucacuuagauuauuuuugucuuccuagugaauauagaaguuguauuuauacuauacuguagucuguuaggugugcaguagcauuaugucuaaaaaaauauauguaccuuaacuaaaaaagaauugcuaaaaaaugcuaacaaucagcugagccuucagugaguuguaaucuuuuagcugcuggagaguugugccucgauguucauggcuauugacugaucauaugcugaaaguuaagguggcuguggcaauuucuuaaaauuaggcagcagugaaguuuacuacaucaauugguucuuccuuucauguaauauuuaucuauaacaugcaaugcuguuugauaauauuuuacucacaauagaguuucauucaaaauuggagucaguccucucaaacccugccacugcuuuaucaaccaagugucugcaauauucuaaauccuuuauuguaauaucagcaguguucacagcaucuucaccuggaguaaauuacauuuaagaaagcacuuuuuugcuuuucuauaagaagcaguuuucgucuguucaaauuuuaugagauuugcaucaauuuagccacauauuuagguucuacuucuaauucuaguucucuagcaaauucuacaucuacaguuacuucuuccacugaagucuugaaauccucagagucauccaugagauuuggaauucacuguuuccaaacuccuguuaauguugauauuuugaccuccucccuugaaucauaaauguucuuaguggcauuagaaaggugaauccuuuccacgagguuuugaauuuucuuugcccagagcuaucacaauauaugacagcuauagccguaggaaauguauuucuuaaauaauaagacuugaaagucaaaauggcuccuugauucaugggcugcagaaugaguacuguguuagaagacaugaaaacaacauuaaucuccucguacaucuccaucaaaucuuuugggugaucaggggcauugccaaugagcaguacuauuuugaaaggaauuguuuucucuacacagcauaucucaacaguaggcuuaaaauauucaguaauccagguuuuuuguuccauuuguagagcacaggaagaguagauuuagcguaauucuuaaaggaccuaggauuuuuggaauggugaaugaacauuguguucaacuuaaagucaucacuuuuauuggccacuaacaagagucagccuguccuuugaagcuuuuuguuuuuuuaaauaaagaacagaaauuuauuucucauaguucugaaggcuaggaaguccaagaucaaggugcugacaaauugucugguaaggacccacuuccuaauuuacagauggccaaacaucuuuuugcaauauccucacaugguagaaagagugagcaacuaucagggggcuuuuguuuuuucuuuuucaaccuuuauuuuggagguuauuuaggggguacauaugcaaguaauugcauauugcaugaugcugagguuugggguaugauugaacccaucauguagcuuugaagcuagguauugacuucucccuagcccuagcauuuucuagauagcauuuucuuucaucuuaaggcuguuucaucuacauuaauuaucuguuguuuuguguagccacauucaucaaugaucuuagcuagaucuucuguauaacuuguugcuucuacaucagcacuuggugcuucaccuugcacuuuuauguuagagagagcuucuuuucuuaaaccccauaaacaaauuucugcuaguuucaaacuuuacuucugaagcuuccugaauucucuuacccuucacagaauugaagcgaguuggggccuuguuuuggauucggcuuuggccuaacagaauauuguggcuaguuugaucuaaccaaaccaccaaaacuuucuccauaucaccaguaaggcuguuuugcuuucuuaucauucauguguucacugaaguagcauuucuaauuuccuucaugaacuucuccuuuccauucacaacuugccuaacuguuuggugcaagaggccucacuuuuguccuaugucagauuuagacaugccuuucucacuaaacuuaaucauguccauaauuagagacuugugacuauuccuuucacuugagcacuugaggucauuuuaggguuacuauuuggccuaauuucaguguuguugugucuuagggaauagaaaguccccaggagagggagagagaaaagagaacaguguugguggagcagugagaacauauaccauuaaguuugcugucuuacaugggcaugguucauagugcccaaaaacuauuuguuucacacaaaaaauacuguuuugaaacugaaaaacugggaaugauggcaacaauagauaugaauugugauaugacagcaauuggcuagaccugugugccagcuguuuuucuuagauaaucucucuucuaauucaucacaauccuuuccuggacaucuuuacuaauuuauauuauauaccugguccccagauauuugauuuuuuaauaucugaaagcuauuuggaaccacuggacuaauagugugugccccuggauuuauagagguccuggucuuaauccucuaaacauuuguucucuucucugcuggaugugucuacuugggucaauaaagagagagaaggucuccuucuagagcaaggaucuuaaagccuuguaaaauagagguaguauuucucccugggucaaaggauaugcauuauccauuacaaaauauuuggguuccuuaaguucuagguucuacuccagaaucaaacccacaguguaugcagaugucaccuggcccucuuugcaucuuuuaggagaauuuguguuuagggaacaagggcaagaaaaugcugguacucuagccacugcucuugcugugaguaacaaaguccuuugacucugacccaguccuuugacagaaacccaguaucuucugccacuauacaugaaacugugauaggccaacuucuuagcuugcaagaagaguagaaucucauucuuugguuuuuuaggaucauguucugcugguagagaaagugugacuuaauagcaaaguaaauaaaacuuacuuauauuagucuguucucaugcugcugauaaagaccuaccugagacuaauuuauaaagaaaaagaaguuuaaugcacucacaguuccacaugacuagggagaccucacaaucgugguggaaggcgaaaggcacuucuuacguggcagcagaugagagaaaaugagagccaaugugagauuuauucacuaccacaagaauaguuugugggaaaccacucccaugauucaaauaccuccuauuagguccuuucuacaacaugugggaauuaugggagcuaacaauucaagaugaaauuuggguggggacacagccaaacgaugucauucugccacuggccccucccauaucucauguccucacauuccaagacacaaucaugccuucgcaacaaucccccaaagucuuaacucauuccagcauuaacucaaaaguccacaguccagagucuuaucugagauaacaagagucucuugcacuuaugagccaguaaaaucaaaagcaaguuaguuacuuccuagguacaauggggauacaggcacugggaaauacagccauucugaaugggagaaauuggccaaaacaaagggucuacaggccccacacaaguccgaaauccagcgggccagucaaaccuuaaagcuccaaaaugauuuccuuugacuccgugucucacguccagggcacgcuguuguaagaggugggcucucaugcucuugggcagcuccaccccguggcuucgcaggguacaguuucccucuugguugcuuucaugggcugauguugagugucuggcuuuuccaggugcauggugcaaaauguugguagaucuacuauucuggggucuggaggacgguggcccucuucuuacagcuccacuagucagugccccaguggagacucugugugggggcuucagccccacauuucccucccacacugcucuagcagagguagggcucugccccugcagcagaugucuaccuccacaagagcccugccccugcagcaaacuucuaccuggauguccaagcauuuccauacaucuucugaaaucuaggcagagauuccuauaccuuaacuucuugacuucugugcaccugcaggcucaaacaccauguggaagcugccaaggcuugaggcuugcacccucugaaauaaaagcuugaguucaacauuggccccuuauagccauggcugggaugcagggcaccaaguccugagacugcacaaagcagcaaggccuuggguacagccaaugaaaccauuuuuucuuccuaggccuccaggccugugaugagagaagcugccgugaagaccucugacaugcccuggagacauuuuccucauugucuuggugauuaacauuuggcuccuccuuacuuauacaaauuucugcagccagcuugagguucuucucagagaauguguuuuucuuuuuuaucacauugucaggcugcaaauuuucugaacuuuaaugcuccgcuucuucuugaaacauaaguuccaauuccauaucauaucuuugugaaugaauaaaacuuaaugcuuuuaacaguacccaagucaccucuugaacgcuuugcugcuuagaaguuucuucugccagaugcccuaaauuaucucucugaaguuaaaaguuacacagaucucuaggguggggcaaaaugcugccagucucuuugcuaaaacauagcaagagucaccuuuacuucaguucccaacaaguuccccaucuccaucucaguccaccuuaaccugcacuucauuguccauaucacuaucagcauuuucgucaaaaccauucaacaagugucuaggaaguuccaaacuuucccacaucuuccucucuucuucugagcccuccaaacuguuccaaccucucccuguuauccaguuccaaaguugcuuccacaguuuuuggguaucuuuacagcagcaccccacucuacuggcaccaauuuacuguauuaguacauuuucauguugcugaaaaagacauacucaaaauuggguaauuuauaaagaaaaagagguuuaaugggcucacaguuccauguggcuggggagaccucacaaucauggcagaagauaaaaggcacaucuuacauggcagcagagaagagaaaauaugagagcuaagcaaaaagggaaaccccuauaaaacccucagaucucauguggcuuauuuacuaccacaagaauagaaugucggaaacugcccccaugauucaguuaucucccaccuggucccucccacaacaugugggaacuaugggagcuacaauucaagaugagauuuggguggggaaacagccaaaccauaucauuauuaaaaucaguguuuagggggugggugcaguggcucaugccuguaaucccaguauuuugggaggccaaggcagguggaucacuugaguccagaaguucgagaccagccuggcaacauggcauaacucugucucuacaaaaaauacaaaaauuagcuaggcaugguggcgcacacuuuaaucccagcuacuuaacgaggcugaggcaccagaaucacuugagccugggaggucgagguugcagugagccaagaucaugcuacugcacuccagccugggugacagaaugagacccugccacaaaacaaaaugaaaugaaaaacaaaaacaacaacaauaaagucaguguguagguauuuacauuucgguaauagacugcuaaugauugaucuuucuauucuuccuuauuuuaaauguugguuauuaauaggaaaugcaguaguuguuuuucuuguauagauuuguuuuuguuuuguuaaucuuuaauaacaaaggaguuauuuaaaauaucaguaguuuuauuaaaaggacuuuuugauggauuuaauuaugcacaacaauauaugcagaguuuuuucuuucaggguuuuagaaauguuaucagaagcucuuuauuuuuugccucaguuuaucuuauacaucuaggagacuucacucauugguuguuaauuuaauuggcucauguugagagacuuacaaggaacuuuguuuuauuauugacuuuuuuuuuuguuuguaauucugagcucucauugcuaaagggaggaucauuuuaaagccuuacuuaaaccucucuuugguagcacuuucuagaguaugaaauuuuuuuauuuuauuuaaucugauuucagcauaucaaagguaucuugcauaacccaugagcugcuguaucucaugaauuuauccuguauuggugaacuuucagagaauauauacugaagaacaguuguacuuuagaaagaaaagaacaaguauucauuguuuaaaaccugaaucuuucuauuuuuuacagucaguggcuucuaaguggaaaaauuuuuaauggaauuuuuacacauuauuauggauuauacuugcagcuucucuuccuguuccuuuccacuaaugaacuuuauuuucuaaguuggaaaauaaauagaauuauguacaaauaauuuuaugacuauagcaaauuuauuguuuauuauguuccaagguuaggaugugagaccagaaguuagaaagcauuaaaucuaucaugugaacaaaauaauugagaagauuagaaauaauacuaaagacacuauuuccuguguuccugcaaucuuauaaaaauaugauuauagauuuaggcugcagaauaugaauaugugaaagauacuuguccacuauacagagaaguaaugauggccccagcugcccaucuggaguggcugcugcaaagaugcugcaguaggggaggcauggccagggcugugugcucuauggagcaggugggaucugggaacaggcaggagccccacccucuuccgaguuggugggguuggagccccaugcuuccaggagcagcugcagcuauggaccugggcaucccuauacucuugggggcccaggaagucccccuaccccagcaggcuuggaagugccugcuccugcugucuggccucacccugcucacagugccugcucugggauggagcaaagcuguggccaagccugggcacuguugugaccuggcugggugugcacacacucaggguggcgcugacaugccagcccccugccaccgcaucccuuuccagacuuugggaccaaggagcacuggagggaggccgacgggguugggcugaggguagcuccgcaugggccugcaggugacccuccacagaaacagccuguagaugacaugauugguggcagcaggaggcagacaggcucauggguggaaaggggcagguccccauugaagcccuaccuucaagacagggacagccuacagccucagggccgggcugucaguuccugguggaguucacagugggagugaaaacuuauggagcuuuuucugggccugcccuuggaccagucagcacacacuuccuuccuucugagcccaugaaaaacuccagacccagccagacucacacagacaucagacuaccagcuacaggaagaagcuacccaauuugagucucuuugacuccuugggaugaucugccugcagaaaggagcuacccacucuggguuuccugagugcuguucugcugcucaguaaagcuccuuucugccuucccacccuccaguuguuuguauaccucauucuuccuggacacgggacaagaacucagggccugccaaauggcaggacugaaaaaacaguaacacaaacagggcugaaaugugcccacccuccacccccuucacgccccacauugugggcaaugagaaggagagaagagcuguggcccuuuggggagcccacaccuacaggcucccugagcuaggcugugaagccccauuugggagacugcaguuucuggagucuccaagcuuuugggugccacugguuccccuccuccagacacaggugcccacaguggaagccacuugcugugcaucagauccagccacuggcuugcccagagccggugccugugcuggugccuggagcugcccgcccugcuacagcagccagugugcuuggcugugcgcaguggcuggacuccaugcucacuuguucaugcaccacuugcugcuccgcaucugacucguccuuggcaggugugggaucugugcugguagugcauggugagcguggcccgccagguugagucaguggaaugagcccagcaggccugagcaaaacucggguaauggcgcaaccaaucacagagguuucuggcuggaaaagugacacacaaacaauaagcgacaguagugcuuaucugcacuagagacaaaguguuaugagcuuuuugacaaauaaaaauuaugcagcauaaauacccagcaucugugucuuuaucgugucaggaauuuucauguauaaggaagagugguucaaucuaauuaugaauauccuugguaacuaugguugccauccuaucaaagaugacuugcuguauggugacuauguaaccagaguguuuugauaugcuguuucuguggguugcuggaaaacaauugcuuuucccuuauugauagaacagcaagaguaauaauggucccauaagaaucuaucuucauauucuuaaaaaauggagucaugauaaaagaagguuggauuuaaggaauaacuguauacaaaaugucaacagauuuaggaaucacagcgcuaauauuuuguguccauaauguaaucaaaacauaucaaauauguuacaaauauccuauuaucuucugaacaaagcuugcccucuguuuaaagauacugacauugaacauaucuuaguugaucaaggugaauuuucugacaacauuuacauaaaauuagaaauagaguugggcugcugaauauagaacauauuuucuuuuuguuuaaaaugaggaugacaguauauauuccugagcuacaauggaucuuaaacaccugccaccacuaauaccacagcaacaaaacaaaccaacaauaaacaaacauguugauuuccuuguuuguauuaugguaguuacuuuguucauucccauguaucugauuuuuagucuuagauuuuuaguguaauauuuuuuaaaauuuaaauauaugauugaaguuuaauguacauggggaaaaguacacaaaucauacauauagagugagaaauuuuuaugaaguaaacauaauccauguuuacaguauguauccauguuuaucuccuacccagauaaaguaguaauaccuugcugccugcaucuuggaagacgcccucucucagcgcgucagaaagucgcacauagucaccacccaguaguucugauacaugccaucauaaaucauacauaguugaaaucauacuaauuauacucuuuuggaaaaaacuggcuucuuccucucuuuauguuuauggaauucaacucuuuacuugcauguagcaguacuuuguucauucuccuuccuucauuguauagcuguaccacaauuaaccuauucauuugauuauuuauuuauaaauuacccagucucagguauuucuuuauagcacugcuaaaacaaccuaacacagaaacuggauauauaacaucaaggagaagagguuuauugggcccuugguuaugcaggcuguacaggcaugguauuagcaucugcuuggcuuccaggcaggccucagagagcuuuugcucauggcagaaggugaaacagagccugcaugucacauguggugagagcaggagcaagagagagcaaggggaggugccgugcacuuaaacaaccagaucuuguaagaacucauugucgucaggauggcaccaaggagauggugcuaaaccauucauuggaaauaugcucccaugauccgaucaccucccacugggcucuaccuccaaaauugaggauuacaguucaauaugagguuuggggggaacaaauacccaaacucuaucauccaguguuuauauauggguacauaaguuucuaaaauuuuaguuuuguuccaucuauuuguuuaugcuuguaccaaugccacauugucuuaauuaauguaaagaguacauacuuguuaauguuccuagugaagauuaccuuuuuuguucuugacucuugcaugucccauaaaguucagaaccaguuuuuaguaucuacuacaaaaaauaccuccugggauuguuuauuugaguuacauuaaauuuuuagacuaauuugggaagaacugacucuuuauaauaugaaucuaccauuaaaguguuacauaccuuuauuuauguuuuuuauaucucuguguauggguguauguugauauuuuugccuugcucaucuauuguuagcuuuauuucuauuuauuugggacuuuuagauagcauuauaaaaauuaaauguuuaaaguuucauuuucuaguuauauauagccaauauaaaacuacaacugauauuuuauaucaauuuuguguucagcaaccauguucaauuuucuuauuuccuauaguuuaaucuguaaaauuuuuguauuuucuacauauaaagcuaugucauaagcagacacugcuuugugguuuucauugauucuucuacgauuauauacauuuaaaaguuuuaguacaucuucuauucuuuuaguacacuagagcauauuagacauauaaaaaguuaaaaaccaugaacaaauacagaaaauauauuuuugaaaucacuuauaaucccuuccacaagccaguuauuaaauuuguggcaucuccagacauuauaguuuaacauuggaucauaaaggacaaaauuuuaaaaauacuauuuccauuuaguaguaucccaugaacacuuuuccacgacaauaaauauuuuucugcacaaaauuguuacuagugaacguauuuguuuucaaauauuuugcucuuauaaacaacacugcauauaaaagacuuguggaugggccuuuggcugcuauguauuuuuuggacauaauuuccuuaggugaaaucccuagaaguagauguucuuagucauaauguauaggcuuuugaaauuuguuuccaaauugccuucuagaagugcuguguaaauucucauucacaccaguaguauacagaaguuccuguuugcaaacacccuggcuucuguugauguucacccuuuguuguaugaaauguuuuucauuuuuuccuaucaguugaaacuaaaacccuguagccuuuuaugaacuagugguuucaugaaaauauuuuaccuuuuuuuuuuuaaaagaaaucauucuccucacacuuucuauuuuccauucuucuuaccuuuucuuaaaauugcaggauuuucaaauuagaauaucuaauacacuucuccacauuuacacaggagaaaacaagccuggaagauuaagugauuugucaacuacugaccagcugacaccuuuccagauuuauuucccugcaucugauuaaucccauugucuuugaaaagauacuguuuuuccaccgcauauucucacucauaggugggaauugaacaaugagaucacauggacacaggaaggggaauaucacacucuggggacugugguggggucaggggaggggggagagauagcauugggagauauaccuaaugcuagaugacacauuagugggugcagcgcaccagcauggcacauguauacauauguaacuaaccugcacaaugugcacauacauguacccuaaaacuuagaguauaauaaaaaaaaaaaaaaaaaaaagaaaagauacuguuuuucaagacuuuaaagaggauuacuauuguuuuuugguagacagacuagaacucauuaucuaauaacaggauuauaacauagucuuauuuaucauguucuuaucucucaugauauuauaugaacagaacuaucacuuuaacaaaaagucauuaauagauuucuguguaauagauaggugguaguaagccaucaauaaauggcaguucuuacucuuauuugaaauaaaaagauccugaaauuauauuauuauuacaggugcauggcuauccauuggucauguauucuauucuuuguagauugacaguuacuuauacuuguucacuguauuuuaaaagcgauucagccugcaacuuaagugguuuauaauuguaagggucaauagaauauauugaaagauuuuuggauuagugaaaacuuggaguuuaguuggccuuuuuauuuucucucucucucucucucucucucucucucucucucugucucucucucucucucucucucucucucuucccuuuucuucuucccaggucucugccagcacccugaaauuucuacauuuguaaaacaauuugcuauugauauuuucucucauuugcuucaucucuaaaggaagagguaguagaaaccaccacugucuuuuugcagaaguuuaaauggaggugugaaaauucaugcuuucuggguucacuuccucucauauaccucagagaagaaugguagccacuuagucuuaagaaaguuuagagccuuagugcaacaguuuagaauaaucuaauuuuuuuguuuguuuuuaaagacuuuguuguuguacucuauuucuauucuucauucuugaaauccccuucccccuaccucuguuccccagccccaccuccuacacaauaauggguguuuugcugaagugaucaaaugaggguuaucuguugcgcaaacacucauauaugaaaaguuaacaaaauagugcccuggcucccuaaucccuauuacuaccacuaauuaagauuccagugaaugccucuuuggauuugagguuuaucacaaguaaucugacaaaguuucauuuacacaaguacuguggaaauguagcuuguccuuuuguaaauuguuauuaugaagggguacauuagacuaaaauuuucuuaaguucauacaucucguauaacuggcucugggaaaucacugagugcucaaaagaguuaugaauugaauucacuguaaaugcuagauuagaauaauuuuuauaguaacagauguggaagaugucuauuuggccuuuuuaaaaaaacuuuauauguuauacacaaaauaaauauugacaauuugaccacuuuacguuguauacuuuauauacgaaacaaaaaugcuuuaacuucuucauacgaaaaauaaaauuuauacuguucugaagucagugguucccugaucauauuuuuuuuacucugaguaucaugaucaaugucccuuuuguguguugaguauuugaaacuuuaauuuggaaaagaaaaauguacuucuuagacauuaguuuuaugguaauuauaaugaagcuggacauaauugcauauuuauacuucauuguaaaucaacagcuuccuaauauucuuaaaaguguuccuuuuuuuuuuaaaaaaaacagcagcauuuuguuaaccuuaaucagagccugacguguguuucuucuaaauggcaucugaugugguaucucuccucaguucucugugguuuccuguuuuuuucauacauagagaaacacuuuuugagguauuaagccucauauuuuucuucuuuuaaugguaccugaaaccuaaacucucuuauaaauacagcauaguguugucaaccugucucaccauuaauuuaugccacuucccacagacugcuucucuggaaucccuccagcccuugcuguguauccaucacccagcuagcauuguccuuacauaccccacucuagauucuuuagcauuacagguuuuacuucugucccuaaagugugaucuucagagacaaagauguuaucuuuauuucuauaauuguauuuccccaacagugccuuguuuuagcaaugaauagauauaguaggcucucaaaguguugucucuagagcagcagcagcagcagcagccucagggaacauuuuauggcugucaguguucaggccccaccccaaugcuacugaaucauaauaucuuggguugaggaucaggcuauguuaacaagcccuucagauaauuuggaugcaugcugaaguuugacaaacacugcuauagaaaauuauugaaugaauaugaaaguuguaccuuuauggugauaucucauugaagaggauugauauagcauggggccaggcacaauuuaguuuauucugccugagucuuguauuucagagauacugguaaaggaaaccuaagauuuaaauauuugcuaucuuauaagaggauguuaucuuauaagagggacggcuuuuaugcuauucuguuguaaaaauuguaguuuaaguuuuaaaaacugaaugauuucuuucuucugccgaauuaggaauaggcauuauucugaagcaggaagguuaacuaagaaaugcauccugggugucacuaauuuucauggugggaaagaggguaggugaguuggaaacuggucagguggggauagguugagagacguuucccuaguuaccauucugugcucuucuaaauuuuuugaaucauguaacugcauaacauguuaaaauuuugucgaaugauauucagucagaauaaaguaauaaauauugaauaaacucccaugauauaaccauugugguugguuuaaaaauuaaguuuuucuuuuguauuaauaugaaaaguuagauaacguauguuuuucaucucugcagaaaacaucaggguuguggcagaaaugucuugauggcuuucuaccuuagccuucuugaauugguugauacauauuacucauuugugcaaugaauaaaggauuucuauuauuauauggacccaucaucuuaugacuguuuuuagaaaaugagaauuaaaucuugauucauuauuaaauaaccuuguauacacacaugaagaggucaugacacauaagacuuugaccuaauaccuuuuuucagauauguuucuauagcuaucuugauagccuaggacuguuugagagaaaauuaauuuaaauuuuugucauauucuuagcaaaugcaaaauaauugaguuaaacagaacccacuacauuuguucugaaauaugaacaauauucucaaauauuugucugguaguacaaauacaauuauauuaauuuuauuauugaauuuugcugcuucaaagggagguauuucuuaaaugauacuugauucaauuauuucccuuuuuuuccaccuugcacagaacuaucguaccauggaaaguauucagacagugccuucaugagguccaccagauuagcucuggccuggaagcaauggcucuaaaaucaacaauugauuuaacuugcaaugauuacauuucaguuuuugaauuugauauuuuuaccaggcuguuucagguaaguuuauacuugcuuagucuauccauucccuucuucucucucccugucuuuucucucuguuucucucucucucugucucucucucacacacacacacauaaacaaacauauggaaaauagugucauuccuauuagucuguaauuuuauugguauguuuggucauuguuaaaaguuuagagugagccauuuggcuuaaguuuggaguuaucagaugcugugagccugguggcugcuuguuagcuuugagaggauccauccaaaagagcuuuguuuuaaacucucuacuuaguuucuuacuuuauuuuguugaucuuuuagcacaaugauggauagaaugcaacaacuggaggugggcauuugccaccuagaucuaaaaucuuucccuuugccuucuguguuuauuaggucaaaagggaaauaguaaacuuagaaauaucagacuguucuguauaggacagaacuguguccuguacuuauuuuguaaauugcuuugcacauucaaccauguguaaugaacauuuuucaaagucaauaaauauucuucaucaguucccuugucauauucauucaaaauaguaugucaguauuaacaaagcucucuuuugaaaaauuuaggucuuuucccacauuuucucuaauguaaacaacuuuaagaugaacauuuuuguugugcuuauuguuuuucccuuuaaauuaucuuccauaauuguuuucacauagcaaauuagaagaagguagcauuauauggauacuaucauuuucuucuuuugcgugccuuaauggaauuaucuuaaacaugaagacuugaaauuuguguuuugagauugacucugccacuaaaauguguaucaucugugggauucaguucaaguagucacaaaauaaaaauuuucugcuuaacauuuuuaugauuugguaacauaaauuauauaguaaaugagguaaauugaucagacugggcuuacuuauguucugauauuauuuuuuaucauuuuaaucugaaguaacauugauucucuuugaaacaugcuuucaacaaauaucagaguauaauguugauuucauguuuuucauguuacaugaacuucucugauuuauaauucugcuuggcacuagcuagcaaggauuggaugacugguuuuuguaauaaaaaccacaaugcacaggauuagcuuuuaauuuaugaaggaacccauuauuagaagagagauuaacuccugucaacaguacauauaggaugugaaaccccgccucuacuaaaaauacaaaaaauuagcugggcguggugaugagcaccuguagucccagcuacuugggaggcugaggcaggagaauggugugaacccgggaggcagagcuugcagugagcugauaucgugucacugcacuccagccugggcaacagagcaagacucugucucaaaaaaaaaaaaauacauauaggauauauuucacuucauuacaauuacagaaucauaauucuaccuucuauauaggguaagcaauuacauaaaucacugaugaaagugugcuuuugauuauuuuaaauuuuuuaaauucgugauuauucccuugguguauguauuacaguuugacaguuuauguuuuuuucaaagauuuuaagauauauuuuagaaaaaaaaguugucugauauuggucauuuuauaauggaaccucuccuuucuuuaaagguuucugauaauuuuacagaauaucuuauuuauuuaacaugauacaaagacauucuaaauaguaagagcuuugcuucuucaccuugucaaggaagagaguaaaaguaaucuuccuacauuaaaccuaacugcucauucuaggaagugaguauauuuuuuuguggugagccuggaugacuuuuuacuguggguauuaaaugcuagaauuccuugcaguuauauauugaaaguaugagggcaacuuaauguugguuaaacgauuaccuaaacugcuauuuaguauguggacauauuuucuuauaagcuguuuuacuuuaaaacagcacaagucaaccuuaauacucuaaggaauauauaucuuauuuacuuucacugggaugggaaaagaaagggcuauuuuuaagucaagcuacugugaaaaguuuuauaucauaaaaugaaaaucuuaccugggcuagggaaugccuaaucauuuuaaaaacaugauuacagaagcagcugaagaacucuuguuagcccguguauuucugagauucaucauuccauuuauuucuaugcuguaaucaaaugcuuugaauauaaucguaugugugccuuaaaauaugauaaaauugauucuguuuauagagaaguagaugguuuaacuuuugcugaucuuuuauuuuuauaaaacuuuaaaaauuaagugauuuucuuaaauguauuauauuuauuaaauccuuacauuuauauauucuguaugaaaauauguuuugcuaauacugugugacugcgggaacauacauucagcuauagccaugauauuaguaguuaauuggcagugacuucugacuaaauuauugggagugggguauuuagcagaaagggaacugaaggugagcaagguacacuuagaauuuggggucugaaguagagaaacuagcagaagaaggagccagugggggggcaggagaugaaguugagaauugcagagggaaugaaagaaguaaaaauguuugcuuccucuuggcuuucauucuuauaugcaggcagaaccugaacaaauacuugggagucacuggagggaucuuacuguggucaccuuccucauuuccucuucuuccuucuuuccuucucuuuauccuucucuuuucucucaaagucacuuagagaugcuggaaucagcacaugcuaauauuaguccuggaaagaaauuauagggauuuugcuucucccuuccuucucccuggggcuguuguuccccuuuuccucuauauccccacuguuagaaaaaauggggucacugagaaauggggcacuacauuuggggguagcaggauaaggacggaguauuuuaguagaauauccuauugacuauggaauguguagcaucaauggaauagugaggaaaaucaaagaagaggaaaguccucaguuguaguaaagaauuauagagagugucuaggcagaccagccaaggacccucuuccaacuuaaguuguaagucaguaacuggcucuucuugaaaauaguagcauuugggagaauggagggacuugucuccuuuauucacuucauuaauuucuauagucauuuaaaaguaucuagauaauuuuauguucuuguacacaaaaaaauuucuucaaucugaaaaacaaaauaaaaaaaaguuacucuccaaagcacuuuguuuugccuuuuuuaagccaguaguugucgaaauacuuuaaaaagaaaaagcacauaaguacuacauguuucuguuuugaaugggcugcauacaaggaaaacaauacacagacucauucuauuacauaaauauuuuugcaauuagaagcuggcccucuggauuauguacuaagaaaugguugcugaauacuguagcaguuggcucaaaacuccaacuuaauuuuuuuacuuguauuuugaucugugcauuggugcucuauaaaguuuagcauuuuuuuucaaacacucuuccacuaauuuguguggacuuuaauggaagugacccaaauauuuguuugguauuucuuucauccuuguccuucauagauggguagaacaaaacaaaacaaaaacuagggucuagaauaacaguuauugcucaguuuuuuaaaauauaugcugacauuuuccaaguaauguuuaaugcaguuuuuagucaugcauuaggaagaaaauuaaaaacaugcauuuuuuucaaccucucauauuauuauucucuagagcgccuuucuugcccaauuagguauuuuagugugauggggaaauaccccaaagauuuuucuuguuauguugaaaaaggcuaaaaaacuucauuauuacuaaaucauucuuuguuauccucaucucaagggauauaauccuugcagaauucugccuuguaaauuuguaacuugcuuaacaauaaugaggaacaagucucaaaacaaacaaaagcaggaacuuucuaccaguaaucaugucuaggaugacugcuuuaacagcuuuaacauggcaacguaaaaauacuuuuuuuuucuuuuauguagaagauuuaauaaucuggcacaucagauagaguaugcugccaguuccuuggaauaaauguagcgucagccuuaaaaaaaucgcagagaugauucauccacacccuugaguaaaguugucuaucacugacugccuuuuuucucuugcccugguaacuggagagacaacuaaucagauuaaagagagaaugauacagugguacaaaccaaauacuucugugaaaaguuuuguuuuuauguaacucacuuuuaaacccuaaaccuuuccuaagcuuauaguucuguacaguuaagccagaugugacuacuguaguguuaacacuagccuuuuacacaagucacuauuuagaggaucuaucuguucaaugacaauuaucccuggcugauuacuauuaucugacacuugcauugguccuggcaucccaugggugagcaagacaggcaugucccuugcccuuauguagcuuaugguuaauguguaaccuuugccaagucaugcaaguucuaugauaugguuucuuacuguguaaaaugaagcaguuguuaacaguuaacagacauacagggaggugaagaauauggcaagagguaacaauuuuaaauacacuggucagagaaggcuucauugaggaagugacauuuggagacaggaaugagauggauauuugggggaagaaaauucaaguaaaggcaucggcaaauacaaagucucugagggggaagagggcuuuuuuguucaagacaauagcaggcuggagaagaugcagaaagugggagaguuauagcagauggagacaaaaaagggaacugcuggggaucaaaccuuguaaaguccuucuaagugauauaugaggacuuugacuuuuauucaaaguuagaaggcuuugaacaaaagaauuauuucauuuguguuuuacaauggucacaagugccguagcgagaauaggcuguguagagaagagauuuugugguuuucuuuuuuguucucuguauucucuuccugaaaaaucuguuuucugccuaaucauauuucuguaaagaacaauagacuugaacgucugcuguuaaguaacaaagguugaccuaaaccacauaaggucagauuaacuuuuaaaauauccaagauaauguuaaguguauuaaauaugguucaguauguaaucaaaauauuugauauucucuagauacuaaucucuuuuaauuuuuuuauuuuuuagccuuggggcucuauuuugcggaauuggaauuucuuagcugugacacauccagguuacauggcauuucucacauaugaugaaguuaaagcacgacuacagaaauauagcaccaaacccggaagguaagacuuuuuagcaguaauauuaugugauauauccaaagaugaaaaauucuccaugguuuguuccuaaguaagucagcaauacccgcugauggcaugcuugggagggggcuagaaaagguaaaagaccaaaauggugcuucuuaacauaauguuuuaaauugauacauugugcuuacucugaaacuugguauucauaaagugaaaggggauauggucuccuuucuguuuucaugauauccguguuuaugugcaaaauugaauguauauauuugaauacuugaauacugugcuaaagaacaaauaaauagaacagucuuauguucauuacuuuaggguauuuuuaagacauucauuuaggcucucugauaaauauaaguacauauacaugcacaugaacacauaaauauacauguaaguuuaugaacaaauacauguauguacauaagcauauauaaaccuauuguuauaaucaaaaccaauuucguguccuugaaaacuuuuuucauaaugccucguguuuuauuauagccucagaauuuauauuuuauuuuccacaugaugaaacuaaaugagacuuggagagguuggucagccccuguggcuuuggccaagaaauuacaccuuauuaauggcaaaucuggauccagaaaaucugucucuuccaugguucagugcauuuucccauguauuucaucuaaaaaugcauuaggcccauaguaggcauuugugcuauggcaggcaguaugcugaguacggcaguagggauauuagagaccugcuugucagaguccucacauuucagaugcuauucugguauucauuagugcucugauuuucauauagagaacauuccauuuuagggaugaauuuggugcugguuuuuaagacugccuuuuuuuucuaguaucauuuuuauuugguuuaugguguauauaauguuuguacuuuauaacauuuuuguuuuguuuuguuuugcuuuguuuuugagauggagucuugcucugucaccaggcuggagugcaauggcacaaucucuguucacugcaaccuucgacucccugguucgagcaauucuccugccuuaaccucccaaguagcugggauuacaggugugugccaccacgcccagcuauuuuuuguauuuuuaguagagaugggguuucaccauguuggucaggauggucuugaucuccugaccucgugaucugcccaccuuggucucccaaagugcugggauuacaggcgugagccaccaugccuggccaaaacaguuuuuuuuuuaagugcaagccaauagugcugauuuuuucuucucugccauuaugaaaauuuccauauuuuugucuuuuuaagaauuuauauaguguauuugaaaaaggagcuagugaauacaaaaacaguuuggcuuccacugaaaucuucuauuuagacuaaggagaguuaguucucauuguaaccaugagagaaggucaguuauuuugcauauugacagugguuuagaugaaugauuuucuuucauucaagaaucucucaugaccagauuuuuccauaguuuuuacucucuugaaugacaucauauaaaguaucuuucuugcucuuggcguaugaugugaaaaauguguugugguuggaauuaugcagucauacaaaauuuaacaugugaguuauuugauaaauuuucuuguccaaucauagaaauaaugagggaacugaggccuuuauuuuugguuuuguuuucuuguucaguaucauggagaacaugaauuacaauauugagaacaacagccaggucucauuacuauuuggaaaaguucucuuaguaaaaaacuacugcccucugauaagaauaucauaagacccaccaguaaacuuaucuucaaauguguacaauauauacauuuuauacagcuuuuuuguauaucagucauaccuuaaaaaacuagaauaauguccucugagaaaaaaauccuucuuuccuuccuaacuugccauguaaugauuuuuucuacuaaauuuuagguagcuaaugaugaaauaaauaauauauaacaaauuauaauguguaaaguaugacauggguacuaaagauguguuuaggaaaacacccuuaaugaauaaaaaaaaaacuguaacaaauauuugcuuuggagaauaucuguguuuaacauuuuuuuuuuuuuuaucuuggaaaguauuucaugucuuugacuucauaguauagaaaacaauuggauuuacuucaaggacauuuuggcuccuuagguugugcuuuauuauuggggauccaucugacaaaauaugaguuauggggugaagguaguaacauuuggaaaucuaagugaaguauucauuaggugacaagaguggcauugaacccuaaaccaccucgucaacaugaaagauacuucauuuuauaugcauauauauauuuuuuuuuaauuuuuuuuuuuuuuugagacagagucucacuguguucacccagcaggagugcagugguacuaucugggcucacuguaagcuccaccuccuggguucaaacgauucucaugccucagccuccugaguagcugggacuacaggcauguaccaucaugccuugccaauuuuuuuguauuuuuaguggagacggguuuucgccauguuggccaugguggccucgaacuccuggccucaaaugauccaccuugcucagucucccaacgugcugggauuacaggugugagccaccacuccuggccccaauuugauuaaaugaagcauguuguuuaagagagcaaggugcuaaaaauaagccaaaaauucacuugagguugggaagggguagccaccagccaaagggucagcagcaaauuaaauggaauaggaaaaaggugcaugagaggaagaaauuguucuaaaaugcccuuggcucuuaccagauugcugguauuacuaucucuuauauacaugaauugcuugaaccuucuguauaauaaugaguuuuagaaacaccaucccaaaacaauguuuagagcaacagagaaggacaugaauuaaaaaugugagcaauuucacaaguauguauuucaguaucuacuagauucuuacuauaugaauaaauuuggaauuacauuuaaaauuacuagcaaugcagauguguaauuauuuucuucauguuaauacacuguaaacuuugcugagauucauaguacacagauuuuuaagauuuuaacuuuugacuuaauuugaaggaauuuuaucauuaauuuuuuuauguaacauuuuaauaauguccuucugaauuauaauuuauagugacuuucuauuauuuuuggcacuucucauaauaucauagccguaggucucuguggcauuauuuuaucugauuuugauuaagaaugccaauaguugacagauugauauccuauuuucaguuucucuagggauauauguuuuuagacuuuuuugaaaaguucuuuccaaagauucuaucaccaauauaaaguuuuuaauauuuaaaaaucacuucuuuuuuuaaauucuaguuuguccaaagaugaaauuacacucuacuacuaaauauacaaguuaauuaaauccagugacugcagccauuauguauguuaaaguauaucuuucaaguuacauuuauagugcuuggucuaucaaugacuaaaguauauuuugacauacuugugucugccacauacauacagcagcucgaauauuaaaauauagccaacagauuuaaguugguuuguuuuugaucugcuuaauggguaauaaaauccagaaggauauccugauagaaagauugaaugcaguacacucaaauaaagagaaaugaucuaaaaugaaauaaguacauagauagcuaaaugaauacauaaaugauaaugauggauuuaaagccaaguugcugccuccuuuuguuggauauuaguuucaagggacuugauuugauuuauauuuuugaacuaucuuaacuuccccuuguaagauacugaauuugacaugguuagauggcaggcaugaaauuaccuaguuugcacuuuugagcuuuagggaugaauggcaggaauaccugaaagaaaaguuacuauuuuuuuaacaguuggccgggugcgguggcucacgccuguaaucccagcacuuugggaugccgaggcggguggaucaugaggucaggauaucgagaccauccuggcuaacguggucucuauuaaaaauacaaaaaauuggccaggcgcgguggcucaugccuguaaucccagcacuuugggaggccaaggcgggcagaucaccaggucaggagaucgagaccauccuggcuaacacggugaaccccaucucuacuaaaaauacaaaaaaauuagcugggugugguggcgggcaccuguggucccagcuacucgggaggcugaagcaggagaauagcgugaaccugggaggcggagcuugcagugagccgugauugcgccacugcacuccagcaugggcgacagagcaagacucugucucaaaaacaaaacaagcaacaacaacaacaaaauaacaacaacaacaaaaauacaaaaaauuagcugggcgucguggcacacgccuguagucccagcuacucaggaggcugaggcaggagaaucgcuugaaccugggaggcggagguugcagugagccgagauggcgccacugcacuacagccugggugauagagugagacugcgucucaaaaaaaacaaacaaacuaauuuuaaugucuaaauuacaaaggaauauaucgaauucuaagccugggugacagaguaagacuccgucucaaaaaaaaaaaaaaaaaaaaaacccuaauuuuuaugucuaaauuacaaaggaauauauugaguucuacaguagaaacuggcucaguuuuugucugagguaggcaaauuaaauuuaaauuuuuacuuauuuauuuuauuuuuacauuccaagagugauuuauuuuguagcuauuccaugccaucagcauuuccauacaccgcauccugaugaugaugguaaaaaaaucccuaguuuacaaucuuguuuauuuucuuauauauguaucuggaaguauuuaaauaaaaagaaaugaucaguguuucucuuguaaauugauaaauggagaaguacauuguugcuaaaaauaaguuagaagacagaauaugaggaguauucaggaauucuaaaugauuguuuauucuuuugcuuggaagaaaccuaacaaauuguuuaguauugauuuauauucugaauguaauuagauguaauuuucuuauguuuugcagcuauauuuuccgguuaaguugcacucgauugggacagugggccauuggcuaugugacuggggaugggaauaucuuacagaccauaccucauaacaagcccuuauuucaagcccugauugauggcagcagggaaggauuguaaguaugagaaauggaaguuggagugcuuaugauucaugaauuugaaaaauaaagauugcuuugugauggcgaaaauggauagcaaggcugcuuuuuauguuaagacugagaaauaauggauguuccuuaguuuuuuguucaucuuuuuauauaaucauuuuaagguaaccuaauuauuugaaacuauguuauagcaaauacauuucaacuucaaauuacaacaugaauuuuuaucuuucauaugauaaaaacuugggacuuaaagguaguuuuaaaauggauguaaaacuguuuauauauuaagagaaaauuauuuagaauaauugacuucuguuucuucauauaacccuuagaauacuaguuucacuuuuucuuucuuuuuuuuuuuugagauggagucuaacucuguugccaggcuggagugcaguggcacaaucucugcucacugcaaccuccgccuccuggguucaagggauuccccugccucagccucccaaguggcugggacuacaggcgugcgccaccaugcccugcuaguuuuuuguauuuuaguagagacgggguuucaccguguuagccaggauggccucaauuuccugaccucaugauccacccgccucggccucccaaagugcugggauuacaggcaugagccacugugcccagccaguuucacuuuuuuuauuuugauuguuagugccagauuuucuuuucucuuucuuaucuguuucucccuccaccccuuuucuuuucucucuguagaucuuuccuuuuucacacuaauaauaacuccauauucaggacuauauguuaauagcuaaguuuaguuuaucucaagcuauuccuuuuuaaaauuuaaaaauaaguuaaguuucccuuuguuuuuuagauuaauaaugaauucucccccacucacuccacacacaaaguauggacaaucuguugggccccuucauaguaaauaugucugauucuucuuauuuguuuuauucacaugccuuucccuuuguccucuccuuguauucucagugcacuugaucaugcugcuuuuucuuccccucugccuugcuggauaacuuagagaugcucgugaucaaacucgcugcaguaugaauucugguagaaaccuagaaggaaaaaguccaccagaguuaacaaagagcaaaugauuugaguuuuaccuuuaucaaaguaauugcaaaaaagaaagaaagaaaagaaaaaaagugaugagauuuauacaaagaaaaauuaggaauuucuaaaaaccuaugagcuuuugggugggagugguggcuuacgccuguaaucccagcauuuugggaggccaaggcaggaggaucacuugagcccaggaguucgaggucaggcugggcaacauggcaaaacccuagcucuacaaaaaaugcaaaaaaauuagcugggcaugguggcgcgugacgguaguccucgcuacucuggaggcuaagauggguuaaucaccugagccugggaaguugaggcuacagugacaacaucgugccacugcacuccagccugugcaucagagugagaccuuaucugaaaaaauaauaauaauaccaacacacacaaaaccuuucaauaaauuaauuacauaguaauuguauggcaaguuaugguaccaaauguguauuucucuuucuuuuuccuucuaauuuucauaaauuugcuagugucgguuauuuauaccuuucuucuaaugcaucaaagcuuuguguauagauuuugauuuaccaugauuacagauuuuuuuuaagaaaauauacuuuaaaguuugaauuuauaaguagaaccuaucaacaaccuccugauagguuaaaaagaaccuuuaaccuuuccuaugguacccuaaucaugauuuuuguaaucuuuaauuucugaauucuugcuagaauuucuucauauuauuugaaaugugauacauaaaauuuuauauaauauuuuuuuaaauggccaauuuuuaggguauauaaaaaaguugcuuauucuucuuuggauuaucauuccucauuuaauguuugucaaauuuuguaacacacccauaaggacauucuaaauuuguaucauacucagauguaguaaacuccuuuugcuaaaucauaaaaaaaucaucucacugauuugucccuuacuauguaagaauuaucuguccuuuaaguucauuuuucugguuuuccuggguaaauucuaacacuuaacauguuuguagacuccucauucgaggauaaauauuuuuuguuauuuuaaagaauagauuuguuauaguuuuacccuuuaaaauauacauacuacaguacuauauucuuauuguuuuauuuaagaaauuuaguauagaaagauguuaaacagaacuaaccauaauuuaauaaacugaugaaauacagcagugacauuaccacuuuuuucaauuaaaaauaaguauuuaccaacacaguaaauuuuauuuuuuaaugaauuuuucaauaacaaguacaacuucugauuuaacacagcaagaaugcauuauuacuacaacuuuuaguucagauuucaguuuucccugauaauagaaccuuguaucuauagaccauuuuguguuuguaguguuaagucaaugaaacauggaaacguaacauuuucuaauuuuuuaaaauguguaugugccugugugucuguguguuugcauaugugcacauguguuuguguuaggugaggggaagaugggagaagagauauggaaacuguagaaacaggaauaccacagaaguguuugaguaacuuacaagaaaacuguggccuuuaauuauauuuuucuuuccaugugguauuaggcaugguguaaaaugauaccauuauuaccugugccucagaugaaggauguaauaguugcaaauagguauaucuucaaaguguuuuggaauacaacaugauugaccagugaaauaaauucuuaacuuauauaagagacauauauuaaagguauuucauugaaaaugguugcuuaguggguuaggcuauauucauuauguauuucuuauaugaaaauucuacauuuuaaguguccuaaaaacaacauaguaauuuggaaacauugaaguaauauguuauugauauguuacaugaaaaggaaacauccaaauguauguuugaauauagaaaaauuugauuaaauauccuuaaaugcaauuaaaacuuguauauuuaagguaauaaaguuucuguuuaaauucaguuaucuuuauccugaugggaggaguuauaauccugauuuaacuggauuaugugaaccuacaccucaugaccauauaaaaguuacacagguaaggauaauugcuagaaaaguauaauuaaauaaguauccauaaugcccuugaaauaaauaagacucucuuaguguaguuaaaaucaugcacagguauuuaauacaaaauauacuuaaggaauucuaagaguguuuaaggagaaauuauauuacuuucuuagauuuuuugauacaaauuuaugcuguuaaaauucuugcuuuccauauaguauuggcauuuauaugggggaaauaaauaaauccauaagcaaguagguggauguaaggagagagccauaguuuagaaagcuaccaaaaaaagauuagaauaauuauaugccuuagauuuuagagucaaauggguaauugaagccuguugaagauaacaauuauguuuuucuaaauccauugcuggcagccucauagcuuaugaauaggaauguaaguugguaaaaccuuucuugagagugauauucagugauuauaaaaaucuaagugaaaauaucuuuucacuuuaaauucuauauauguaauagaucccauauauaucacuuacacaugcacacaaaaaucuauacaacagguauuuacuguaauauuuuuuguaaaagcgaaaaauuacaaaauacuaagaacuuuaguaauagauuaaauaaaauagacuacuguucucauacuguauugugugaagucaugaacaggagggagguagcucuacauacucacaugggaacuucugcaucuuguacuguaaaauaauuccauuuauguaaaguacauguagguaacauuucauuuggucaaguugcauuauguacguucaacuucuguaaggaaauaauuaauuaauugcuguauaugaacaugugaguauaguuuuuaaaagaucaaaaaaacaccaaacugguaagaagauuuaacugaggaggugaaaagggauugagcagugagggaggggaugaagggagaacuugaauauuuuauuuuauauucagucuaguuuuaaaauauuuuauauuugagauauguucacgccuuguguaauaaguaauaaaaaucuaagggaaaaaacaagagaagaauuacagcuuuuuuuaagacaguagauaauaauuuaccuuauaauucuccagauuuccuuucccauggucuuuacauuauuaugugagacauacacauugacauuuauauguacauauuguacguguaaauuuaauaaaugauugccuuguuuuucuuuuuuugagacagagucuugcuuugucgcccaggcuggagugcagugacgcgaucucggcucacuacaaccucugcccucuggguucgagcuguucucuugccucagccucccgaguagcuggcauuacaggugccugccaccacuuccggcuaauuuuuguauuuuuaguagagaugggguuucuccauguuggucaggaucaaacuccugaccucaggugauccacccgccucgcccucccaaagugcugggauuacaggcgugagccaccaugcccggccaugauugccauuuuaaauuuaauauaugauugccauuuuaaaaguuauguggugauccuguauuuucaaauaugugugaaaggauacuuaggaaagacaguuccucuuuauaaagccauuaaaaaaauaaaucuuuggaaguaauaacauccccuuaaauuacucauaaauacucuuacuguuuagguugcauugagaucugcaucuuugauuuuagcuuaauguaauuuuuuuuauaauugcauauuuuuccuuuggacagucauaaccaguaucaauacuuaucuauuauuucagggacaucagcaauuuauaacuuacuuugaauuacuuuaguuuuauuucuucuccauuuuuaugcauucucucgucucuuuccuuaaguuccccacaaaauuuuuguauauucacacaucauaauagacacaguuuauguguacauguguguaccugcauguacaugcauauguauccauguauguuuauguauauguauauuuuucucaccaggauuauaauauauuuuaguagucuguggacuaaauauuauuauuuauuuauccuacuccgugccaggcacauuguagucacuuacugaacuaaaaguugcuuuauuuacccaaauauugguuucauaauuccuuuucuuuguauuccuaacaucuuuuuucauuauuuaccaauuuauuuguauuuuuucaaauuuaccaauuuauuuguauuuuugucacgaagaucuuuucaguauuugaauuuugaaaauuuuacugugucaaauguuuuaagcuaaaaacccaaucaaucaagaacauugcaguuuuaauaaaaugguuuuugguuacugaagugauuuguuuucuugacaguguuagggaaagcguaugcacuuuuuagucagaggcuuaauuuagaguuugaagcaaacaaguuaaacugauuaagccccaggccuaacuuuuguuaaguucaauauaucuucuugugcuuuggagaugaagugaaauaguaaguguggaccacagugccuggcaugcgggaagugcuugguaaauguuugucacuuuucuugcauucagggauuucuaaagauauugaaacaguaaaauuuaauguuuagccaaguaucauuuuuuuuucaauuugacaguuaaauuauaugagcauguggcauuuauaaaaaagauaaagucauuuuauauuccuauuuuaaaaccauagauuuugucuuuugagucaccaugacuauugaagcaagucccuuccuaaaggaacaguaaaggaaccuuaaauaauaugaaucauuaagaagcauguaagauagaugauaaaaguucaaaccuuuuuaaaaugaauuuuguagaccaaauugugauuaucaauucaaaacaugucucaaaugguaacaaaauucugacaaggucaauugugagauauugacugugcgucauuuuauuugggaaaauuugauacuaacaauuugugcuggaaauacauuaacauuacuuucucccuccuccccaaauuccaggaacaauaugaauuauauugugaaaugggcuccacuuuucagcucuguaagauuugugcagagaaugacaaagaugucaagauugagccuugugggcauuugaugugcaccucuugccuuacggcauggcagguauaaucauuagcaacauggaugucuuucuuauauguccuacuaauauuucucuuuucaguuuucuuaaugguuuaggaaguaaugcugguaagugcuuuguuugaaaugauuguguaaagauuuuauauguuugaguugcuauauauaauuugauuuuuaacuaucuuauauuuuaucuuuaaauguauaaauuuuauuauauuagucaucaguaguucuacuucuguaguaccauggauuucaguauguucacuuauagguauuaccaacuagacauuuuuaugccauuuauugauaggucagaaucuguuuguaguaggucaguuucugaagccaaguaaaccauaguagauaaaucuuauuuugauauuuucaagcaaacuucuuuacuccugaggaggcaugguuccugucucacauaugcuccguagugcugaaauuggagaaucagacaggaaguaucucucaaacacuuauaguucccacagaaacaggcauuaaaguucccuauuuacugaagcauaaucucaggcaaauugccuucccaucugccgcaggcauucaauaaauauaaauugauuugaaguuuuauaggaaggucuggagaauaacugguuuucccaaggacuuuccuuuuuuuuuuuuuuuugagacagagucuugcucugucgcccaggcuggagugcaguggcacgaucucggcacacagcaagcuccgccuccuggguucacgccauucuccugccucagccucccgaguagcugggucuacaggugcccgccaccgugcccagcuaauuuuuuguauuuuuaguagagacgggguuucaccauguuagccaggauggucucgaucuccugaccuugugauccaccugccacggccucccaaagugcugggauuacaggugugagcccaagggcuuucuuauauuucuucaucuguaacaaagauuggggauuuuuaaaauggaucuuuggacagauuuccaguuuugaguauuuggaggagucauggaauauuuugaucaagccauuuugaaacuguuugacauaguuauauugaaguuagaaguauauugauaggguuuagaaagcaaauaauuaaauuuucuagucuuuaaaaaagauuuucggugaagcauaaaguugacauuccuacccuauuucuaagcccucucaguccuugauuuucuuuguccaacccugcaucucugcaugaguugaggaaggauggacauugaggcucauggaagggggcugacagacucagaggggcauugaugccugccgagcuccuuacuuaguaauaaaauauaaugauuuucccauuuucauagucauaaaagggccugcuucuucuuuugugaauauuuuuuuaauggaugaggaaaagaggaagaauuaggaaaugaauuacaguugauuuauauuuucaaaguccuuucugaaugcccagagaucuuugcuaccucaguaacguuguucaaaaucccuauacuucucuucuucauaugcauuuggcuuauauuuuguuuuacguuuuucuuuauauccucucccuuauuuccuuuuaucccuucaugauguuggcgaaauuugcauauuacagggagauguugaaggagaucauucucaacauagauacuugauuccuauuuaaauuacauuaacaguaauaguucugcaaacuuagcagugccuuuuaaacuacauucaauaaauguagauauguugguagaagacagaauuguuugcaaguuuauuucaaaugugucaguaggagguauuauagagauauugacucagugauagauugucuguaauuggacuacuuaggauugguguaccugauaaucauucaguguuucaggauacguguuaaacuaacaaagaaaacaaauuguauuugucacccuucuuugccuucagggugguagugugguuuuuacaaguacaaagaaacuaaaagccuugcauuucucccugaagaaaaucagaauaauaggcugauacaaauuccuaacacucugccuccaugcagggcuuguguauuucagccauuuuucuuggggcuccagucuuagagcauacacaugcauacauguugcaagacuucacaucuguaacucaauacugugcuuaguauuuggagguuaaguugguuaaaagucagaagcugcuaugaguuugacagaaacauuuguuuaguaaaauguuuuguucaaagcaucauacaaaauaguuuacuggccaggcauggcggcucacaccucuuaaaucccaguacuuugggaggcugagacaggaagauccccugagcccaggaguucgagaacagccuggacaacauaaggagaccccgucucuauaaaguaauaauaauaauaauaaaauaguuguuugccuugcagcccagggugaguagaaaaguauggcugaauauaaagcaacaaauauuuauuuuacuuucuauauacuucuuaaaagaaaguuuauucuuaguaaauaaauacuaccuuuacuuaaguccuaacuucacauugucaguacauucuuggaaacugcaacuuugagcaaagugacauacuguaugcuguaggaaccuuaacucuuguuucuaucaauuagccuaggguaaaauggauuucauuauacaguaaguuguuucacuuaaagucucaauuuccaagaacuaauuaacaauauuaauugaggacuuacuguauuuauuuguuagguuugugaacuauuugcaguagguucauuaugugcaaaaggcauaggaacauuucccaguugucuuucuguauuacuaaugcuguguaaucaccacaacauuuuacaucaccacaacaugucuauguguuacugugcauucuccaaauugguguaguuccucuugcuuguugcuuaucaauuccuugaauuauuucaugauuuuuuauauuggccuaaugaccuuauaugaagauauguucaguaauguuaguaaguuguuaacauuuacuauuucucuuuuucauucucagcuacuucucaguuuuacuuuuauaaauugaggaaguacauaauugucaagcucugaaaauuguguuuagcuaaaauuuuaaaaguuaugugagaguaauaguuuacuaaguaaaguagaaacaaaaaugacaaauucaaaacuauucagaagguugaaauaauaaauuacauuuauguuacuagacaguaauguuauugucuuaaucugaucauugaauuuugcaccuaaauuaaugaaaaauaugcaaaccuuuauuuucaguauuguuuuugaauucuccucacacaaagcagcucaucauuaauaagcauccuccugauacauuuuguauauguuucuguaagcucuuaccucauuauguucauauuguaaauauuuccauauuuauguauuuucuuucuagaauguggauuacuuuaccuauuuuagaaucucucugcuagcauguuaucugcacauuggucauuacgcaguaaauacuuauagauugcaugcuagguaauguaaaagaaaaggaagucuaaaaguacauuaaauaaaaagacaguauuguagguugugaaaagcucuuacaauacuuuucugagaauuauuuaugaucuuuucaaagaccuuuuaucauacuuaguaucugagaacgaauccuagaauaucuaaggcuuaguucccuuuguuccauucacuagcuauugugugauuuccuuaacauuuuacauugugauuuuuuuccacccauucuugaaccauguuauuuuacguuuauuguaugcaguacuaccagcacuaacacagaagcaguaagacugcauuuuuaucgcuguuuuacaccaaaaaaaaaauaugcacaguaauccccgguucauguuuucucucccccuaaagaaaauuauucuuaggucaauaauucuaaauugauauuucacagucucuguaucucagugggaucuuacuggucaaaggaaguuucaacuuuugaacauuucuacuuuuggauaaucuaaauauuuuuacauuuagauacagucuucacguagugcuuccugccaacuagcguaucuguuuuggcagcuuuuguauuauugcaugaacaggaauguuuguugaucauuaaaauauguuauugcaaaaugccucugguauuuaauaaaaauaaaaguccuauaaaguuaaucuaguuaaagcacaguuguaaaacauuagauaugcugaaggucucguaucuguaaucucaccuagcugugcucacuugacuuaaccuaauugaugauaaauaugucaguaagaagaacaaaauuauagcacacuucauaguuccacaaaauauugccaaaagugguaucuaagcuuguacauauauagagaaauguucucaagguauuaggugucuggacuuagauuaaaauaacuuacgucucucuuguucaauuuuuuccucauucaaaaaugguaccuuaaagacauuguuuuuguuuuauaugauuaaauuugcaagcuuaacugugcacaggaagaauuuguuauuuugcuucuuccucuuacugguuugguagaagcaaaccaagaugguuucaacuaucauuuuccauuuauuuauuuauuuaggaaacauucuuugagcagcugcaauaucccauguucuguaguaugcucugaacugaaaagaacucugagacacaauccuuagcuccaagaaguuaaaguuaaaauuaaaccugaaauuucuauuaaggggcaugguguuaauaauuacuuaaaaugaguauccuguuauccuucaaauuuaauuauggcugcuagacauuuuuucuuacuuucuacuacguugguugggcaugcugauaugaacaugauuuuaaaggcugcgugucugccaagaagcuaugauaaaucaguuagaauccaauaggaaauauuaaacccugaccauaaaucauacucugcucagcagugugcauuuuuagcaagucauucuucaccaacuuuuccuuccaucugaugcccuacuuugguuuaauugaaauucauuagagacuuaaauuuuauguaauuaacagaaaacuuaagaaaugcgcaguagcugugucaguaguuauaggcugcaagugguuacucuuuaauugcugucauaauggcccauuagucaugccucugaagaggugucagaugcuuuuuucucuuucugaaacaucuguguuauuuaauaaauugaauaagcaagcagaguuugcacagaauacuaaguaaguugaauaaucaccuuucuagagacauucuuugaaguaauacuacucugugugcaacauuuuugugcuacccuuaguaauaaaacuuggagaguugucuuucacauccacguguuaaugggacauuaacaaaacguuuaucuucucaacccugaacuucugcacaucuuccuuugugagguaguauauuaugcagcagugauucugcagcauuaccauguaagguuaaaaguuaaggaauuguuuucauucugugcuuauuucaggaaucuagaaaauggcuuuugauuuguaguucuccuugaagagguucuucacaucccuuguaaguuguauuucuagguauuuuauucucuuuguagcaguugugaaugggaguucacucaugauuuggcucucuguuugucuauuauuggugcauaggaauguuuguuauuuuugcacauagauuuuauauccugagacuuugcugaagcugcuuaucagcuuuaggagauuuugggcugagacgacgggguuuucuaaauauacauucaugucaucugcaaacagagaggacauaaagaaagaaucaauaucaugaaaauggccaaaaugcccaaaguaauuuauagauucaaucuauccccaucaaacuaccauugacuuucuucacagacuuagaaaaaacuacuuuaaauuucauauggaaccaaaaaagagcucguauaaccaagacaauccuaagcaaaaagaaaaaagcuggaggcaucacgcuaccugacuucaaacuauacugcaaggcuacaguaaccaaaacagcaugguacugguaccaaaacagauaucuagaccaauggaacagaauagaugccucagaaauaaugcgacacaucuacaaccaucugaucuuugauaaaccugacaacaacaaacaauggggaaaggauucccuauuuaauaaacgguguugggaaaacuggcuagccauacgcagaaaacugaaacuggaccccuuccuuauaucuuauacaaaaauuaacucaagacggauuaaagacuuaaauguaagacauaaaaccguaaaaacccuagaagaaaaccuaggcaauaccauucaguacauaggcaugggcaaagacuucaugacuaaaacacuaaaagcaauggcaacaaaagccaaaauagacaaaugagaucuaauuaaagagcuucuguacagcaaaagaaacugucgucagagugaacagacaaccuacagaaugagggaaaauuuuuacaguuuauccaucugacaaagggcuaacauccauaaucuacaaggaacuuaaacaaauuuccaagaaaaaaaaacaaagucaaaaagugggcgaagcauaugaacaaacacuucucaaaagaagacauuuaugcagccagcaaacaugaaaaaaagcucaucaucacuugucauuagagaaaugcaaaucaaaaccacaaugagauaaccaucucacgccaguuagaauggcgaucauugaaaagucaggaaacaacagaugcuggagaggauguggagaaauaggagugcuuuuacacuguugaugagaguguaaauuaguucaaccauuguggaagaugguguggugauuccucaaggaucuagagucagaaauaccauuugacccagcaaucccauuacuggguauauacucaaaggauuauaaaucauuguccuaaaaagacacauucacauguauguuuauuguagcacuguucacaagagcaaagacuuggaaccaacccaaauguccaucuaugauagacuggauaaagaaaauguggcacauauacaccauggaauacuaugcagccauaaaaaaggaugaguucauguccuuugcagggacaugguugaagcuggaagccaucauucucagcaaacuaacacaagaacagaaaagccaacacugcauguucucacucauaaguggaaguugaacauugagaacacauggacccaggaggggaacaucacacaccagggucugucagcggcuggggggcaaggggagggauagcuuuaggagacauaccuaauguagaugacugguugauaggugcagcuaaccaccauggcauguguauaccuguguaacaaaccugcauguucugcacauguaucccagaacuuuuaaaguauaauaaaagaaaaaaaaaaaaaaggaaaauggcuuuugagcuccugaauggaacaaaccccaaacuguguucuucauaucuuccuuccaaaauaaaaauguauaucuuugucaguuggauaugcagcuauguuuugaauuacugccaaggacuuuaauucaauuaaauguaaaauuaauuuuccugugguuauucuuccuguauauuguuugauauaauuuaaaagaaagauaucagcguauucaaaauaguaauuuacaaaaaaaucaauaaacucugauuuuaauguggaauaugauuaaggagauuuauagauguuccauauguagagaguguuguugggaaaauguauauaguugucugagagaggugagaaacaaguucaaaugaucacuuuuaaggcaauaagaaauaaucuuuggccaggcgcgguugcucacaccuguaaucccagcacuuugagaagccgagguggguggaucacaugaggucagcaguucaagaccagccuagccaacauggcgaacccuguuucuacuaaaaauaccaaauaacugggcgugguggcgggagccuguaaucccagcagcuugggaggcugaggcacaggugaauggccugaacccuagaggcagagguuucagugagcugagaucacggcacugcaccccagccuagguaacagagugagauucugucucaaagaguaaaaaaaaaagauaaaauaaaauaaauguuuuacucuaucuuccuucaaaggcgaccagucuucacauuucuagccucagugaaauuuuauaacuuagguacuacaaauagaaaauaauacuugccuuuacgaacguuuuaaauuggcacuuuugucuuuaaccacccguugugucuuuuguguaaaugagugauuaaauguuggagcuucccuuucacguugggaguaauaaagaagcugcgagaguuguccaaacacguuauaguaacauuaugaacuagagcgaugcacuagaaaaggaaaggaacugauggauaugagaaaauaaaaucugguagaauaagugcuugauucuuaagucuaaugacuaaauuagauggaugcccacuauauuguagaguguguggaccguaacagauacuggcacuuuggaaacauuuucaguugacuccaacauggaucuuuuauagguguuuuuaaaguugacaccauuuuuaaaaaguguuuagaauguagacucauucuaaaugaccagcucauucuagaccaacuucaugcauuaaaauuuuaaauuggauucaagcaacaaauguuuaaaacaaaaagcuuuuacuauguaaaaacguguccucagaaaugguauaauuauucagauacauuuuaugucuuccuguuaaagagcugaaacuuuucaauuagagcgaacagaauauucauugauuguaguaguuuuuuuaauuuugauauuugcaauuugaacaaaauaguuuuaaauuuuuuacauuuaugaaugaucaguaguagcaaccggcuauuuuucaccuuuauuuuaaccuugacuaugaaucugagauugaaaaaccacuacaugcugauccuauaguguaguguugaaaugauuagacucuugaaauagauccccuuguugugauuuccuacuuaguauuuuuugcuaugugaccuucaucaaacuaguaaaccccuuuuucuuguuggggaacaauaauuguaccuaccuuauaggauuaaaugaauuaauauuuagagagugcuuacaacagugccuggaauuuuaguuauuauuguuucuaauaaagugcuuaggagauaucucauauuuccaguuaugauuaaucuaugcacauugauaauucugcagguuuaaaauuguauucauuacauuacaaaauggaauucguauagagauacgaguuuuuucaaaaguuaagauauguuuccuuaguuuucuuauuauauuuauucuugagacuauuuuuauacuaauuaugccaacuggaauuuuuauagcacuuuauaaagcuuuaaacuaauuuaucucauuuuaucuuuauggugucucuaaaugugcauuaucucauuaugcccuguaaauaagaugcaaugaauugcccagugucacacagcuguaauuggggaagguagaaguccaguccaaguauccuaauucagaaugucugugcuccuuuucugauuuacuaugcaggcuuuuaugggcaucccaaaucaaaacuaaaagagucuagauucaccaaugucuuuuuuccuuguccaucauaauaaaccagaaccaaagaucucuccugcucuggggcauuuugucuaagauuacuauuaacuauccuuccuuauucuuucauucguucuuucagccagaaguuauugaguuucugugggagauacugugcuuugaaaauucuugguauggauccaaccuauucucagugcauuuauauacauauaauuuuuccaguuauaauugcuauguuuaaaaaaagauuuguggcaaccucauagcuacaugaaauauagcaagguaauauaaauuagaaguuauugauaaaggaaaaaauacauacauaugcauacacauacaguaaaaauauaaaaugcacuccaaaaugagacuuaggaggcccuauguauauacccuacagcccuugauguauauuacauaugugggaaggcauaaagugauugaccuuaagucaaaguaugccucuaauaaucaugcugagagcaaauaauuuauacuauauauaaugcuaucuugaaaaacauuuaaaagaagguauuuaagauauaguaugucugucuuagcaauauuuaaacaaaguauggaaggugauugauacaugaugaugaugagaugguacuaacaauauucauuuggguuuuuacauagaguauuuguggagaauguaguauuaugaagguuuaaaauuuuuuucuauuuguuugucaauguuaauuaucugaguuuaccuaaaguuauauuuuaaguaaugucacugacuuacaguauuaaugguugaaaugugagucugaauuauuuuacuguauuaugagaaaugacagaauuuaguuucagcuguguauaguauucacugauaacuucuguauccuuugguuuagaaguauuucuuauucgaggaagugaaaccuacugagucauuuagaauagacggaguccucaguacuuccucuuaacauucacagaaugguggaaacuagaaaaugaguuauuuauuggucuuuauucuccauuaaugcauauuauuugaucuugcauuaaguauacauugacagaaacauuauuuuaauuauuguauugaagacauucuucauguguauuuaaucaaccaccugacagaaacuagggcagaguaaccaaaguaacauuugagacuuuaugguuagacgucuaauuugcaugugacaguaguccauuuauaaagugugauggaugaagucauauuagaguaaguaccauuagagacacauucauugugaucuguguuuuugcaaaucaaaauuaauggucauugcagcuguuuguugaucuguugaguaauguaaacucucaacaacaaagcugaagagaagauguauuuugugauaucuacucuuauaacaggcacucuuaacaacaucaguaauuuguauaacauuaaauguucaaguagcauagagaaaaaucuaaauucaguuuuagaugaacaguucuuuguuuuuucuugugcuauaaagacacaguuauugccuuucaccuccucccccuucaaaacucaauauuuucaguuaucucuugugaggaaauauaucacauaaacuggaagucauccuuaaccagagcaauauguaaguugacccuggagguucaaagagaaacuuacguagccuaauaguguggcuugcacauucuaugcacuguacuaaaaaauaauguaacuuucaugauuucgauuggguggaauaauuuuuaguuacgauuaggucuuuaaaagguucuugguuuuuaguuaugauacuaaaauauuuaccagugaauuuauaugauguguaggagguacuucaaaacgaucuaagagugaaaggaacaagagaacauauagaugaaacuggacuggggaugaauugauaauuguugaagucgggugauagguacauagaaauuuauaguuuucccucaaauuuuauguguaucugagauuuucuauaauaauuuuuuuaaauguaugagacuauguacgucucaaaguacugcuuuccauucuucauguguuaaagacagagggaccaucagaucuucagaucuugcuuucuuuuuuucuuuucuuuucuuuuuuuuuuuuuuuuuuuuggcacggggucuuacccuuacaccuaggcugagggcagucaugcugucguagcucacugcagccucaaacuccuggucucaagcgaagcccccagcucagccucacgaccagcugggacuucagguguguaucacaacaccuggcuaauuuuuuaaacauuuauuuuuuauagagacaaggucuugcuauguugcccaggcuggcacagcuugcuguuaaauaaaacuaucuuuuugaaauugucuuauguaaaucuguaaaaguauuccacuauaggcaccuaauauggaucucuuuugacuuuuauaacaaggggaguuuugccuaaaugauaauauauauugaauaugacuuuaaauuuaauacucuuuuuauaggagaaagauuuugcuuuucuuaaauauuuacuccuguguuagaaaauaucauugcaaggagguuaucaaaaauagaagaauuaaaucuugguuuuguuaucuguaaaaugauggagcaaauaauauuuaauguguuuugaagcccccuggacaugaacauguauggugguaaaccuugaaggauucuauauuuauaugucuguauuucuuuauaccaccuuaguucaacuguuuuaccauuccaaguuucuuuuccaaauuauguacaagcagaugaauaagaauauguugcaauugauuuuucuuaagcaagcucaguguuuuuuguuuuuugacacuuuguuuggcaaaggagguguucaauuuguugagcugacugagacuuagaaagaauaaacuaucacaggaucugccacaaaguagaugugagguaguuguucagugagaagagagugagagaguuauuccauccuugauccaaacaucacuguugggcagguagaucacuaauuuccuauuaaaccaaguggacaggacaguccugaauuaauuauggaacaguuucuuuaaagacgucagcucucugcaucccuugucuugccacugaaauggugcuauuucaucccauuucucccuuaaaguaauuuugugauuuuugccacuuuuaaauaacacauugcuaaagucaggguauaaugcaaaaccaaaaaucggguggagaauaucauauaccaucuuaucucuagaaagcaauguugucuguagggcaagaaaacagucuuuauuucccugcaaauugugaauuuuuaauguaguuaguuuugagaaaugaauguaggaaacuuugagcaaaacauccaauaaugaccaguaaauacauuuccagcccaaaaguauuugcacaaaucuuuuuguaucauauuguuuaaaagcaagauaagggcaaaacuuaguaucucacagagaacuuuauauuugagcugugugucaggaugacaggcuuucaggacagaugauggcuuuugaauauaaauguacacauuuuaauuuuuccuaauuguguauaaagauuuuaaaauacacaggcaguuaaaacaaauauuuagccacaguuagaugcacaaguauuguauuuuucucaccgauacuacugcuuuauuaugaauuuuuaccaaaauauacuuuuuuauggaauguuugguuaguacugcacucuuuucauaaggagagauacgauucaauuuccaguuuucuucaggacucuaaugccuugauacauuagaauaauaagugaacagucaggaaaauaaagagguuucuucucuugggaaaaucaaacuuucuuaaaacuuuauuuuuccuucggaaacugaagauacugaccauuuauuauacauuuuguuggcucccuguucuauacccacuaccacuucaagagaaaucuucccccaccuccuaccccaaaaagucuuuuugggggugugacuuuuauaguuguagaacauuauuagcauuucucgguacuguuuauuuugaacaaaaccaauccaugcauuuucuauuuguuuaggagucggauggucagggcugcccuuucugucguugugaaauaaaaggaacugagcccauaaucguggaccccuuugauccaagagaugaaggcuccagguguugcagcaucauugaccccuuuggcaugccgaugcuagacuuggacgacgaugaugaucgugaggaguccuugaugaugaaucgguuggcaaacguccgaaagguaaaacuagaaacauggguuuaguuaaggugaugugaccauaugaaaaggaaaugaugccgucauaaauggaguaugacucagcguauuugaguuuagaaaagaggcacacacacauacuagccuaggccuguacagggucaggaucaucaauaucacugucuucuaccuccacaucuugucccacuggaaggucuucaggggcaguaacacacguggagcugucaucuccuaugauaacaacgccuucuucuagaauaccuccugaagaaccuaucugagacuauguuacgguuaacuuuuuuucauaaguaggaguauacucuaaaauaaugauaaaaaguauaguauaguaaguacauaaaccaguaacauucauuuauuaucauuaucacauauuauguacuguacacaaguauaugugcuauacuuuuaugcaaccagcugcacaguagguuuguuuacaccagcaucacacaaacacgugaguaaugcuuugugcuaugacguuaagguggcuaugaugucacccaccaggcaauaggaauuuuucagcuucauuauaaucuuauaggaucaccaugauguaugugguccauuaccgaaaugucauugugcagggcacaacuacuauaauguugacaggcugauauaaucauaguuugagagagaacuagauucuccucaagguacucucauugguuuuaaacaucauaaugagagguaaugagaguguuuguauaaaauuaaacgucaucuaacacuggcaauagcaaaucugugaagaaaaaauuuaagaaaggaaauuauuaaauuuggaaauggugaaacugaauuugauuaaaaauauucuuuguucaaaucuagaagaagugucugauagaguuuuuucuuaaugggaaggcugucucacuguuuggcuucuaagaggucacauaagauuuacuuuugugaauuuaccagaaucugaguuugcucauuaauguuguugacucacaaaaauugaccuugucaguucacugagaauggauguuacugcccaguuuaaguuuauauaaccagguacacaacagacuagucaaugaaccagaaugccaacugauuaauuuacagaccagaaauacaguggucaagagagguagacucuuggauaucaggcuauucccuguacaggaagauacaugaaaucccaauuacuuucacaaauuuuuugcucucaaaaucagagaaaugggauugaguggugugaaaggucuucauauauggugccacccuuccuccugacuugggcagacauggcuaaucagucaugauacuuaccgccgcugaguucagacuuggccaacagagccuuucaacacagcccugaagaucuuccacuguaguucauuaggauuuggcagguagcaugaaaccuauuugccauugucacuagguggagugaugauaauguguaauggcaucagauuguauucaccguauucaucuaucucuguaggaaggaaaugcuugguaguggaauuuugacaaggcauuucuuuggguuacuucauuuuuagggcugugugcgaguuuuccucuugggaaacuccugcauuuucucccuuccaauguuccaugcugaccaaauacauucccuuaggauauuuuacauacaaauuuuuacauaggaagauauguuaacaucaccaacauggcuacucucaaauuuugcauuuuucuggaaugauuuuuauuauuuaucuuauugguuuuucauaaauguuauaauuuaacacucagagaaacuacacgauuucacucuuuaauccugaaagauacaguuuuuauuaauaguuugaauuaugugauuuuuuuugaccuaagaaauggaagaaaguaguuauuccucagaaauccugaaggaugaacaagaaaaaauaaucuuagauugaaacagacuugagacuugagucucaaaacaaaguuaacuuaaggaagacguggaauaaagcaccaguucugcuacagaguaguaauggcaugcuaggcaaguuauauaaccucuuucuuccucaguuuaccccuucguaaaacagaaaaauaauaguagcuucucuguuggguguugugaugaucaaacgggaucaaggaccuaagaaccuagaagaacgucaggucaccaaagucauaaaugcucacuauauuauuaccaauguuaauuaauaauacuauguaauacauauucuaggauauacuccauaaucugaguuaguagaaaucauuucaucacuaugcaugugagagagcuacauaugcggagcuggugauauugauguacuguuccccagaagacauaaguuugaauacuggcucuacaauguacaaauacaaacaaaucacaugacuagucugagccugauuuccucuucugaaaaaugagaagaauaauaccucccuaaauuguugaaagaaugacauauguuauuaaugcugguuuuauugauuugugacccuuuuuacugcaaguuaaaaaugauuuuacauuuuaagugguguauauuuaaauuccuauauaaguaccuacaaaauguccuugauuuuacaucuuguccuaaaauauucacuaccuggcccuuuaagaaaaaguuugcagccccaggucuaggacauaguaagcauuuaaagaaugguuauugaauggauggauaauggagaaugacagaaaaguauuugagauacaacagcucaaguaguugaagugcuccagguagcaguguuuuuuuuagcugugaagacauuucaauuuucuuuacuaaauggguuuucaucuucagugauccaugugagaggguaggucuaggcuuuaagagaaauuuuaaaaagaauuuuuguauaccuuacugcuugggagaaaacaguaucugcccuaugugaauuugggaaaaguugcagucucaaccugcuuuccauugaauuaaguugaagcuugagccucuuuucaguaguggcacuaacaaucgaaaggaaaugcugggaacauaacaugagaagcagaauguuccaaggugacucuaguguuucuccuugaucuuaucacccgcucccaagaccauucauauuucauucucucuggcacacuggugagcuuucugucaagggagcugagacauuuucaaauugauccuuucuguuuuuuaccccacaaagaguagaaugaugaucucaagcauuauuguccuagaagucacacuucaguagcuuauuuggcagucagcagugucauuuaauaaagcuuuacuucacuacaaucuuguuauacuuucuuaugggaguuagauaguuuagaaauuuauaucacuuguaauuauuuguuuuuaaguugaagagguauauuucaguuaaaugucuuuaugucuacuaaucugccucuagucaauuaaacugauugugacuuuuauagcauuucauaaauguguaccacuuaauuuucaauaaaaccuaaauuuuuauauagauacaagcauaauucuuucugaauaauuuggaagaauauugcuaugauguuauguucuuauaguauuuuauauguacuucuauaucaggaguuacacuaaauuguuauuuaaaggacugucuuuaaggccagggacaaugccuuguauuuguguucccaggcaccuaaaugcacucaauaaauauuuacuaagugaacuaauaaaugcacacuccugcacacauguuccuuuagggcaaugaccuaaucuuaugcauauuuuaaacuuuguuccaaccugaauacuaaauauauauauacacagagcaucaaacugauagauuuuauccaguuuuuucuuauaggagugguuauaaacaaaugucacauggucauuuugacacaguaguucuucuaccugaauguucuuccucuguuuuuuaaaucauucuuuugucauucauucaugcauuuucauucauucacucauucauuuauucauuuauuuuuuaauuaacugaugaauuaauuuagagcuggagucucgcuuuguugcccaggcuggacugcaguggcacuaucuugguucacugcaaccucugccucccugguucaagugauuuuucugucucagccucccgaguagcugggauugcagacgccugccaccacgccuggcuaauuuuuguauuuuuaguagagacaggguuuuaccacauuggucagccuagucucgaacuccugaccucaagugauccagccgccucagccucccaaagugcugggauuacaggcaugagccaccgugccuggugccuggacuuacucauuuauuuuuaaaacauuuuauucucucaguuaaaagagugacugccagugauuguccaacagaaugguuccauuguuucuaucugccauuuugaauacucaucuuuuucuucuuuuaugagcgggccaaugauaauauugugaaauuguuucuuccugucuucagcauauuacauucuuuaaaugaguaaugcugccaucguagcauggaaaccugcuuugauuguauauuccuguuaccauggugauaucccacagcuggaguucauaaauaguagcauacuaaacauauaguguauuucuauuauuucuuuuauaguuaaauguguuuaauaaugcuaauccuuacagaagcaauagaaccuaaaagucuauaauacauacuuuuugauucccucucugauagaaaguauuuugugauacuaacuagaauauguuuuagauuuugcccaagucuguaucguugccugaguuuucaagcugucagaauccugggauaauuagaucugaugugagcccucagacaaaguccaggaugugacugguaagaucacagccuucucucugacuucauucagaucagagcuaaaaaacaguaucuguugcuacccagugauuugcuucauuuugccagaggauuaagaggaaucuuaacaguuuuucacaguauuagucaccaaauacauaacauuuacauuugaaauaaauaaaaauuugcauauaaaaauaaaauguugacagacugaacuagugaaugagcccagauuaguucuuauugucuuaaacauuguauuuucuuaaaauaauauuuaaaaucuuaauggccacauuagaacaaaaauggguaugaacaaaagucaaggaaguuauucuuuuuuaugcauucuccuuuguugccuucuucaauuaaaauacaucuugcuaauuagaaauguaacaugucaucuaaguauugcauuuccuaauaagugugaagaacgucucuauagcagggguccccaaaccccaggccauggaccaguaccagucugugaucuguuaggaaucggcugugcagcaggaggugagcaacaggcuagugagcgaagcuucaucuguauuuacagccacuccccacagcucgcauuaccgccugagcucugccuccucucacaucagcaguggcaucagauucucaaaggaguaugaacucuauuuugaacugcacaugggaggguucuagguugugcgcuuauuaggagaaucuaaugccugaugaucugucacugucucccaucaccccuagaugggacugucuaguugaaggaaaauaagcucagggcucccacugauucuaaauuauggugagguuuauaauuauuucauuauauauuauaguguaauaauaauagaaauaaugugcauaauaaauguaacacauuugaaucaucccaaaaccauccccuuccccucccugccaccguucguggaaaaaaugucuucuacgaaaccagucccuggugccaaaaagguuggggacugcugcugcauaguauuccugauccuaaggaaaggggugugugugcauaucacaguguuuugcagcuauuuuuaggaggauguugccuuuuuacguugucuauuuaaaucugaaucacaggauuagaguccguguuggagccguaagaucaaaaauuacaacagaagugaaauacaaaaauaaaaauagacauucgaaaugcagaacaugguucucaacuauaggcaauuuuaccucuugaggguauucaguaauauauggggacacuuuuguuuuuugcaaugacuaaaggauggcaaauacugcuggcauugagugggaagggccagagauacuaaauauccugcaagcccaugggugguccuacccaaaagaauuauucugaccauaguacuaauagucuaguccucaccacugccuucccacaacauuuagguagagccgugagugacaguaagcaauccgaaggcacagguuuguuguucaucguuuacuugcacucuguuuacugaucuucuaaaagcucuucgugcaaaauagugguauuuucuuuauuagcaugugauuagcaaaagaaacaacugcaucauccaagugcugugugaugucguaggauaccuugaagacauuguuacuuauuucucaaaaauaacuugaauacauaguauauuagaagaagcaacacuugaacucuaaaaguuuugaguccacugccucagguagauugucagcuccuugaggacacaggcuaugcuuuauucuucuuuccauucuuagagguuugcauggugcuugauacacaguaggcccuugagaaggauuuuuuuuuuuuuaaugaucaguggugacacuguucuuaauuguuauauucuuaaguagagcugcccucuuggagugaaacugccugggcucaucuucuaguuuuccuacuuaguaucuaugugccuuguuuuauuuaacacccccucccacuccccuucccccaaguacuugguccauaaaacucugccucuuuaagauuaaaugaguucauauauauaaaaagccauuagaacagugcuggcacauggaaaaugcuaaguauugguuguuauuaauauuauuuuuaaaguaaauuaacaaagauggggucucacucuaaugcccagcauagucuugaaauccuggccucaaguuauccuuccacuucggccucccaaagugccaggauuacaggugugagccaucacaccuggccacauuuuuuauacuaguguuauuuaagacuccugaaauauugcuguacuucuaagaauuaaguuauuaguauuuuugaguugucuauggaagguuuucuuuuagauguugauagcauuccauuaggaagaauuagaugccaaaauuuuauugguuaccaagcaauugguuguauuucuuuaacauauuaacaucuauauaguuauaauuucauugcaugaccacauuaaaauaauuuacuguuaaaccaugcuucaaguuugaaacucagaaaaugcaaacuugucaacaugucagcugaaacacuauuuugaggauuaaauaauuuagauaagguuacaauguucuuauuuucuguauaacuaaguugaaaugauuaaguauuaucuaaaguagggugaagaacuacaguaaccaaauagcaauugcuuguuccaaccagcuuuagcuggcauuuggagagcaauaaggguuuucacaugaaagcauuuuuucagugaccaaaauuuauuccuuuaauucucagaauguucuuguuucuuggccauuuuuauggaaauauuucugaauuauaugucacccuucccugccuucucaaaauugguuaugcagcugagcgaaccaaagggcauaagaagccacuguagucaacaugacacauuucuaaaagcuuacauuuugcuacaagauuugaggguagcuugcauaaagagaagagaaccauaaauuuaaauuaaaaucacacauauauuuggaucaggauauaaaauuuguguaaauguuuaaaguaaaauacaaaacuuuaaagaaauuucaagguuauggaggcugaucauaggccaggagaucaagucccucucauaagaagguacuucaaggagaagcaguaucaucacuuguguuaacaguguuuaauauuucaguagagcagugcccuuaagguuauccccaagugugagacugcacuacuuuaaaggagaccugucggcaacuuuauugaccacuucucugccagaccucaaagagaaaucagcucuuauuccauuugguguuucuuaauauauagguuucuguuuuccuccgcuucuuuauugcuucuaauuugaaaauuuccagaaguuacuaguggaacauagacaguaauucagccuuugaauuagugaacuucauuuuacacagaaaucaaauguccauauucuuaggaagguagcagggugccuacauucuguuucuguauuaagaaguagaaaaaaaaauguuccuccuacuucagaggacuuuccuguuucauucuggguuucuccccaaauuauuguagguugagacuucuggaaguaugaccauggguaaccaggaaaugauuguauugcucuaacacaauauucuucauauaagcuuuuguuuauuaucuguggagguacucuaaaauagauaacacaagucauuuacuuaagcuauaaugccauaugaauaugugaguauguguguaagcauuuuuguagcauauacccucucugaauaauauucuguauaggcuacuauuuuaaauacucuugauuuuuguuuuguucacaaaauaaagugaaaaaacugagaauaguagcaaguaaaauaugcuuagacuauuuuaucaugugauaaaaguuuuaucaaugucuucauuaauuuucacgcauuuauagaaaaacauugacucucugaguccuucucaucauccuuauuauaguaacuguauauaccuuuuucagauauggaaauucauuaaguaaaaaucuuguuaaaaguauuauaaaauugacuuugauuaucucugggacugucagaacucucaucuuauuaguaauuggagagguuuucucuuguccuguuuuuauaauaagccugacugugcuugaaguuucuuaccaaauguuuugccauuuccauaauaauggaucuuauuaacguuuuuauaaaauggcucuuuaaagguguggauaaaaugaagagugacuaaaauagaaugaguucccaauuauuauugguaauugcugaacauagugagaugggcuuuugacuacuuuacuucuuaggguuuuucugucaggauuuucuguuaagauugaacauguggauuucucuguuccucgugguaguuauaaaggauucugugcauuuugucagaaaaauaaauaauaguauuuauuaauuuccaaagcaaaaggaugaguauguagacguaaaagaauccaauguggucuuuaaauuucuagaacaccaggauucuaguuuguaaaagauguucucaucuguuacuaggauugaagaacuuaagagaaauuguuaguuagacaaauauacuggugugaugauaauacaggaaggaaucaaggcuggcucagccuuuggauuuggaaagaagcugaaacagauaauuuaucauaaaguuuuagaaacaaguguaauacuagaaaaaugugagaaucaccuaaaaucaagauaaaggaaugaagugauacugaucaguaucuuuuaacuugaaaggauguuugugucuuucccaacuuuugcaguuaccucuacauaaggauuuuggauauugugaauaaguucuauacaguuaauucuguguucacauucuacuuucuaugcuuuaugacuuaauuuuuccauacuuauauuuguuugucuuaagauuagagagaugaacaugaaggagugacaaagaaaggaacucauuuaagcagugcucaaaaggacaugauacuuuagucauucauuaacacaugaaaaccagaagagcacaggcgaaaucucuaccaugaaaaagucagaaaaauuuaacugcagaaaaaauagugacagcaauuauaacagauagaaagagguugacuauccuaauauauaaagagcacuuucaaaucaacaaagaggaaauuaguggauauggggaccaaaaaaauguaaaaagcuagugacccaaagaagaaguacacauguccaacaaagauugcauuucuuucaaauuauuugucaaggaaggaagggcaaauuuaaacauugguauggcccauuaaaaugacaaucaagcaucaaagcaaacaaaauauucuuugcauuugaguuuuguguaaugguaauuaucacacauggcuggugagagaauaaauugguuuuaccaucuggacagcaaaagagccuuaaaaauauucauaaauucgacacgguuacaugucuaguaucuugugcucaaaaaaauuguaugauucuuuccuuaaaaacuagcacauauaugguuaaagauuucuuuaugauacuacuuuauaauaaagaaaacuugaaaacagcauaaguguucauugcacaggaaugguuuuguaaauccauauaugcauacuuuaaaauuauauucaugaagaauguuuaccgcuaauuuuuuuuuguauaaugcuaauaaacauugaguagacuuaacauuguguaugugauuaggaaccaucaccaauggcuauauguagguguucuuuaaaauaucuuuauauuucccuauaauuccaaaauuuccuagagugaaauuauguucuuuauaaugaagagagaaaaagugaaauaaacagaaaauugaaaagauacaaggacagaacugccaaaaccaguaaaacguauuuuuuaugggaaacaguuugacaacaugcauaccccuaaauuuauaagccuaauccaauucuuaaacuacuuuucuuguuaucauuuguuguuuuuguguuuaagacccuuucuagguuaaaaagaaagccuaaucauguuaaauuaaauuuuaaguuugcuuuuuuaaaggucagugcuaauaauagcaaauaauccaagaggcauuucuauuugacuuuugaaugcauuuuuacuuaauuuaauuauuugguuagauauuugauuuuguuacuauugcauuaagagcugauagugggaggaauugucugggacaaaauaagaaauaacaagggugggcauuuuguuuaacaguaacuuuaaugggauuaccuuuuggcaguguagaugggcaagcuuugacuagaaauuuggagauaauauaauagauuacauucugucccuuuuacaucaaaauaauccauuuuccuaacaauuucaucuaaauaaaaauuaaauauuuuacaucagcauuuauuuuacauaauguuuauaaauguuuuacaucagcauuuauuuuauaaugcauuauuuaauuuuauuaacccauaauguucugucaaaugcauuaauuuuauucuuuaaucuacagauaacaccaccaauagguggugacauuuucaagacugcauggccucuuuauauuauaacugaaauuuaaauauaagcaauuugaauauaggaaauuuaaauauaggagaucugugguuugaaaucagguuauacauuuauuuauaugauuacucaaaugcaaaaaaaaauuguucuuuauaaccaguuggcauuagagcuuagauagucauacuugaaauuuacauuuucuaaucaagaguauccguaugaacaaaauacuaacuguuguuauucagaauuuaaaugaauccuuugcuacuuuucuacccaagauguuuuauacuuauguauuuggucugcauuuuuauacacaauggaaguaguagugauuaagaggaacaguggacaaaucaguaagugauaauuagcacaguucacagucuuagaauuuaaaccugagccaggggauuggcucuauguuuguuuguuauuauuguuuuaccccaacagcucccuuuaucaccuaucacauguagaaaaagauaaauggccugggugauuugagcuggggauuagaacuguggaagaaagcccagaaaaggguggaggaaauggcugauaaggagucaauuuaggggauaauaugaacuggugggcuaaagaugaauucccacauucaggucccagcuauagaggcauuugaauuaccuggugauuaccuguacaggggaaaagucuguuacucuagaauuuagucuuuuaaaaugcaaaaauaaaaauaaaaaaugcagcuauuacaaaaagacagcauugucuuuuaaaggagaaauaauuuuggucuacauugaauugauguacuuuguuuuuuuuuauuuucagaaggauaaaaaagagcagacuuuuuauucuuuaaagugagcugauaaauuuugauguccugaauuuuuaauaucucauccaauaaauuaauuauggacuggauugugcaacauugugcuagauuuccuuuuuuuccguagacuuucaaauaggaaggaaaaaacacaauuugugaugacucaaauaaauuaaaagugaccuucuauaugaacauuaccuacuaaaaauguuuacaaaucuucauaguguuugaauuuuaccagcaaugaaaguuaaggcaaagcuucaguacacuaacugcauaauuguuuuuaaaaauaguaaaagguucagcaaagaauaaugcauuacuaucaaaagagcauuguuaaauuaucuacucuuagguaggaauuuuacucuaauuuaggagaacucaggaaaaugagguuuggugaguuuaguacauauaaucaauaaagaugaaagauauuuuuuuucuucacauacucuccauaaaauccuucuaacuaagccaacuuacagauacuguguagcuucuaaaugaauuaauucuucaaaaggacaguacauaaucaccuucagaacacaguaugaauugcgcuaagcaagauaugcuuccaauuacauucacaaagcuucagagagccugcucgucuggaaguaucuaaaaguucaagguuauuacuuugccacacacauugguuuggaugucuguucugaggauuuucauuauacucuuucaguauccaacaggcucuucaacacaucugaaaucaaauuuaccccauuuaaacaugcuagaaauuuacuaacugcuuaaauauuaguaauuaauccaaucuagggugaaagucaaguccuaauacugauaaugggcuguuagcucuaucacaauucugugucuuguuucaguuaaugagagaaguaggaaaauauuugcagaaaaaaagugcuuggaggagcacaggucucauucagcagucuuugcaguguguacaucuagcccugaaaaguguuuuugcaaguaacuaaagaacugugcauucuuucuauauauaaaaaaauauauuguuugggcuagaaacaguauugauagcuuugcuucuugauucuucuuuguaaaggagaguagccauaucaacaaagcauuuuuuucagguaauagcuuuucuaguucucagagaauauaauuuauccuaauaggaaugguggagaauuagauguccugugacaauugcugaucuacagugucaagaugcugugaugcaaauagcuuuacaugaggaauuuuuucugaucuaugaugauuuugggauuaguuuugcuccagaagguucaaauuuauggaacaugugaggcccugugacuuucuggguagaacuauucuuuuguuaagaaucacuggcuguacucaagucaguuugugacuauagagauucuuuauuuucuccuucagugacaauugaauuuuuuugacuuaccauaaccgagcuaaaagaaaugaaaaagaaucauuaauuuuuaaaaaagaaauguuucuaaaaauuguaauguaaaauuauguugaauuuuguugaaugauuuuguuauucggcaccaacagagacaaagacuuugcaguuuaguaaugucaugacaauauucaggcauaucggagguauagucuucuguuuagcuacucagauuuauuuauuuuauuauuuuuuuagagacagggucuugcucuguugcccaggcuggagugcagugguacgauuauagcuuacuguagagucaaacuccugggcucaaggaauccuccuaccuuagccucuugagucgugggacuggaggcguguaucaccacaccauucuaauuuaaaaaaaauaaaaaauuaguaaagaggaggucuugccauguugcccaggcuagucucaaacuccuggcuucaagcaguccuccugccuuggccucccaaagugcuggcauuacaggcaucagccaccagggcuggccucagauuuauuuuuaaaaagucuuuacaaaggacgcauaaauuuccaacuauauaaaugugggcugugcagugacuuccuugcaaagaguauacuaugggaaggaggagaaaaaaagaaacuuaacagugaagaagucugauaaacaauaccacggucagguaauuaaggucagcaacagcagugaugaaucauguugauagcauggauccuugauaugauguggucaaaaugacacuuuacuuccgugguccuacuccucaaaacuuuuaaccccaggcuaauuauuuuuaaaaauuagacaaaucccaauaaagaaacauucuguauaaucucuaaccaguacuuuacaaaacugucaaagucaucagacacaauggaugucugagaaacugucagagccaaaaggagaguagggagacguaauaauaaaaacuaauacaguauccugcaugaaauccuggagaagaaaaaggacauuggguauaaacuaaggaaaucugaauaaacuauggauuuuaguuaauuaacaaaagccuuauacaauguaacuaagugugaaugugaacgcaaauccauuaucucaguuaaagacagacuaaaugauaaagcugcugaguucauauuaaauugucaaaugaugacaucagcaauucguacaaagguaaguaauguuaggaggaaaauggcuuacaaauaaguuuaaaacuauaaauacuagcauucagaaacagaacaauaucaaagcaugauagauaguguuguaaacauuaagucuaaaucuucaaagagcuaguaacuuagacuuggaaacugcccaguauuuuagaacagaauauuguuuauccuguuaaggcuacuugauuaacuguauggcuuuuauaacaaauagaaauuagguuaugcugcauuaaaacacauagacacacacacacaaacacacaacauuaugcaauaggaaguguuacguacaaauugaaauacuuacuggcuuuucgaugcuacuuuaucuaccagacaauauggaaaacuuguaguaacagaaacuuaguuuuugccagaaguacagacagacuuuccuagauauaguucauuguguuucaagaaaaauguuuaacuugagaaucuuuuccauguguaguauuaaggaaaaaaaaauaggcuuaaaucaguuuguuuuaaacacacaauuauuuuuuuaaaaccccaccugauuuaauugguuugcaggaaaauagacuacauacaagauacauguuuggaacaaagcaauagcuaaguauuagaauguacaaagcucgagcaaaaaaauuuauaauauagagauccaagagcaaugugcauuauugcauuauguguuucuggauuccucauaaaauauagaugguuuucuugaagaauaucugcauuugauugucuuuauacuauacuuuugcuguucuuuuuucuuagccccuuucugcaauauguaggaaaaacuuaucagucuuuucuuuucguaauacuacccuugagggacaguaugaacuauuugcuucuauuaaucaggguaaacuaagggaauucauuuuaacaaauguauggugccagaaaccuucuuccaaccaaauauauucuuuaagaacagagaacacucugcacagcuaauaaacagcggcaucuuucucuuuuucuguucuagugcacugacaggcagaacucaccagucacaucaccaggauccucuccccuugcccagagaagaaagccacagccugacccacuccagaucccacaucuaagccugccacccgugccuccucgccuggaucuaauucagaaaggcauaguuagaucucccuguggcagcccaacggguucaccaaagguagaucaauuuuauuagaaacacagaugaaaauuuuguaagacaauuauugauugcucagauucuuuuaaauuccauuacucauauuuuuuugcuuuuaauugugaauaaguuugaugaguuucucguuuaguuuauggugagcccacauucauauuucuuguuuuauuacuaugagaguuacacauaauuuuugcagagagcauaugucuguagccccaugauuugccagaauaagaagcagaguaaguauaguuauuuuguaaaauagauuuaaaaggucauuauaugcauuaaaauaauuugcaugcuguuaucaaaugauauuuuacgcucauuuuuauagugccaugacaagaaaaaugugaugggaguauauuugcaaagggcuuaagguaugacaaauuaucacccuuguuucaaggcgacucagaagagggaauuauauguaguuuuuaaaccuggagaaauuaauuacaaugaauugcaauauuugcagaguaauuauauuacuguuuaauauuaaagacauaauuuuuacucuacaguuaaaccuacaguuuauuuuacuguguggauuuuuuccucgaauuugauaaguauaagauuuuaaaaauuaauuuuauuugguaacaugcucuguugucuaaaauuuguuggaagcacaauauauuuaguaguguuugauuuuccuguauuaccaguuaaccugguuuuaagaucacacauuauuagaauaucauuuagaauuauguaaacacaacagauuccuuuuuucucugcuauuuucuaacauuaaaauuacaaaucaaucaucagauuaaccauguaaauaaaagucaaaagcuacgaaaagcauacucauucaauucauugaucuauaccuuuauauuucuauguaagaaucagccugaucuuuuaaaauacuguaagaauucauaaaauugaaguaauuccauauguagugcugcucuguuacuugugaucuuuuacuauucugguaauaaccgauaaagaagcagagcacauuugcccccauaucaguuuugcuguaucacagugaugaaaacaaaaauaaagaaaaagcuuuuaaucuucuaaaaauauuacaaauauuacaaaucaaguuacucuuuaaaaaaacugaaaccaugacaacuuuucuccucucuccuaaaucauagagaugugcaaauaaauuauugacauauucuuuuaaugucaaagucauuguaugauuuugaucuucuacuuguuucuguaucauuucuauaacuuaacauuuggauuuauguacucauuucuacuuuuuccuaaugaaauguauuuaugaguuuuuuauucucauuuaaauuucauuaacuaguaauaaaagcaacuuauuaaaagauggcacaggaaucuaguaaaacuccuuguuuggcuuagaaaauuaaagcaauaauacacuaguuuggaaguucugucagugcaugguacaaccuuuaguuuuuuuuuuuuuuuuuuuuuuucucuucuguuucuuuagucuucuccuugcauggugagaaaacaagauaaaccacucccagcaccaccuccucccuuaagagauccuccuccaccgccaccugaaagaccuccaccaaucccaccagacaauagacugaguagacacauccaucauguggaaagcgugccuuccagagacccgccaaugccucuugaagcauggugcccucgggauguguuugggacuaaucagcuugugggaugucgacuccuaggggagggcucuccaaaaccuggaaucacagcgaguucaaaugucaauggaaggcacaguagagugggcucugacccagugcuuaugcggaaacacagacgccaugauuugccuuuagaaggagcuaagguaagaaauacgcaaagcagaagcuagagaaucugcuuauaaaugcuucugauggucaguagcauaaaagguugggaaguguuuuuuuuugccuagcauggcacuucccuguaagucuuuaauuauccccaaguuauaaauaaucagaagcucauuaaaacuugaacuuaagagaagucaggagguucuaaguaaugauuuaauuuuaaugugaagacacuagacaauuugccagagauuuauuucaccuucccguauuucauuugccaaaaauuucuucuauuaacaacuuaguggugguauaaucagccugcauuuuuuuuuuuuuuugagacgaagccucgcucuugccccccaggcuggagugcaguggcgugaucucggcucacugcaaccucugccucccagguucaagcgauucuccugccucagccuccugaguagcugggauugcaggcaccugccaccacgccuagcuaauuuuuguauuuuuaguagagaugggguuucaccauguuggccaggcuggucuugaacucuugagcucaggggauccacccgccucagccucccaaagugcugggauuacaggcaugagccacugugcccagccagcacgguauuuuuaacaaacuccuuuaguuccauccaauuuuuacaaguuguguuacuauacaugucauaaaucaguuguuggaguuaguuauuguugccugggacagugcacauuaggcagccagguaaaaugaaccuccuauauacuuaaaaacacuaaaccaaguuuacucuuaaaaaucaaguucuuuucccaaguucuuuuccccuaaaauugagagauucucacccuuguugacuucucacuugaaggauguuacuacuaucauuuauauguccaggaaggaguuuaugugugcaggaaacugaagagacagcagcagaaaucauuuacuuuagaauucuugguaguuccuuggcagagguauacuguaauaauuucugguauuugguuccagggugcuuuugacucugagauuagauccuugccaucuucccucugcugauggaggccuuggcucuucugaagacuauaauauuaaagugaucucaucucuguagaccuuaaauugauauuuuacagaaguagucuaguccuucaauauaaugguuaaaguuggugaguucaucuuauauucaggauauaaggaagaagcgugacuugcacucagcuccucuguguguggagguacagugauaaugaacacuuuguaugacaguauuuaaccucagugauaugggguagccaggaaaggaagagucacaacucaguagcacagcauucaaaaccaaaggcaaggagugguggcaguuugcuuugacucuuugcuggugacucaccuugguaccuucagucucaucuauuauaaauaugaggaucucuaaagguuuccucagguucaccuaaauauaauguaaauguaagagaacauacuaauaaaaccaauuuuauaauaaucucuguuaguggggagcuccuccucaaaagaguuuuuccacaaccuagaaugcugauuggaaggaccugccauucauuuucaaaaauuuucagguuuuuuuuuuucccccuuuagcuuuacuuuuuauucauaugugaucacacuugucuugggaagaguguuagaagaagcuguaauuaacuaguuauaucucagcagcauguuauaauuuauuuucuaaacggacuucaaaaauacuugaaauauaauaguuguuauagccauuucauugaagauaucuugucucgggguucuuuuagauaacauguuauaguuuuaaugcuauuauaaauuugcccuccuaagcucuagaaaacuggcuguuaauuuuuuuaugagauguuaccccaauuucuuagguuauugguaugagauacuguuuuuauuuuauuaacuauagguaugaaauauugugaguucaguuauaaaaacauuccuuuaaauauuucugugugaacuuucauguugugaucauugaaacagauuaguauaauagagaacacugagugaaaauuuuaucucuuauugaaagcugaacuuuaauauugcuuaguucucucuaaauaauucucauuaagauuuccuaaguucuaaucucauauauuguggguauuuauauugcaaugcuaauauccuccaguuaauuucauguuacucuuagauuugguguuucaaccaaaauuagacuucugagauuucuaauuucaaccuaauuguuuaacuucuggagugagcuguaaaaaagaauuuauauauaguugauucauugaaugccacaaaacuauaaaacagaccaugucuccucuuuuauuacuguuauaaaggaaaaaugauucacuucauuagaucauagggcauaccagaacuuagauaaauuagaaaaggccuaauuccucuucucauuucauuguugggagacuuaagagguuggcuucaacuaacaacugacauaaucacuuaggauccuguaauucucaguuucugugauccuggguuggaguuuguuaccaggcuccaaaaucaggccuggauuucacuuuuugcucuagaauauacuggcuuuguccccaaccuuacuuauuuuccuuauaaauaaaguggaacuuuauuuuauuccuuuauauaaaauggaauaauaauaauaccugguaucuaggauaauaguuagcuuccagcuaucuaaauuucuaaaccccuugguucaggaauaaaaccaaaaauaacagcuguacauagagugucaaaauaaguuguaacacuuggcauuuuuauucaaaauaguugucuguuuuuuaaaccgaaacaucuucucuuuguuucacuccuuuuuucuuuuauuuaacguaguuccuaaugaaugcuugguaagcacucaauaaccaaguuaauaacuugguuaagcauucaauaaccaaguuaauaacucggugcuuauaauauaauacuuacuuggugcuaguaaucuaacacuaaagccagugguggagacaaacaguauaugugcuuggguuugagugugggcagguguaggccaggagagaaaagguggagggagaggauggcugugauaugcaaggaguuacaaagggacagguuuuuauguaucuugcauaguuuucuuauuuaaaauaggauuuuuguuccucugcagaagaguagucauuuuaaacauguagaucauauacaacaagaaaaggagagcgggugaagagaaaggggagauauuuugauuuuuuaaaaagacuaagauuuuuaaugaaaauaguagauguuaacguauuuucacccuucauaccuaauagugccauuuuguuuugucuuacuuuaucauuggauuaaagagugggagauuuagguauuuggaggcuguuuuauucacauaauuuaucaggccccuaauauaagcaaaugcgcuuuuuuuuuuuuuuuuuuuuuggucaaaugguaaaaacugccgcuuagguuuaguaguuuucauaagcggcaaagcuucaaaucuaguagcaucuucccauuuuagagauaagaaaauguagauaaguacuaaaaauuuaagugaaaacuaauuauacauguggaacacaagggaauuuauaaaagucaauacccugucaaugggcgaggacucgcuucccuucauuacucguccugucauuaugucaguucccaucauccagaagaaccauuugccuuuucuguuugcauugucacuagaacaaugaaugauaggggaaauggaaauaaauuaagcucuaauuacuccauuugguaauuguagagagcucugaggaaaaaauuauucuagcucauaguuaaagugaagucuaagaaguuuuugugauauucauuuacucccuuuacucuuccccuccuaccuagcauaaucaaaagcuagccaagguaauacuuuacuuuaaauguggaucuacaagcuaagaguuauuguuuauuuaucugauuuugaugguaagagauuucuauccuauagcauuguuuccauucucugaaagucucagauuuuagucaccuuauaaagcuguuccuuaauaaacaucuuguuggcuagauauuuauuguuguuggugguuuguuuuaauuaucugagcaaaauaauucaccaaaauauauuaaaauaugacuaaaaacuugcaauguaucuacuuauuucuagauauuaacauuauacccaacugucauuauuuguucucuugaggcaguaagaauacugcuguuucuuauaugauaaaacuaucuuuaacuggucauguaacuuacggugacauuguccuaaagaugaccuuugcaugauaaucuuuugaagaugcugcaagauaaauauaucaaaugauuucccuuuuugcaguuguggcuuguuguacuuuugguggagaggcacauguuuacauucaugaccuuaaaguuaucuauaaauuucaagggcugucuuucagaaaaucaguccugugugugugcugguuucauguacagucugacguugaaggacaaauuauagggauacuuuugagguagcauguguagggguuuacauguguaggauaagguaaaggcuuguguuuuguaagauuuuuaaaagauguuuuucuuaauugugcuaagauuuucacaaaauuguuuucucuguaucucaagggucccauauguuuuaaucuucaguuuuuaaacaauaucugaaucacaagaaaacauuuuacacuuuaggauuagaugauaccuugaggcauuuagagaaauauuacucuaagauaaccuagauuucuaauaaauuauacaagccaguuuauacuucuuucacaagucuacacuuccacuauuuucuuaguucuucaaccucauuaccuaauucagcuauaugaguaccuaggauguucaagacacucuggggaauacaaagaggaauaaagcacagaaaagcuagucaggaugagacaggcaugugauuaagagguaaggcauaugagaagcauccagaaaaugugugggauccccaagaagaaaaaaaauuccaagaugcaggacugaaaaaggaauaaagaaagcuucaugcaagagggucacuggcuauaaacauuaaaagauuggcagcuguuguuuuuguagguaugacagaaagaaauagcauggaggugggagaauauguauaguaauaauguagucaguuuuggauagccuauagcauaaaaagaguaggcaggugagguaagaccauggcaaggaaaguuaaaaccaauuaugaagugucuugaauucuacauuaaguaaucauaauuugguaggcaggaaagaauauuuaaaguuuucuuuucuggcagaggaaugcuagaaacagaauugggaauuuagaagauuuaaauugguagcauuuccaaugcaauugugauagauuucagacagugagcuaagaaugcagaggacaaaaaaauguuucuuaguugaggauucagugagguuucagugugaacugcuucaguugauacuaucagucugugcauuugaggaacuauaguucuuuuuuaccauuugcaaacagguuuuucagauaucuggaaaauauauaaaguauuuauuuuuagcccccaaaguugugauuuauuguacucacucagguaguggcagcuaaaaugauuuuuggguguaaagaaaugguugcaggugagaacaugaaauucagaaugacauaauguuaaaucuuguccucuagccaccgucaauaaauaugaacagccauuuuagaugaacggaaacaugaucaucauuuuauaaaguaccugcgcauuuagguccuuugcuaucucaaucuacuaauuaggaaagaacuauacaguucuauuccaaguuuuguauuaggcguauugucaacucucaguacauauuuaugaacaguuuauaggaauaacagccauuaagcaaauuauauauauguguguguguguguauguguauauauguauguauguauauauauguauguguauauauauaacauauauauacucacacauauuugcugagaguauuucaguaauaaugaauuucuuucagcuaaaccuaaggaaagugauuucacuaguuaauacuuccauuaauaagugcaucugagccaaucagcagucaauauuaauuuaagccuuacuguguguaaagcacuguaaggcauaugcuauaaaaugguaaaggaguaauagaauuuuuguccugaaagaggcccaguguggccuaaauucuccuugacaaaacguaaguacacagaacaugagcaaaauauuaucagaugccaaacaucaaaugaaugguucagaaaagacacuacagcauuucaguggccauagaaauccuuuaguuacuauacaucaguaacaaaugguauuucugaaacaguuagaaaaagugacauuugcauuuuaaagcagauuaauggauuguuucaaaaaauuaggaauaagucacuuaauuuucuuagguauugcccuccaagaguaaguuaccucauuaauuguacuuuguggcuuuacuagugauagacaucauugccuguaugacuugucuucaugaaauuuaauaguaguacauaaaaauaugcaaacucuguuauuaguauuuuauucucauuuaccuaaugugcaagaugaaagcaauuucaauaccaguaaauguuugaguguauugguauuuuuuaaagauacguucauaauguucugauuauaaaaucauaguugguuuauuguuaaauuagagccaauacagcugaaacuauuauucccauaucugucuuuuauuuuauuguugcugaaauuuuauuaagcaucuaucuauguuggaugcuuuguccuaaaauaacaaacuauugcauauaaaauccacauuacauuuucccaaaugaguuuuauauguauuuguaauaugaauuaaggaaauuugauugcagauaucuuacauugugucuauuccugcagcaugcaaagaauuccaaugaagaaugacuuccaaugcucaauaucacaaugagcguuugugguuugauauguguguuugucuguuaaaaggccuuuuuuuauguuaaaggauuuuauuaaacuucaaaaugauuaauaucuauuaggaaauuucuucuuucuggcacacuucagaacacuuugccuuguucuguuauuuggccacagucaaaagcccagauaaaaucauuguauuuaaagguaauauuuugucaugguauggcuacaguauauugagucuaaugaagggaaacaugaaaaaagagaaauugguacuaaagcauaagaccagucucuagugaaacuuuaaagcuauaaaauuugauuuuguagcuuugaaauacgaacguugauacauuucaaauauguucuuuaaacuuguuucuuauuuuaaguugauagguaaggguauggucuuuuaaauuuuguauucuaaagcuuccacaucauuuuagaaauaugaugggggaaaguaauugguaaguccuugacugaauuaucuagcacugcucaaauuacuuuacauguauuuagccccaccaucagucuaccuauuaaauaugaauuaauaagaguuugcaaaauaacuccaugauaaaaaucuaaugauugcuuauaggucuuaaaauguguucaauuuuuucuugugaauauguuucugcaaaauuauccucucauaaccgccccccuuuaaguugcuguaauuucaaauuguaggagaaacgaacaguuuuucagacauuuccuguaguguaacagaaaucuagacaucagaaucuccuaauucagaguaauugaacacuggcuuuggauggucccauaugagcaaguuagaaauugugguuuguguguucacaaacugaaaauuuuguuuaaauuugccugcacuuggaaagccagaacaggucucuaguuaucauuagcacagaagcuucaaccaugaaagaacaaaggcacuucugauuauauuaauguacuguuucaucagaaaguuuaagaauguuccguucaccauggagaaauauaauuuagagcacuuuaauuuggaaggaauuaaaaaaagaauaacaucagugcugcuuuuuucuuuaccccuuauagagaaugcuaacuuuucaauaaaaacugaucauaguuggugaauuuuacugucuaccuauuuagccauuaauaucuguaucugguguauauaaauuauaguauucccucucaguguuuaagaaucaugguguaacauuuuuauuuuuuguguaagcuugaaccccuuugggcaguggugaaucaucaguguggugcuacugacuccugaauaaauuguaugacauuucacuuauuuaaauauacugaacuuacauauugucuucagaaugguagagcagcuauggcuuuaagguccuucagaaguuaaauucuuggaaacuaacaauuugauuuacuuucaggucuuuuccaauggucaccuuggaagugaagaauaugauguuccuccccggcuuucuccuccuccuccaguuaccacccuccucccuagcauaaagugaguuuuguugaauuuggagaucacuugucuaugcaucaagauaugguagagugguuuugagagguucucaguacagacacuacaugaugaauagaaagucauugauaguaaacagccagcuguauuuacaaacuaaauuaccauaaauuaagauccuucccuauacuuugcugguaaccacaacaucugugagacuuaccuaaacucuugagguuacauagagcaacagggagagaaagcuacgcauuccuugcaucaaagaggguagaguagcacaaugagguaucccuucaaauuuaccucuucuccucagagguaucccauuuuaucucagcuucccaguuugacaucauaaaauaaucuuugguuccaccagguuucucauuucucacauccauucagcuacuaaguccuuuugauuauucuuuuggaguuuuucauauuccucuaaucuucuccauugcucuagcuuugccucagagcuggacaacugaaagagccuuuuaucugauaaucucuuaugaucggagaguuaguaucaauggguuuacggcuaguaaaaugagauaacuggguaucucauuugaaaaauggggccccagaggcacacuagauaucucucauugauaucuucccaaguuaaaccaggauaaacuggauaucccaauucuaauuuuccugcucuuuauaugaagucaggaugucugccuuuccuccgguauauuuuguucacuguaacugaguucauuuaauuuaacuucugccuuccccaggucaccuucccacucaaaaacuagcauuguuucccuuuuuccauuaaauuaacucuaugcacuucugcuaacaguaagauccuacagaauuuuacccaacuaaaauauuuuuuagugauuccuaauacuugcccuguaauuauaucuggauuguuuuuucugacuuugugagauuuuuaugcuguuccuccugugcuucaccuuuuccuaaucuuuauccuaaagguccauaucucagacucuauuucuuugugaaauguucugugacuucuucaauuguagugauuaagacugauuuacauuccucuuccugcaguuuauuuccuacucauuuaauuauauacucugccauacuguuuucuaauuuuaaugugacucuccaauugaaaagauuacaagacuuugaggacaaaaacuuuguguucucuaucucccauaacaucuuacuguauuugauauauacuaaguaaaugauuugcauauaguaaguaaguacacagagaauacguggaugcuugguuuauugauuuaaauuuuaucugcugagguccuuauuuacaauagaaggucuuagagcuucuucauuccuucaucugcaguucacugaacucccacuauacauaucaaugcaaaagaaaaauaagguagaucccagccccccagaaauuuacagucuacuuuagaaaauaacauuaauguauaugaaaucauuagagaauggugugcacuaacauuuauaaugcuaacuuaguaguuucaaaugaguuuggaggagaggcuguuauagacuuugugaaugaaggaugucauggagggaugggcauuucaugacucaugaaguacaggcacaauugggaaaggcagaaugugagaaaaaacaagggugugaaauuuggcaucauucaggggacggugggaaacucagcgaauuagaucauucuccagugggaacuucucuuggaacugcgagauauuuagcaggcauaggaguuggaagcaauuauacauacucuggguaguaggcucuaaaucagugacaacauaugauuauauucuagugcuaaaugaacucuggauauaugugcauguaauaaaacaucuaagcucaauuaccuuugauaacucagagaacauuagaaaaugaaaucuugcuaauuagagauuaaauguucacauucuguuuauuaaauucauauuggcaagcgagcuggaaguugcagugugcuucauuuguauuuaacauuaaauaccugcuucuccuguaaaugaagcaagaauaacaaauugauaguaaaauguauuuuuucuaauacuucaguugguaagugcaucuaaaauuagucauacuuucucccuauuuacucuugauuuuucccucagaaacagugcaauuguuucacuuaacuagagaaauauuuuaacagugcaugcuugccagcaaauuaguuuucaauuuugcaugcugcaagucagccauaguuagcaguacaaaugcuagcuuuuaauggcacaguuaucucuccaguuuauuuuuguuucugacucuguggguagcaguuguucacuguagacaauaugcaaaguauauaagagaaagaaaaaagugagauacauaagcacaagcauaugcauaugcuaaauaucaauguccagaguuuuaacauuuugacauuuuuuauuuaaacuuguuuuuaccuuauuuagauuauaugguagagauaauuuuaugcccuccuuucuuaacauuaucauaagcauuuuucuuaauuguuuaguuaugcauuguguuuauuacaaaaccagcauggaaugcugaugugaacaguagaauaaaaucagacuguguaccacaccugacuccgccauuaaguauuugucuuuuuuuuuuuuuuuuuugagauggagucucacucugucgcccaggcuggagugcaguggcgcgaucucggcucacugcaaccucugccuccuggguucaagcgguucuccugccucagccuuucaaguagcugggacuauagucguccgccacuaugcccggcuaauuuuuuuauuuuuaguggagacgggguuucaccauauuggccaggcuggucucgaacuccugaccuugugauccacccgccucacacucccaaagugcugggauuacaggcgugagccaccaugcccagccuuugucuuauuuuuaacaggaaaacuucucugggccuuuccccaucugguagaagagaggaucaguuuaacuuaaauuaucuccaaaauccuuuugagauucagcuuuuuagguucuauacaguguguuuuuuuaaaggauacugauggcaaaccugacaauaacagugagucaagagucuuggcuguggauggucuuagaacagaggucuuagcaaaaugccacucacagaaauaggaaugucagauguucgagaguucauuuccaucuuagacucuugguauauguuucaaaaucaggccaaagcaaaauuacgcauuccuaccaaacauacacuucuguaguucuuacaaauguugaaaacuccaauguuaaauccaagaaugucaaagcuaacauuuaccuuacauuuauacuauguuguuauaaauauuuacugaaauagaauuguuaaauauuugauauuguuuacucugauucccauuuacaugaugucagaggcugcugucauaguguuuccuguuaaacuguaucuuugcaauuauuugacuuuuauuguguaauuugucuugagaccuagaagaguaugaaauuuacuuuuaaaaaacauacuguuguaaaagcaaucugaaauuauuuguaucuauauacuuaauuuuucuaaauuaauguuuuuuucuaaaugguuucugcuuaacaucuuugacacuuagcuauaaauauaaaauuuuaaguaaauccuagaaacauggguaauuauuuuuuuggagggagaacaaaauaauccuauguggauucuuuuuacuuuauaguuuaaauuauuuauuuacuaaauuauauuuauuuugaaauaauuugauuuuucaaaauuaaaacuaaaugauacucugaauaguuaaggaaauauuuauuuuacuuggcacacaauagauuggcaaaugaacagaggcauuauuacaaguaauaauggaguaauuacuuccagguaagauaauguucugaaaugcugaggaauaucuuuuuuuuuuuuuaagaauuuuuuuugugugugugccuugucuuuuagagauggaccuuuuguacuuuugauauauuaaacuuaggcuuucaaauagccaugaaucaauauuacuugguuuugcauuuuuguaagaaagguuuuuuuguuguuggaggugguauuaucuauuuuuaugaauauauauucuuauaauauauauuuuucuaaagagauaaguccuuguauuuuugguuccauaaacagagaauacaaauuucaccuaacuguccuguuuucauucaguugcuuuacuuacuagagguucaguuuguacaagauaaaauccuuuauccucuuuggaauuuaagcucuaguuagggagaagagaaaguaaacaaauaacuauauuguauauugucagcuagugguaagugcuaggaggaaaaauaagcagggaagaggauaaauaaugauagagagguuuauacuuuagaugaggucauuaggaaagaccucucugaaaggcuaauauuugaacagaaacuugaaggaaguaagggagcaaaccaugagguuaucugugugaagagcacagaggcuggauagaacacaaguacaaagcaacuucaaaucuguuucuccgauuuacaaacaaguuagugaaaaugcuuauaaguaaagcuuaucuuaaagcuugauaguauaccacacagacuuuuuuuugaugucaugaaagacccuugaaaauuagcauguauaugauaaaauuuaguguuuugaggaaaugauuuauauguggcacaugugcaaaaaucauuucaaauauagcuauauuuuguuuugucucuucucuggacuauuuauuugaguuagacauuuuucccuguuaggauugggauaauguaauauaagaaauaugguguaauguauagggcaagcucuaaagauucuauuuuaacagaagauauuuuuucguuacuugccuucagauacuauuaaaggaagauagauucuuauauguagaaaacaagcuuacuaauuaagcauagcauuggauacuaucuccugugcuggcgugaaaauucacuuguuucuugguuuguuucaagugugcauauguagaagaugaauguauuuaucacugaaggcucaaauaacuaacacaaugaauuuaauaaaauguccagguugugggggggguggugacuaugcaucuuugagaguguaugucccuauguauuaccaguguauuaacucaguaauaacagcaucagugcagaacacuccgggaauguaagaugagaauauaaagggauugcaguaauaaguguaaugguaggcuuuaauguggagucagccaaauacaauuuguucagcuuuauuccucugguauccuaaaaauuucccguaaguuuagucaaugacugaaaauugucccaugccccauaagauagaaauuuuuucuacugccaaaugucacauacauggauagauaaugacuaaauauaaaucuaauuauuuuaccuguuauuuaguaguaaguaaaauuaaaccuguuuuuugaaugaguuuguagaggaaaauaaaaccccacauguaauuccagaugguauaauuaguuacaugacucuaguuuuuuauuuugcuauuuuauauacaacuucuuuaucucauuuguaccauccucuucuguuauuuuuuuugauagaaaccaguuuuuuuuuucagaacuggauaagauuaauuuuuaauaaaaacuauguaaucuugaauaaaauacacuguaauguuauucuuuugguuuauuucuaauccaaauagacuauuauacugauauuaaacauuuucauuaaaaaacauaagcagaaaaauaaaaucugaaucuuuagaacuuuauuaaaauggugauaaauggaacaccuaaguauuuuuuucauauuuagauacaaacaccacuugaaaacuauuuuuucacuucuagauauaauucucuaaaaucuguguaaguugacaauuuauacuaguaaguuuuagcaauaagccuuauuauuccaugaaguauuagaugagcuuugcuuuucacuucauucugaaauaaucuacugauuuguggcaaagcaaaagagugggggaaauuacucgagaaauucucuaucaaugaagguaaaauaucaaauuagccacaacguaugugauuuaaaaaaugguccauuguugacucauaaugaacugcuucuuuggaaacuuaaaucuuuggagggaaccugcaacaggcagaucuuagaacauuucugauauugaauaguuguugaauguuuagugaaaaauacuguuuucuuuuuacauaguguaugcuugaauugcauagaaagggauucauuauaaaugaaaguaucuuaggcauagagaggauguacaguauauauuucucauuucauuugguaauagaacccauucugguccuugacuuagcuaaauugauggcuguguuuacaggaauuuauggaaaaguaauauuauaagucucucccaguuccagugccaucagaucaccauuuugcagcccauauacuuaacuuccuuuaauuggaaaguaaauccuccaaaguuaaaccauaauagguguaauaauagauuauuauuaaggcccuuagcuugugcuguagguagugacacuggaccuuuugucacuaugcuuuugucucugugcuuuugucucccuguaacgcucaugugaauucuaaaguugcucaaacaacaagaauuuaaagaucaguauugaaauuuuuuucaaagauagguaucaauaaacauacacuugaaaaaucuuaguuuuucuuugaucuuugaauguccuaucuaaugacuuagauaauaugguugaaacuuaaaucuuuagauuuuucaaaaugccuucuuguaauggucacaaagaaaagccccuaaaauuguuucuguucuaacuaauaaaaagaaauaaaaaugaauguuaauucaggcauguuuguuuaauauaccaaaggccucuugcucccucuauagaaggugcugcaaaauugcagucacuuaguuuuuuuguuuuuuuuuuuuccuuccuuuuuaaauugaacagauuucucaugagguucaugaugauuaacaaaaagauuuggauccauguguguauucccaaugccuugcaaacuaguuggucguccuaaagugaaucaggaugaguuugugcauuucugccuuggcauuuuucauuggcuucagccaggguuagauuaaacucugguagcaacaguuacgaaaaacauuguuuauguuugcccauuuguuuggguuuguuuuauuugguuuauuuacucuuauggauaagugaaaugcuuaauguuuuugauauuaggugaugguuuuacucauuuuaauucucuuuuauuuagccagggaauuuaaaccauaaaaauaauguacuucaaagacuuaaaaauaaguucucucauuaucuacaucuaaucauuccauucauuucuagcucucaguuguugguaggaagaaaaaccuaacaacuucaacuauaauuucacaggauaguuaaguuuuacagaauuaaacuggauauuuuuccaacuauagauaauauucacaggagacaaaaaguuugaccauucuauaaagacuucuuuaauauauaaaacaaccaugcuuauuauuguagcaucauauuuuacccauuuaauuuaaauuggaacaaaauauuaauauuuuaauagauuugguuugaauaaauuuguacauuuugucuuacaaauccaacaucuuuuuauuuuauucgacagguuacuaguuuuuccuauugugccauuuaaaauugugaggaugaaaauucuuuuaucccaucaagggucuuaacaaaagauugaaaauuguuuucauuuguauuugauauaagaacagcuucucugaugauacccuguaauugaaaaaugaacauaagugauaaaguagcuucuuugacuugaauaugucacaucagacuugccuguuuugaauauuaugcuuaaacuagauuggauuuuuuuuccccugguagguguacugguccguuagcaaauucucuuucagagaaaacaagagacccaguagaggaagaugaugaugaauacaagauuccuucaucccacccuguuucccugaauucacaaccaucucauugucauaauguaaaaccuccuguucgguaagaguaugggcagauuuuugccacuuacaucugcauaagcauuaucauuuguaauguuuguuuuuaaacaauugauucacgucuaauuaaaaauccuuaauuuccagcucaaauccuucucuuccuauuauaccauuuccagcauuacuuuuaaagaaaacuaaaagaugcagauuucucauuaaucaggaagucacuuuauuuuaucaguucuaaacaccuaucucaugaagaaaaauuagugcucagaaacuaagguauuauucugaccuuccuuagaauuuuucuucaugauguacauacuaguauaauuuaaauucauuuuccuucuugauguacuugcuaccuacuucuauucagauuuugaagaagugggaaaaaaauaccaagguguuucucuuaacuuuuuguuuuucuaucaagugcuauuuaccuuccuuuagaucaaauaagaaugugaggaauaggccaggcgugguggcucacgccuguaauccuagcacuuugggaggcugaggcgggcagaucaugaggucaggaguuugaaaccagccugaccaacauggugaaacccugucucuacuaaaaauacaaaaaugagccgggugugguggugggcgccuguaaucccagcuacucaggaggcugaggcaggagaaucgcuugaacccgggaggcggagguugcagugagccgagauugugccacugcacuccagccugggugacagagcgagacaccaucucaaaaaaaaaaaaagaauguguggaauaauggggguuuuuuccuuacuuuuguggcuuauucucacuuacauggggauagccuuggucuuugacuuggaagcuccaucgagguaaauaagaguuauuaauaauggguuguuuguauugaaauauuacuuuaucuuuaaguaaaggcaugagucugcauuuauauuauugaauuuauaaacugaaaucuauuauuucuggguuuguuuguuuuaccugacugaaauauaugagguacucaguacucccagcuacaaaacuuacuuucugaguucugguuuccuuuguauaacauuccuggggccaugcuuggcacauagaauagggcucaaguacugcugguggcccuacauuccagcaucucuccaugacugacugagggauaggggagauggcaauuacuucagucaucugugccaucuuuacuuagugugccauuuccuuuugaggucaagucaaucaacugaaaacauuuuauaaguacaguguucccuucuuuuccaaugaaaaacuaaaaaauguuuuaauguguuucuucaggcaucucacugagguaggaaaugcagcacuuggaaagagaagcacauuuucauuuuaagcagaugucugucuuaauaagugacccugguuagaauuaucaacauucugcugaauuauuacccagaauuguuaauagucuacagcgcaggacuuuauuuuuuuaaaagcaagaaccuaaacacuccuugcuauugcugguguuuagauaagacaucuguugauaaaaucauaucauugagaagacaaagaaauaacgaggagcuaauuuuauguaucagaagaaccaaguagcuagugauguauuugagaacaaaagauauuccuucucaucaaauauaaguuguuacaauuuucgguucuuuggcucuuacaaaugugcaguaauuuuuaaaaacuaaaguaggaugagcuuuuuuuggucucuuugggagucuuauuuuuuuucauugcuggauaagugaggaguauaauuuuaauacguuaaauuuuaauuguuacaucauauuggaugugauuuuuuguggcagagcucccaaaucuugaaaauaaauuugaauuauaaccaucauuaccauuuuucuauuguuacagaaaaguaauaaacguugauaaucccuaaauguaauuggagugaauucuuuaucuaauuuguucuugaaagcugauggaugaaguaucuucuuuugugcucuccaaagagcucuuuaagcuuaacacuuucuuucccuguguguauuuuucccccuuuggaacaucaggagaagugaauugucaauauguagaaaaagugacccaguaaaugaguaauucaauuuaauuucaguaaaaauccaucauuauuaugaagauucaauacaugauaacuauuuuuaaaugaacuauaucuggccccuuaaagagaaguggccaccagagagaauagaaaugaauuucagaugaagcauucuugcauuaucuauucaaauauccgucucuuccauuacauacgcacuuuuacuuugcucuaaaaauucagaguaaaucagagaaaaguaaaauguaaacucugauuucuauagcucuuugucaguugauuguuauagagcuauaugcugaaggcaaaauaugcuccuuaucuucucuuccugcugcuaucuucccauggcucaauuuuaaccauuguguucauaguaugauuccgaagaauuaauaccaauaauuuggcuggguucgguggcucaugccuguuaucccagcacuuugggagggugagguaggcagaucacuugcggccaggaguuugagaccagccugggcaacauggcaaaacccuacuaaaaaauaaaaaaaauuggcugggcgugguggugcacgcuuguaaucccagcuacuugggaggcuaaggcaugggaauugcuugaaccugguaggcggagguugcggugagccaagaucaugccacugcacuccagccuuugcaacacacagauacacacacaacaaaacaaaaaaagccccaacaacucaagcauacuuuucugguaaguaguacccuuuacaaacacauuaaaaacuguacuugucguguacccaaggccuuugcuaaagucauuuucuguagugucagagggccagaauuuuguucuuggcaguggugaaauaguaccacaggcucuaguucuuugaauguuccugucagaauuguaauggaauuauugaaaguucaauaauuuuucuucuuuuaugugcuguagcuuauuuuuauuacaaggaaauuuuaaguuacagaagcaaaaauaugauauuaaauacuaucaacaaauaauaaagucauugagacugcuauauguuuuugccuuggcacauacaucuuuuuuuacuucaaaaacuugaccagguucuauugaauucuuccacagagauaaguuaauuuuacauaguguuuaggauaucaacaauuuuuguggcccuuguaauucuugguuauaguuuaaaaaaagagagacuguguuacuugagauauuuacuucuacauuuuaaaauaagggaugaguaucuugauguuauuacugguaauuuugagaaaagaaaaauauauguucaaacuuuauuaaauaaacaggaauacuaguucccucuaccucucaaguuacuuuuaauuggaaaguauucuccuuauauaauuuuacucugaacuguccuuuaggucuugugauaauggucacuguaugcugaauggaacacaugguccaucuucagagaagaaaucaaacaucccugacuuaagcauauauuuaaaggguacguauagaauauaauuuccuuugugauguacaucuuaauggucagaauuuaaaggcaaaauuucaugccauuguacugaaaauacauuaagguuuuguguuauccucuaggagauguuuuugauucagccucugaucccgugccauuaccaccugccaggccuccaacucgggacaauccaaagcaugguucuucacucaacaggacgcccucugauuaugaucuucucaucccuccauuagguugaaaccuuuaaaaaaguuuugaacaacccaccccuccuucuuuuaauuucagaauuuucagaauucagaguucaguauaacacagacucacuggguugugaauuugccugaaauuugaauggguucuccaggugccggugacucccaaguucacgagaccauuacuccauguagaugauuaagguaguaguguaguaguugggcaucagucagguuuuaagcaaguuguuuuguccauacuaaauguagucuaaaaacacaugagagcuuugugcucuaguaguuuugaagugaugacuugaaguguugagauuuucuuuaaguauaauaauucuuaauaaauaugaacuugcuuuucuugcagcaugagcaccaguuccacuuacgcuaauuaaauuaugcaaaauuaaauaguuguauguagagaacugauaauaaauucuguuuuauucuaaucauuacaacuguaacacauucaaaaaaaucucaauuuccuuguuucaaauuauaauaaugaagaaacauccuauguguauuuuuguuuguauccacaggugaagguauauguagguguguguauauguugaaguuggcuggugccacugucacuguuaauuucauuaauucuaauuaggaagcaucucacccuguuuuuagaagacagaaugucugcacaccuuacauaacgcuucacaauaacaagucacuguaacauaaaauaauauaugaugaaagucaauuuacaagcuuuucugaacuggcuguuaggccaccagaaauacgaaaugaaccuuuccauuuucucacaaguaccacugacuaguauuuugaaugacacaauugcaguaucuuuugcuccuguucucucuguaguucaggacuuuauucucaccuacaucaauuacaaaaggcuccuaacucuguuaccuacagucuuucucucccuuccacuucuuccugcacacuuguuuuugacauauuacccagaucuucaucaccuggauaagcauuguucaauaaagcuuucuguggugauguaaaggaucuguauauuugcauauggguuaagugugauuauggaacugacuuuucauuaaauuuaaauagcuaaauguggaugggugacuacuuuauaugacaaaguagacagauuuuccaaccugucuuuuuaccuugaccuuuuucuaggucuucuuaugcgugucauuuuuuucuucauacuguuuacucuacuuagacgauccuguccuugcauuugaugaauaaauuuuugagccuucugauaucccaggacuuccuguucuucaacacuucacugaauaccacuugucuacauuucucuuuccucauccaaugcauaugucucuuuuaugggaccaauaaaacacuuucacuuguaaaucauaccuauuugugagcuuuuuuuuaagcuccuuucauggaaucucagcuccuugagucagagccuuauaauuuugauuuucauaucaugcaugagccuggcccagugucagauguuuaagggcugaaaaaagauuugaauaaauaugauaauguaggaaauagcugaagguuaaaaugauagcaaaacucugucuugugcaucuucagauguguuaauaagaaaaauaugauuaaagaaauuagugugccaauuuuuucuaaagcaaguucaguaaauaguaauaucuuuuuuuuuuuuugagacagucuuucucugucaccaggcuggagugcaauggcacgaucguggcucacugcagccuccgccuccuggguucaagcgauuccccugccucagccucccgaguagccaggauuacagucacguaccaccaugcccggcuaauuuuuuguauuuuagcagacaugggguuucaccauguuggccaggauggucuagaucuccugaccucaugauccacccaccuuggccucccaaaaugcugggauuacagacaugagccaccacgucaagccucauuuuucuuuaaauaugccauuauguuuaaaucauucaacuuaaaagugugaauuuuuauuauuagaauauguguuuauguauacccugucucauuccuaaaguauuuugagauagcuuaccaaacaugugcuuuuuuuuuuuuuuuuuuuuuuuuuaaagacucaagguaaugaaaacuaugaguagaauaguaaggugugacaggggacaaauaaguagauauaaaacuaugcugcaauauucuaguuauuaaagcugggaaauaugcaaauguaaguagugcuuggaaccagagaagguucuauauuuagcuguucuucuguagcuaaaucugacaaauugaaaaauaucauauucucugcucuagguacauuuuauguauauuuugacagcauaucaaauauaugaaacauuagguuaaauaaauuaaaauccaguggaauaaacuauaugggauaaucuaaacuauucuuugacauuaaauuauauguauuugaggugauuuuccaguuaaaggcugugaacucuuuuugcuacacagaaaauccuguuuucauagugugacugauaauaauuuuuaguucaaacucugaguccuaauauuauaaagguuacaagugaacuaugagcuguuucauaaguuacaaugcugcuuuuuauaaaaaggccugauagaaaaaguuugcauggguguguuuguacguauguauguauguauaugugugcauguguguguuucucuccagacucucccacaaaauaauuagaucccauuaucaaaguuggugaacugcuggauaaacccugcgagugaaauucuuuauaagcagcaagagaaaaucaauuauuacuuuuguuagaugcuguguauuuugauuaaugaaguucugcugcugauaucgaccuuucuuuaaaugcaggugaagaugcuuuugaugcccucccuccaucucucccaccucccccaccuccugcaaggcauagucucauugaacauucaaaaccuccuggcuccaguagccggccauccucaggacaggaucuuuuucuucuuccuucagguaggagggaaaagccaaagaaaacuauucacuuaaagcaaaaauauuuccaaaaccauacuaucaaauaaauguuagugauucauuagucucuaccucccuagcagaacagaaaaaucccugggugguaaaaguagcaaucguggguacguuuguuugucaguugauugguuuaaugccaacauaauuacagagauggaaagagcaauaaggaacuacaguagaaaugaugcuguagagauuguccaguccagaaaccuccuuauguuacaaaugcaacccugagaaccagaacugcuaagggguuaggcuaauaguaaugggaacaauauuuagacuuugucuuccgauucccaaugcaauguuuuuuaauagguuuuuaaaauuuuacuagauaugccuuagugucauaauuuuguucaaaacauaagauuuugguaaauuauguuguuauaacaagaauagagaaguuuuucugaaauagcugcauuuuauuguuuuguugugauauuuuuaaugccucaguguguaucuacucacuaauuauugguauucuaaggaaaacuaauuuuuucuuaguaacuauuuaauauuauuauuuacauauguauauauuauauaauauuauuuguuuaauauuaguaaacuaauuuuuuauauuaguauauuuuaaaauuucaaaagaggaucugaaauaaaaaugaagacuuaauaaacuaucuguugcauuaguuagaauuaucaggaaaaagaaaaaaaaauguuauauggaaucugcugauacuaauuaacaguuccagucugucuuguuagugauacugugcccugaaaccuuugccuccuuggacuugauuugggaaaauacaggguaaagauguucuuuuuuucauaguuccuuacauuucuacaugagauaaaucaugaaaaucuuuaaaaagugcucaguuuguccuuuagcuacguauaugccucauggaaacuugagaaucuuuauucccaacugauucccuuaucagcuuccucaguugauuauuagucaugucuaccauuaguuuuucuuaguuuuuuuuuuuuuuuuuuacuugguuugauaguuuagaaaguuugaagagauuugauaagacacacaaguuauggacguacaacuuggaauacacagcuucaauuucuuaaagugguuuauuuuucaagaauaaucuucugcuuuuacaucaguaaauauugauugagccauucacuguuuacccauuugugauagaugccuccugaccuguggaaccuuaugaguuuacuggauucugccaaugaaagcacuagugucauaauccauuccgguccaagcaggaaguauaguguaugaguccguuuucacacugccauaaaagcacuacccaagacuagguaauuuguaaagaaaagggguuucauugcuucacaguucugcaugccuggggaggccucagaaaacauacaaucauggcagaggugaaggggaaccagggcaugucuuacauggcagcaggugccagagagagugagcaagcagggaaaaugccagacauuuaucaaaaaccagaucucaugagcacucacuaucaugagaacagcaugggggaaccacccccaugauccagucaucucccaucaguucccucccuaacacguggggauuacaacucaaaaugaaauuugaguggggacacagagccaaaccauaucauaacugcuugggcuuuuauucauauaguuaguuacauguaaacacugcuguauuucgcuauuuuuuuucacuuauucaaaacuuugucuuauacauagacuuuaacaugauuuuuagaacaaugagucauuccaaaucuuaguuacuuaaauuuccugaugcuaaguucaagauaguuucuggcucuccuauuaccuuuuauaugcguaacuuaagccccaauagauggaacuuugaugauguggcuuuucugacaaauaaagucaagcuuuccaagagcuauaauaaaagagaacauuuuacacaaauacacacuuuuaccuguuuuugucaaaagaauuguaaaagguuuuaguuauuuauuuuaucuuaauuguucauuuccuuuuauauaaaaucuucauaaagaaaccccucaagauuaauugcuaaaaaaaauuacuaguuuaaaaugaaaauguccccucuuauuagcuaaaaugcaauuuuuauaaaccguuguauuuauuuuauagauuugccuguuuuguguuugcuuggcugccagggagcucaacaacacuuauccuuaacuuagagugucaggcuagcaugggagucagggcaauguuuuucaagccuguugacucucucuugacuuucauuaauagauggacauauucuaauucucuucccaauaauaucaacaucccuuauaauaaguauuucuuaaaaaaaaaaaaaggcaacuuuuuuguuuccuuuuccagucuuucauaaucauuuacaugacagauuucuagucugguaccagauccuuuaugacuuuuuuuuuuuuuuuuuuuuugagacagggucucacucuguugcccaggcuggaguacaguggugcgaucucaguucacugcaaccucugccuccaagguucaagugauucuccugccucuacccccuaaguagcugggauuacaggugugcaccacuacacucggcuaauuuuuuauauuuuuaguagagaugggguuuugccauguuggccaggcuggucucgaacuccuggccuuaugugaucccccugcuucaaccucccaaaaugcuagaauugcaggcgugaaccacugcacccagccccuuuaugacuuucauugugacaauuauuuugauucaaauuuaaaaccguguguauuagcuuuccuccuuuucaaaagaaauauuuuaauauuuuaaugcuauugcauaucauagagcauaaagauuuuuuuggcugauaaaugagcauuugaguauuguuuugcaaaguauuuaauacauuauacugucuaaagaaauguaaaagauucauuauagcaguucucccuaagaauugacuuuauuaagaauaugcuauaaaugcuaaaguuuaacucaguaguuuuagaauuauaaaagguaaauaaaagggacugcaaaauuuaaacaaacucugugagcauuuuaccguuguuuucguuguucagucuguaaaaucuuagucugguguaaugauacaucuuuucuaaacauuauugagauuugguuuccugaggaaauaauuauuucuaauuaaagacaaaugauaggugucuuaggaagagagguugaauuuucucaugauauuauacuaaguaccuaaucaagccuacauuuuuauuccagcauucagugcccugcacaguugggccagguucagcuuuucagccuuauagcucauugacuucuauauaguagugauugucaaauugcaguguccuaugucucugcaaaagugccucaguacuguuguaggaucaagggggcagggcaagcagaggcagggcucucauucuucuuuuaucucuuuucuauuuuaggccuucauguaagauuucuuuuggcagaauaguaaugccuacagcuguacaugagcccucaguuuuggacaggccaaucauaucuuaacaaaaccugaaguccccaacaaaagcuuuacacucuuuugucuccaaucccaaggcuaccacuaguguauaugugcuuuuuuccauauuacaaaaaaguacuuccuuuuugcugguagauugaaguagacaccccuaccucuacuuugugccaggucagggcucaagaaacaaagcaaagacuguauuuaaguccugcucauaaccauaacuaggugucuuugugcagugcacaaaauacaguguuuuugucagucuuuaugcuaccuuuauuuugcuguuucucuaaccuguaaucucacuugaagaucuuaucuaaucuuaaagucacaguucaacucugaaagcuagccaaauugacuuuauuaaagauaaauggaaguuuuauucuuggauccagaaaugcaacugcauaaguaaaauaugaagaaaauccagaucauuagcaacaauuguugaaaagguuuuagggguuuuguugacuacaaucuuuauaaagcaucaucaugaugagaaagcgcaugccauuuggggcuugaacucacagaauucaaaucugaggagugaaguccuccacaguacucagccuuuguggagaccacuguguucagauguugaagcauuaaugggcuagagcagcaauucucaaauuguguucuccggauucacaacauuagcaucuccuggggauuugcuuuaaaaugaaaauucaagacuuaauaaaucagaaacccugggaaugggacucaguggucacaagccuuccuggugauucugaugcauguucaaguuugaaauauacugggcugggguauucucaaaaaagugcaaccaggaugauaaaguaaacuagaguggauuaaaggaacugagaauuggcucagagaagagaagaccuuggauguagacgagaguugucuucaguuacaguauuugggaaagaaggauuauauuuuuuccaugucacuucagaagguaggaguaagaucaaugggaaauguuaagaaugaaaauugcauucauccuacaaagaaguuuccuaaaucauuacgaauuguucuaccuugaguguagugaguuaucugacacuggaggauuuaaaccaaugguagaucauuacauaguagagauaugaacaugagcuaaagcaugagggcagcaaagaggggagaacuuuguuucaccuaaauggcucuucaaaccuuuuuuagcauuaguuucugcuuugauauacucuauuaaaauuugggggauaauugauaaaucuuccaggugguuuauggauggccagggaggaaauuugccauuguuuuaauuauuuaauuuuauuugccucuguuuuuacacuugguaaaaauuuggaaguguuucagauagugaagaaaaaaaagaauuaagaaaaacauuccaggccagguacaggcucaugccuguaaucccagcacuuugggaggcugaggcaggcauauuucuugagcucaggaauuugacaccagccuggccaacauggugaaacuccagcucuacaaaaauacaaaaauuagccggguguugguggcucgcgccuguagucucagcuacuugggaggccaaggcaagagaauggcuugugcccgggaggcagagguugcagugagucaagauugaaccacuccacuccagccugggugacagaacaagacgcucucucaaaaaaaaaaaaaaaaaaauccauacuuccuccuccuaaucauugauagguauccuuccuuuuuuuuuguuguuuuuuuguuuaguuuuguuuuguuuuuugccuacgaguauguaaguucacauuuauguaaaauuuauuucucauaguauaugcuauuuauaaccauuuuccaguuaauaugucaugagcaauguauauaguuguuaaauauuuguacacaauauaauuuuuauugauguauauuuccucauuucuuuuuuaaguagcaaaccauuuccucccagucuucccuuaguuuuuuauaaucucucaaauaaguacuaaauuuucaguuuugcagugcuguacuauaaaucacaggcaguaguacuuugcuuuuuacaacagauuagucucuguauguguauccauuuauuucucaaacacuuauauaagugauaaauuggcugugaucauuucaguuuguuuuaauccuguggauauaauauuuuucuuuaguuuuugaagaauuuauuuuagaaaagcuuuauuacuuuacaaaguuuucuuaucaggggacaauugguaauuauuauacucuguguagcaauuguguuauaucuaaucucuuucccuuuaaagccugaaugcuuccaacuuuauaauuugcuuuagagagcccaguuuacccuauggcugacaaauagcaaacuuaggauaugaugcaagauagaacaugauaaugauucaaaacagaaccauaagcagguauuuuugcuauuuauaauaauauuuugaguguaucuaguaccuuuuaaauaauauaguuuaauggaagaauauaguacagugguauauuuuauagucuauguauggcucugaaguguauccagaguuuacuuuuuaaccuuaaauaaauagaugauuagaaauagcauuaaguguauuugacaaaccuauaaauuucccguaaagaaauaagcaaguguauguauuguaaaagacagucuuuccucugacuuaauguuguaucaggggcauuuagagucuacaagaaccuaaaguaaauuuuaugaaauaucuagugcaaaaucuuugggaaauuucaaaauuuaugcugaaaucaccauauuuguuuccuuugguuucucuaacaaaccaaaagaucaacauugucucaugcgauuuaucuucucauuccuuccuaaaaauauuucuggaaaauuaauggagcuggaccaccaauucuucaaauauugaaaacucaaaaucuaagaguuauuuuaaucuugaaauuaaugaaaacaaguuaaagagccuugucuaagucaaaaaguccucagcaaagcuggugauaauuauuauacuccaaaaaaggugaaaagauaauggcuucaaauccugccuuacauuauccagucaaaaacuaauauaaaaauagucaauauuuaagccuauguuuucaucguaaguaaucaaauacuuacauauuauuaaugucuaagggaguggaaguuaaaacaaugaaauucaaucgggucuucuuuaauauuuacaauuuuugcuuuacauuagcaauucagguuucacugauuuuaaaauugugaacaaucugaauuuguguggauuuauuugugguaguuaaaaguaaauauuaagugcaagcuauuugccaagaguguucuaggugcuauguuugauuuaggagguauaauucaaacaugagaaguaggaaaagaucccucagaucccuguccucagaagaauugacgguacuuucagagauaucgacaacauaaaaguacuaugagaggaaagcagcggugccugaggugggagugauagcuagauaaauuauuagugaaccaagguuuucagauguaauguuugucuacucaaaaagggaaucaauucucuaagaauuuaaacccauauaauacuaugaauguuaaaccaguuggguuuaugguauuaaugauuuaauacagcaacacugacaaaaucucuuuuucucccuuuaguuccaguuaguaaauaucauauuuuuuacuauuucagaugccccgucucugacugccaaggugguaaauuaucacauuuuacuguauauucaaauguuaauuacuaaauggcauaauuuuaacaauuaaauuuacuauuuugugagccaacuaacaacaaugauguuaagcauaggaugcccaauauaauaauaagcaccuuguauguacagaagauuuuacaugcacaaauucauuuaauccacacaaauccgaaguuucaggucuguuuuacaaauuuuguaugcccaaugcuuagagagaucaaguaauuugauaauacucuuauagggaggauccaaacccaugguuuuauguauauuuguuuguuuguuuuuugcuuuuacuuuagaacaguuucuauacauuguacagguuggauugggacagaaaauaaaauuuagaagcuguuuuuauugucaacaaucuuauaauuaaauauaucugcaaaauauaaauauaaaacaaguagucuuuauuaucuggaaauaaaugugaagagcauauuuaagcaagugaugaauaaauuagaaaauaugcaggcaguaaaaaaugguuaauaucagucaugaauuuaauuuucuaauuuauuuuugaaagccauaaucuucauaaaauaauucuagaauuuuuuucuucagccaaucaacagagaucauccuuuuaauuugaaacuuguuuuuauuuuuaagaucccuuuguugaucuagcaaguggccaaguuccuuugccuccugcuagaagguuaccaggugaaaaugucaaaacuaacagaacaucacaggacuaugaucagcuuccuucauguucaggugaguuggcuaguaacaguaacaauaauaccuuauuguuauauagugcuuuuugcuuuucagaacaccuucuuauucauuauauaauuuaaugaauguuguccacccaagaaaguauuuugaucaucauugcauuuugcuuauaaagcuggcauugugagaggaauggcuacagaacugccucauugaaaagaaaaauauuaagcuuaauauuaucuuugaucacucaguggagccacuucuuugauucaaaauguauucauuaucuaacuuucauuuugucucagauuuaggaaaugaggaaaaucucuuuguacauugcaaugcuguuuuauagcaaucucuauggaauuaauacuggcaccaaacuauucauuuucuuagcuuauuuagggcuccaaccagugcugcacugacagccaucaaauagaaggauguaccauuuuuguaaauacaagucauacucacaaccguuaauaauggaaugcugcuucuuugcuucuugaggaggcuuucccugaacauaucuaaauagcuccuaucuucugcaguuauuuucuuuccuuuuuugcuuuauuuuucuucauagcacccgucacuacuuaaaauuuuguuauucagaauucauuugguugauuguugguuaucugucucgucugcuaaaguauuaacacuuuggagauaagaauguugucugguucacugcuuguccuagucaguucaggcuacuauaacacaauaccauagacuggauugccuaaacagcaaacauuuauaucucacaguucuggaagcugggaaguccaagaucaagcuaccaacauucagugucuagugagggcccucuuccagguucauagauaacugccuucauacuguguccucacaagggcaagggagugcucugggaucuguuucauaaggaaacuaaucccuuucaugagggcuuccccugcauaaucuaaucaucucccaaaagccuccccuccaaauaucauuacaaaagggauuagguuuuaacauauggauuugcagggaaaaggggacagacauucaguccauagcauugcuuuauccucaaguguccaacauagugcccagcauaugucucuuugauggauaguuggggauggauggauggauggauggauggauggauggauggauuugaguggacaaauaggcaaaaggagggaagaauagcugaugucuguauuaaacuaaaugcaaauaucugauaagcaauauuuuugucacauauuugugaauaucagaaguuuuccuauaugaacuuuugucuuauuucaaaauuuuuuuaagcuaaaaccucaguucauagaagacuugcuaauacuauuagcaauacauucugaaacuucugaaucaagauaauuaaugagcuguuuuaagaauugucaguacgguaguucuuacgugcucgaugccaugcaugggagaugcagaaaucccuguguauuuauauguuuaacugcuugcauguaacucaggaaagcauagaaaaucuuuuuaaucuuuucaaauuuuggccaguguucucuuaucaguuuauuucuagucauucuaagguuucauauguauccaugaguagccuguaauuccagucaaaauaauuugaugacaaaacaugaaagucaagaaagaaagacaauaucugacagcuucuauauaauauaaggaagcaauuuuuuuuaaagaaaauaguauuaaaauauaacuuugagcaaagugcuaugacugauuuaaaauaacauauucaguaccaccagcucuggauuaaaagaaaccuauacuuuaguuaggggaaaacuuguagccaaaacacaguguuuucacagcuucuuuacaguuuucuccauaauaaguggguguuguagagcccagaggaacaucauucacauauaugauuucaagcaguaugaaucccuauuagcauuacacuagaaaugucuggaagaacuucaaaucacaaaccuuguugaaauauccccgaauagccauuugccagaagccugaacuggcuuuuaccuaaguaauaaaagacuccugacuauuacucugagggcccagcuagcuguaacaucaaauauuucaaucuacucccuaaauucucuuuacaaacacagucaaccacagaaaauaagauacuuuuuuccaacauauguuuguucacaugaaguucacaggccuaccaggcuguucacuaguuuauuuuacaucagcagagagacugagcuugccuucuagaugaggucuuuccauucaacccuugagacugaaugcauaugcgccuuuaggauucuaauagcucuuauuuugcaguaauuaaucuguuuuuauuaaggccuuuuuaagaugaccaaaugggguucugguaugauugcucugccuuaugaauucaaguucuguuaucacuuauggcugucuaaauaauugauagucauuuaugaauaggcuucuauggaaaguauauuucuaaagaaguuuaaaauguaguuucauugauuuuaaaauaucucccuuguuuucuuaucuaaaaaguaugucugcauguauauguaugucuacauauauaaagagccuucuaaauguuuauuccucccaaagaaaauauuuuaugcuuuucuuaaaguuuuucuaaauguauaauugaaauuuaaauauaugaacguaucauagguaguccagauauaagaagagcuuaccagcccauguuaaauucacauauaucgguauauaggacaaacauuuuugcuaguaaucugcuuguuucuuuacauggauguauuauucacauggggcacaugucucuucuaucuaugugugagguuuuacaaauuucucaguuugcuuuucucuuguuguaagacauauuguacuacaguuugaauaccauucuuugaaaacuaaaaggcuguauuaaugaagugcaccauucacucuugaggugauuuuucauauuguuaguauuuagaaggaaguucaagguaacacuugaaaacaaugcuugauuuuagcacaacucaaauguguuugaaaccauuaaaagaccuuauugccaaauaagccaaucucauuauaaaauaaaggagaucucauuacaaaaugaauuaauuucaauacuaccauuaguuuacuagcuuaaaggagaauuguuggaauguugaauacauuuuauauuaggaccaaguauucaauaguuuaucucuguuaagaucucaauuggaaaucguggcuucacuucacgcaaggguuggaauuuuaagguagauuaugugucuuuaagauuuuguguuucaacaaaggaaauggcaauguugaguuuucccacaguuuagcuaugugaaauacuggggcuuacagacagcuucaguuugaaagccagagaaccuagaguuguuuuccuuacaaaucuaagauuaaauaaccauuuucuggauauauuuaaaacaguguaugugaagauuuuuuuauuuguaauuuaguuuauuaaaucauguccuucuauaggcaguauuucuuuuuuuuugagauggagucucgcucugucgcccaggcuggagugcaguggcgugaucucagcucccagcaauuuccaccucccagguucaaguaguucucaugccucagcuucccgaguagcugggauuacaggcauccaccaucaugcccggcuaauuuuuguauuuuuaguagagaugggguuucaccauguuggccaggcuggucucgaacuccugaccuugugaucugcccaccucagccuccuaaagugcugggauuacaggcuugagccacugcgcguggccagcaguauuucuauagaggcaguaauucaaccuuauggcauaaaaaugaaucccagaauuaauugauccaacuucuaguagaauaacaaaguuaaucauaauguguuugagauuucuuuuauuccuugaucaauuaaguguauuuauauuuuuuucuaauucuguuauuguuauaguugagaaggucaguagucuaagaguuuugauaucugucccaagaauugucacugguuuacuaaguaaauuuagacaguauguuucagauaauauauacaauauuauuuugucuaauuaaaauucguuaaguuuguuaagcauuuacuauaguccugaugcuuugcuaaguauuuuagagacagauauauaauuuuuuuuuuuuuugagacgagucucacucuguugcccaggcuagagugcaguggcacgaucuuggcucacugcaaccuccaccuccuggguuuaagcaguucugccucagccuccugaguagcugggacuacaggcgcccaccaccaugcccagcuaauuuuuacauuuuuaguagagacgggguuucaccauauuggccaggcugaucucaaacucuugaccuugugauccgcccaccucggccucccaaagugcugggauuacaggcaugagucaccacgcccagccagauacagauauauaaauuuuauauaaguuaauauuauauauaauuguauuuauauaguuaugcaguaaaauauaaauauucauguuauuuuauuuaauaauguauauuuuauauuaucuguuuauaauuauacauuuauauauuugauauuguuauacaaauauaugguuauauaauaugguauagauauaaauauaaauuuauuuuuacuguguaauauagaaauagauauaauuuuauuucuccuaaccacucugaaauauauauauguguguguguguguauauauauguguguguguguguauauauauauauauauauauauauauuuauuuauuuauuuauuuauuuauuuuuuuggagacagagucucgcucugucacccagcaggcuggagugcaguggugcaaucuugucucacugcaaccuccacguuccggguucaagcaauucuccuguuucagccucccaaguagcugggacuauaggcaguuuuuauauuuuuaguauagacaggguuucaccauauuggucaggcuggucuugaauuccugaccucaggugauccaccugccucagccucucaaacugcuaggauuauaggcgugagccacugcgccuggccugaaauagauacuauuaaugucaauuuauagaagaaagaaagacauaacaaaguuuaguaacuaacucaagcugcugcagaaaguguaagccugauagaauuuacaucaguuucaguuuuuuaaaaauuuguuaauaaaguuuauguuguuaucccaucaucaugccagaauuaaguuagaaaaaaauguacacaugcaucucacgucuccagacugaguuuggagauguucagugguaaaaucaugauaauagugauggaauaguagugaugacaaaauaaugaaggguuuuagaaauaguaaaacuguacuagaaauuucaaaaucuagauucugauuauuuuucacaugaccuuaggaaagccacucacuauguacuuccuauauuuuucacaugagcgaaaucgaucucugguucucagucuuagauacuugugcagcugaggccuuuaagaguaucagaggagaucugagacuauuuuguuguugguggugguuuuucuaauuaugcgcauauuauacacgcauuggaaaauaaaaggaaauuacagagaaaacaauuaauaagaaaaagcaaucacuuaaaacccuaucuucaauaaggaacauuauugccauuuucaagugcagccuucuaaauguuuugucuaugcacauuuucacuuacgaucuuaagaucauacucaauaugucaauucuaucucaguuccauuuaggaguauuauaaguauuuuaccacauuauuuuaaaaaauaaaugucauuuuaaauuauuguaugacaauccauuauuuuuauguacuaucaaauacuauuuuuaacauuuugaaagucuaacagaaacccuaacuuuauauacuagaaaacuuucacauuaaaucccuuugcugugaccuagauauacagaagcucaguguuauauuuauuguugaacaugauccaguauaauagaaaaugggaaaauguauucaucaauacaauagcauuugcuuauuagacacaucuuucagaauauagaaaaagaaaacccaacccaaucuuuagaugaugaggggaguaauaaagacuuuuuguggcaaaauaauugacagccacugaaaugaaauauccucaguucuuuaaauggagguuauguagauauacagcagugcgucucacuuaaaaaaaaaaaauauggucugccuacgggccuuuuggacacuuuuuuuuuuuuuccuaauaagcuuucuguccccagcaauaaugaaaguuuaaacuacagaugugcuuaguagacauagagauagagguauaucucuauguaccauggcucuuuggaaggccacaaaccauuuuaccaucuaaaauuguuuucuuucaucccacaagaaccaaugauugcccccgucuagaauguaugaccuagaguaaucauucuggguauuauuccaaccauguuaggcuaauucccaugcaauccaggaauguucuguuugucacucuguuggaggcugaaagaaugagggucgugaucaacucacuauaccacuggaggcuauaugagugaacagcaaacuguucucauaaaagcagaauguugacaaacugacaaacugcaucugcugcccaggaggaaugcugagggcagucacgacccaggcacaaguguugcuuuugauuaggcacaucugaagccuguuaacaauaaugugaaccugugaucagucaagcagcugaccaaucguuaccuccucaucccugcucuuucuacccaauaaauacaaagggcuauggaagcucagggcugcugccuuugcucacuucuucuuccucagacccuuuccuuaaaacaguuucuuuuguuuuuuguuaucauuucuagguucuucccuuaguucagucuuguaaugauggucucagguaguaacagaaguaacuguuguaaugacugucucaaauaguaacagcaguaacugugauagugaaggucucaaguaguaacagcaguaacugugauagugaaggucucaaguaguaacagcaguaacugucauggugaaggucucagguaguaacagcaguaacugugauagugaaggucucagguaguaacaguaguaacucucguagugacggucucaaguaguaacagcaguaacuguuguagugaaggucucaaguaguaacaguaguaacucuccuaaugacagucucaagugguaacaguauuauaguaacuguaguauugauggucucaaguaguagcaguggcggucggccacaucacucucuucuuuuauaugcucagaaaaggaaagcugaaucaaaauuuacuccuaaaccagggcuucucaaaucuuucuuucucaaagaagaguugacagugaacaacacaagggcugggacauuagguaaaagaggacaauauuuaguuuuuuagugcaagacauuguuucuauuuugucucaaaaauuugugcaaacuuuauauuuuacuccuuaguguaucuguauucauuucagugcuuuaaaauauuaaugaccuuauaucuuuuaagaaaauugguaacccagaagauguacuauuuauauucuguggcucacauucuuguacuuauuuugauaccacugcaauuacucauaagaguucaaaaauaccaugaacauggaugguagcacuagagcaaacacaugcuuuuccaaaauaacuauuuuuaaggaugauguauauucagguacagaaauuccacaggguugauaaaauuuauaguuauuucagugugcucccaaacugcaauauaauaaucuuaggggaccagaagauaguuucaucuucauuucauugcuuccuuccacuacccuacacauucgaaagugcuaaaguaaaugaggaccugguguaauccacuuuuagguacugugaaaaagaaaaguggagaaagugaaggcugcgucugggcuuugggaagagacagaaagaguaaucgguucuaagcaauuugcucuaauggucaguguggaaaugaucuccuccuccccacuuuuuaacagcuuccacuaguaguucagguugcaccagaucuugcuuuuuaauauucugcuagaaggcuuucuguagaaucagauacucacaacaaauuuuguguucuuuguucuuucacacuucucuggcauuccuguuauaguaauugcugguuuauagcauuugaguauagcacuuaucauuauaaauauuaauucauuguucuuucuuuuuaauggucuccucaguccauauacuguauauuacauuaauuguuauacuaccugguugaaagggauaaauaauaccucuaaacacagauauauaaaguagauuuggagaaugagaauugugaaaguaaauugcuuagcccaagaucuuagcggccaaacugagauuuaagauucaauugccaguuauaccauuuauuagaggcauucgucauaguauucaucccacuuguauacacagcuguucuuuucaaacaugccuggcauucaugugcacaucucaguauccuggacagacaaaauaacaauauuaaaaaucucuuagaaaauuacccguagaaaacaaguuaauuguuuucuaagucuagguacuuuuguaucaaagucuagguacuuuucucaucuaaaagugucucagaacagacaugauuuaaauguaugaauuuuuugguaauugauuaaaggaaagcuuucaauaauuucuaauaguuuugaaaaugauuaaaagcaaaacauaauuuauuguccauuccuguaugacauaaugaaaauaauaggaaaauaaauggaacuacaaaacauacuaagaaacgcaguuuaucagacgauaauaguuugagauguuuaauuacagaugcaagaaacaguacagauauuagcaagaaccagaaauuauauguucuuauauaugggcauacuuuaauauacauugucuacagcuauaauauuuucuaaaacuggacauuuuguuacaaaaaaggaauaauuuaaaauaagacugucaucauggccggacgugguggcucacgccuguaauuuuagcauuuugggaggccaagauggaaggauugccugaggacaggaguucgagaccagccuggucaacauaaugagacuucaucucauuuaaaaaaaaaaaaaaaagaagaagacauccuauuugauguggaaacaaaugcuuuuauccuagaggcuuuguuuuauguauguuauauugauauugcuauaauuguauauaggaugauguuuuuacaaguuaccuucuccuggaaaaauaucauacaucuuuugauuuagaaaggaaaaauauugaauaauacaucagauuagcuuuuauuauuuacguuuauuauuauugaaaauaucagcuuacaguaucuccugaagccauugggaaaguugcugaggcagcaggaguggggagacaagaugggaacauuaagcaugagacguuuggcuuuuaaccucacaucaccauucacuuaacucuguccuugaauuuauuguuuggcauuugucaguggucugagagaaagguauuaaauauuguugucuagauagucuuaaauccauaaguguauuucaugacauaaagaugacauuuuaaaauguauauaugggccaggugcgguggcucacuccuguaaucccagcacuuugggaggccaagguggguggaucacuugaggucaggaguucaagaccagccugaucaacauggugaaacccugucuccacugggaaaaaaaaaaaaaauuagccaggcaugguggugcacgccuguaaucccagcuacuugggaagcugaggcgguaguagaauugcuugaacucgggagguggagguugcagugagcugagacuacgccauugcacuccagccugggcaacaagaguaaaacuccaucucauguauacguauaguguguguauguguguauuuuuugucuaggcuuuugagauaaagugcuauacauaaccaggaaauacaugaugaaagugcccugucaaguuagcuagcccaugaccugggaccuuuucuuuuuucuuaagguuacucuccauucaugggugccaaugucauugguuuaaauuggaggcuguauuaucaccaagggacuaaucuagaacccaauucucuacuccuaauauuucuucuagguuugcuuuuucuugagcaaaacuuccuacauugcaaucuguauaaaguauuugagcaaagcacugaguuuccuuccguucagccuguugacuaacaguagagucaaagcaucuacuauuuuguuuuuuuuuucuccuagcaucaguaaggcacagauuauuaacuugaaaaaucagcuaggaaaaugcuacagagcaucuguuuuagagcaguucugcugugacauggaugggacucaggaccuguggggacguucugccauggcuguuugugagcuugugaacaaaguuuccucucauagaaaccucccaagauuguuccucuggagaaccaucaaccagagccugugcuguaguagagugugaacuguauugcuaaacaaagugaaaggcuucccuuuuuagauaguuauuuuaauuauuuuuuccuuucucuaucucucugaccacauauggcuugaagaauaaaauguggaauagagaaggagauguguaaauuucucaguggaacuaccaacacacuguaccuuaauuuucuguuguucaaaaugaggauaauacuaccuaucucacaauaguauggaaaaauugaaaaaaaguuuauuuguaaagaaaacaagaaauaauauuuccauaggaaaugagauaaugcuguuauguuaucuugccuucauuuuuauuucacuguuuaaauaguaucucucuuuaaaaaucuacacagaugguucacaggcaccagccagacccccuaaaccacgaccgcgcaggacugcaccagaaauucaccacagaaaaccccaugggccugaggcggcauuggaaaaugucgaugcaaaaauugcaaaacucaugggagaggguuaugccuuugaagaggugaagagagccuuagagauagcccagaauaaugucgaaguugcccggagcauccuccgagaauuugccuucccuccuccaguauccccacgucuaaaucuauagcagccagaacuguagacaccaaaauggaaagcaaucgauguauuccaagaguguggaaauaaagagaacugagauggaauucaagagagaagugucuccuccucguguagcagcuugagaagaggcuugggagugcagcuucucaaaggagaccgaugcuugcucaggaugucgacagcuguggcuuccuuguuuuugcuagccauauuuuuaaaucaggguugaacugacaaaaauaauuuaaagacguuuacuucccuugaacuuugaaccugugaaaugcuuuaccuuguuuacaguuuggcaaaguugcaguuuguucuuguuuuuaguuuaguuuuguuuugguguuuugauaccuguacuguguucuucacagacccuuuguagcguggucaggucugcuguaacauuucccaccaacucucuugcuguccacaucaacagcuaaaucauuuauucauauggaucucuaccauccccaugccuugcccagguccaguuccauuucucucauucacaagaugcuuugaagguucugauuuucaacugaucaaacuaaugcaaaaaaaaaaaaguauguauucuucacuacugaguuucuucuuuggaaaccaucacuauugagagaugggaaaaaccugaauguauaaagcauuuauuugucaauaaacugccuuuuguaagggguuuucacauaacauagaggagcuucccuuuuuuguuuaaguuuuguaaccuuuaauccuccauauucucaugucugucaucccaggggugucacaacuguaaaaaucuacaauauuagaaagcagcuacuacagauguggaagagagaacacuuguauaagacaaugcuguacugaaguuauauaacaagguccccugauacuuaugccugcauuacuuugagggaugcugaaugagaggaccaucucccugaaauauauuaauaauuuucagauaaaauuaugaacauaacauaccuuuucucaaguggaauuagaguucauuucccauuuaagugauuacacucuaucuccuaagagcugugggaaccaguucauauugcaguggaaacauuaacucuucguugcacuguugagugucaaggcuacuguggcaauguuuuuugcaaaguucucaguaauuuucucucugcaaucaaauuagaguucauauuuaauuugcagauucucucauucauugcuccacacugcuuuaucaaaucaggugaaagaaauuaauguaguuuugccuauuuuacaaaauggugguugguucuuuaaacaccauguuauuacucuuaauaaaucuacaaauauuuauugagcaucuaugauaugcuuggugcuguuaggcacuguguuuuuaaagcacaaacucucaaaagcugauuccagcguaauguuuuauuuuuguuuuucuguguuuuuuaugacaaagucugucugauagacaaagccuggaagguuucccccagggcuuuagaauuuagaauuagcugguuuucauuucaaaugggaaauuaauggagaaaugagauaaaaucaucucuguguaaaugcuugaacccacagaaaguuuucuaaauauggacuaauuguggguuugugcauauuucugugucuccucuuuucacuucacacccaccaugauauaaaaagaugcaucagagagugagccugccuucaggaccugaaaggacaugacugaacaucuaguagaucugguggaaauuaauguuauacaaaagacacguagacuaaguugacccugggagaggaguuaauacauuccuuugcaaagugacaugugcccuuuuuuugacagucuggcuuucaugguaugagaugaggacucacaggccuuggguaauuucugcuuuuguaugaauuuuuucagaugguucugagcugguuaugucccuggaggggaauuuuucauuugccuuagauguucuucccaugaguagguacaugagugaaguuucuuacacuuuuaaaauugcauuggcaaauuuucuuuugcuuuaugaaccccuguuuugucauuaugauuuuucacuuguuuuaacaguuucagaugucaccuuggaauagcacuguuuauuuuggccuuuuuaugauugcugaugauagguacagucuaaaggccaaaaguugccacuucauugugauaacauuguugcaacauuccuaauauauuagagaaugauguaaaauaagaauguuagagaacauagcacauucucauucaguuuauaaacaauauuugaaaauuuccagugagaauuaaaaaaggacuagugaugauauagcaaaccuggaccugaaauuugggggugggggguggggggauaucuguuuugcagagaaaauuuaccagccuccagcaaaaucucugcaucuuguacucaauagcaaccauuaguauugucauuuaaaaagaaugaaucaaaaauucauacguaauggaaugaaaagaggaaaacuuucuauuaaacacugucaagaaagacccauugcuaucuaucaccuaugaaauuaaaccuaaaaaaauuuuuuuuuauuguaaaagcgacugcucguugaugucuggaagugauccagacuuuguuucacugugauccaaaaaguuagacauuccuuccauuucucaagauuugguaacaauuuuuuuuuaagucagcauuucauauaauacauaaaauuaagacaaauuaacuuacugauauguggccaauaucaacccuucucacccaacccaaacauguucuggagauagaaggacuuauccucaauuauauuccaguaaauuuaucuccauaaucuguuuuauccccuaauguaugauauaucucaccaaauuuuucuagaauugaauaaaagcaguuuuugcuuaacuugaauuuccuuccacaaauacaaccuucagcucuucccucucuguuucccuuuugcccacauugcaaauagucuucauaauagaacccucacugcaacuuaaaagggucccauuucuuaacucagcauuucauauaccaagaacacuugcaaagauuucuucauaaugugauuuuuuaauuuuucaguuccagaagcauuuccuacaguucgaacguuauuuuuucucucagauuuucaacuugaagcuuugauuugcacugaauuaacuuggauaaaauuuuaguuucucucuucagcuaacagauuuggaagcaaauuacaguauacuugaauaauucagguacuaccuguugaccuggaauuuuagugauucugggaaaguuuuccagacaaagacaccaauagagugaaggguuuuuuccccaauuacuauuuuauuguuuuuuaaaaugccuuuuuaaaacuugugugauguggcaaaauagucauauguucaauuaauuuauauuuuauucauuccuuuucaauucugguuauuauguaaccucaaguacuuuaucuguucuuuuaaaguauuuuauaaaaugaacguuaacuaa

SEQ ID NO: 21309 - RNA, 39439 nt, Homo sapiens
uucucgcuaggcuuguugggucagcgcgauuggccggggcccgcgcgagccugcgagcgaggugcggcggucgcgaagggcaaccgagggggccgugaccaccgccuccccgcgacgccccaguccaguggccucgcguccgcccauucagcggagaccugcggagaggcggcggccgcggccuccgcaagccgguauggccacuggagacggggguugcgggcgcucuguccgaggaggccgggagacuaggaggcgcugggagggccucguucgaaccgcgcggcagcuggggucggaggcacugugggaaggggcuggagggaggagggggugggagggaggagggggugggagggaggacgaggccgggggggagggcgggcggggccuugcauggggggaggggaagggaggucgcggagggggaggggagagaggcaaccccuggcugcgguggccaggaggcgcgccuggggggcuccgggaggggagugcgccagcuaaugccuuggugcagccugccuccaagcguuuggauugagaggagaggggcuuugggagguuuggggcggccggcgcccaauacccgaaggagcucggaaggguguggaguggcgccuacgggaauaaguugauuggggucauagaaucggagccuaguuccuuggcuaagucagcgcuuaaucaagcgccggcuggaggcccagccugguuuauagugaugauucuagcuaacuuuaagaguuugcuuugcuggacacuacaguaaguauuuuggaugcacugucucauuuaaucaucacaaggauuccuccaaauucagauaugguuguuuucauuucgaaugugaugaaagugagccuuggaggacuuaagaucacauagcuaguagugagaaucuuuaccgucuugcugcacugccuuugaggcaggguuugaggccucuuggcauucuuuagaauaauuacagguugacuuggcuuaguauuucuugaaggaaacugcuccccucaggaggugcuuaagccacagccucugaaauugagcagggucuuacccuuagagguaguagaaccagaaguuuguccgccgaaccuagaaccugguucaggaggcaggcuuuuuauaugaccuugggcgugucagauuauucccagugcugagaaaaguguaccugguagaggguuauauuauacaaguuagaagccgagucauuucuggacuucagagggggcggggcaaggacaagaugggagaagagcuugucguagggcuccuacuggcaguucuaggaacuaguuaauaccagucucuacuuuggaagagaaaaugaguaccagaauucuguaugugaaguaauguuggguugggauuuccccuugaagggaaaguuuuguugcacacuuacuuuugagauacuuuuguguuuacucuggggagaugacugcaagagcaaacgacagcuuuaggaaagaagcacugguuccuggccacaagauguuuacagucaauaggaaacacaaaaagugaauuugcagguaaacacggcagauagaaaguauacgugacucaauuuuuuuuuuuuuuugagacggagucuggcucugucgcccaggcuguagugcaguggcgugaucccccagcucacugcaaccuccgccucccggguucaagcgauucuccugccucagucuccugaguaucugggauuacaggcgugcgccacgacaacuggcucauuuuuguauuuuuaguagagacaggguuucacccuguugaucggucuggucuuggacuccugaccucgugaucugcccgccucggccucccaaagugcugggauuacaggugugagccaccgugcccggcccucaaauuuuaaauccauugaaauugggcaacaaacccguaccccagucagaaggacauaccaucaauuaucuucaaagcuggaauuuuuuucuuaauuaggagugugucugauggaagucacuucuagcuacauaaagaagguacagugugaggggucggauguaaaaacugaucuauauuacagcuuucuucucccauaauuaaaaaauuuaaacaaagucuuuaaauucuauaugucaggcacuuuucuaggugcugcugggaauagauaguaccagcucacugaagcuaagcacugguuccuuuuacauuauugcugguuuacacuucuuguaggaaggagaagguaacaaauacauugauuuauugaaaggucuuuauuacucuuaggcugccagagcaagcaagauggaauauuuaccaucuuggugaaguaauuauacuuuagaguuggcacauaguagguauuuaauaaguaguuccugaauaccgaaagcauugcagaaggcauugcagaaggcgaagaguugguuguguggagauuucuguuaaucacugucuucacgagaaguccauugugagaacuggcagauaaaaagcuaacuguauucuuauuuugcauuaagauaagcauggcaucccuagaguggaaugcaguucacucuguucugcauugaccuuagaguguuauauuuaguuuuaaugacccauuucauugaagauuuauuaauaaaauaucuguugagagcauggugaggggucuagagauauuaauuuaaggacuaguuagauggaaggaccuagcguauuuauaugaagaauaguagggcauuaauauauaauauucauauaauaggauucaugaaaacuuuuuugaaguacuugaaggguugauauguugggggaguaggugagugcuuucacauaccccgaaagaauaaagaauaauugcagagaagugugguguuaaugaaauaacagauuuaagaggaggaagcagaaagcugcuaguaguaaggcgggaaguugaaacuagaauguggccaguaguaguuuguaggauaccuugaaaagucucaagagaucauuuucuuggggcaggaggaggaaggaguuaugcuuggaaaauguucagcgauuauagauaacauucaggaacaucuuggccuugagaagaagagauauuaauccauuauuuuucccuuuauuuaauagcuguugaaugacuguugucugcuaggcacuguuguagacucugggaauauggaaaacauaaucguuuacuuccuaccaucaaguggaaaagacaauaaaauguuauaaauuuuuaaugucugguaguguuaagugcuuugaagaaaaauaaagcaggauaagaagauaaugccaggggagccauuuuaaauuagaugguuaggaaagaucucucucaguuaacacuugauaaggaaucugaaucauaugagggguaucagaaagggucaagacaaagggaaaacuugaaguaugggaauagcaggggugagugaagaagagagguaggaaaugaaguuaaauacuuggccagggacuggaggccagaugauuuuauaggucuugcuuuuugggaugagaaugcauuggaagguuuugaacagaaugauacuagguuuuacuuaacaguguuaacucugguguucugagacuagauuaaaagugggcaaagguaaaaagcaggcagacugguuaggagucuuuuccagucauuuaggcaagugaugaugguggcuugaaucaaguugauagcagugaaggugcugaagugguuggaccccagaguuauuuuaaaggcaguggcaaccauauuuucuuggcaguuuggauguaagguuugagagagagagaucaaccaagauuuuuuugucuuauacaacucgaaggaagauaaagaagccucuaggagaggcagguuuuagguggaagaucaggaauuuauuuuuagauauauuaagaaaaaucuaaauggucaugucagaugaacaguuaaauaugagaaaaaauaauaguagacguaaaauaaaagcuuauuuuauuaucccuacaguaaaauaauguugccuccagaccauuuuaacauaaauaugguaacauggggauaaugaaucuuuuggaggcuagaguuucuuagcaucuaauaguagcuuugcucucaacuuuuacgguauguuuuguuguuuaauuaucaaaaccacuuuuaucagucuuucucuagaguuguauauauagaacauccuggaguccaccaugaacggacaguuggaucuaagugggaagcuaaucaucaaagcucaacuuggggaggauauucggcgaauuccuauucauaaugaagauauuacuuaugaugaauuagugcuaaugaugcaacgaguuuucagaggaaaacuucugaguaaugaugaaguaacaauaaaguauaaagaugaagguaagaguguuuuuaaagcuauuuuuuaaagucuuuuuaaaaaaaaaaaaaaaaagacagagccucuguugcccaggcuggaguacaguggugugaucauagcucagugucaccucaaacuccugggcucaagcaauccugccucggccucccaaagugcugggauuacaggcaugaacugccaugccugaccuuaaagucuuaaguauuguauguguuauuuugcccauuuuuauuggacucuuucccauccucucuucacgguaguugagaccucacuuucuuguauugaaugugauguuccuauaguuacuauaauucucucaucaguuaaaauuagcuaaguggggccgggcgcagcagcucaugccuguaaucccagcacuuugggagaccgagguaggcggaucauuugaggucaggaguucaagaucagccuggccaacauggcgaaacccugucucuacuaaaaauaccaaaaauuagcugggcgugguggugugcgccuguaaucccaacuacucgggaggaugaggcagagaauuacuugaacccgggagguggagcuuacauugagccaagaucgugccacugcacuccagccugggugacacagcaagacuccgucucaaaaaaaaaaaaauagcuaauugguuuauuagaagggaauuuuaaguguuagaacauuuucacauacauuuuuuuuacaagcauuauuuucuccuuuuguccauauaauucugguuucuuuuagcuuaaaaaaauuuuuuuucuauucuuauuucccgaaaugaaagguuuuaguauguauugaaugaaaaaggauuuuauggucaacuaaguaagggaaagcugguuuaaacaaagacaaaaguguuucuuuauuguaggaguuuucagauuauguaauaugcuuauauacauuuucagaaguuaguaguaugcaguguucccagacucauuuguugacaaaauuaucuuuauggaaauagguuuugaaugaaaaauguuucggcaaacacacugaguagaauuauaguaguagacuguauuuccuauucuucaaccugccuucuuuguuaauaucucugcugaaauuuucucuuuaggugguuaccaguguuuuuuacuguggaacuuacuugcaguguauuuaaucuugaccucacuguuuagcacugcuacccacaccauccuuguuuuuaaauacuuuuaccucuuaacaucucugacacugcuuaaccuaguuuucuuaucacuaacaguuuuuucucugucuguguuaggguugggcuuaaaguaaugccagcagauauaauagaaaucuuaaaaucugagugguuuaauaguugagaaaucuuucagggauccagguugaaagaagcuguuaccuucaacacauggcuuauaagcucaccauaggcauugacauuggcaagcagaugagugaagacagaguaugaagaaucauaugggagauuuuacucacuaggccugaugguguuguaugucauuucugcccuuaugacauuggucaguacccaguuacauggcuuugcuaagaugcaaauggguugggaaguauagucccuggcugagcagccacuuagcacaacuuauacuguggaggagaaguguaaaucacuggugaucaguuaaauugaccaucuagcuaaagguauaauucuccuuuguuuuugugauguguagucuaagaauacccaaaacaaauuuuugagaguugcccauguuaagaaacaauaaaggauaguacuuuuuuccuguuuucuuaugcuuaucauacauugauuugcaccucugugacuuugaaaugugugucuuaauuugaucagugaauuuuuuuuuuuuuugagacagggucucacucucauccaggcuacagugcaguggcaugauuauagcucaucauaaccuuuaacuccuguccccaggcaauacugccaacccggccucccaaaggcauaagccaccaugcccagccuacaauucagauuuuuaacuuuuuuuuuuuuuuagcaaagucccaagaguacuuuuuuuuuuaaauuuuguuuuaauugacaaauaauaauuguacauauuuaugggguacauaguaauguuucauuacauauaaugggauuagaucaggguaauucgcauauccaucaccucaaauauuuauuucuuuggguuagaaacauucaauauucuccuucuagcuauuugaaauuauauaauauguuauuguuaacuguagucauccuauagugcuauagaacacuggaacuacuucuaucuaguuguacuuuugugucuuuuaauaaaucucucccuaucccucuuuuccccuacccuuugcagccucuacugucaucuguucugcuuuuuacuuguauaagaucaacuuuuuuuagcuuccacauaugagagagagcaugugguaucuuuuuaacuuaaugucuuccaguuccauccauguugcugugaaugacaggacuucauucuuuuuuauggcugaauuguauuccauuguguauauauaccauauuuucuuuaucaguuaaucuguuguuagacacuuagguugauuccauaucuugacuauugugaauagugcugcaguaaaaugugagugcagauuucucuucaauauacugguuuccuuuccuuuaguuaaauauucaguaguggcaucgcugaauuguguguuaguucgauuuauaguuuuuugaggaaccuucauacuguucucccuaguggcuguacuguugacauuccuaccaauaauguguaagaguucccuuuucucuucauucuugccagcauuuguuauuuaucuuuuugauaauaaccauccuaacuggggugaaccuuguuguggucuucauuuuccugauaugugugcauuucccugaugauuugugauuuugagcauuuuuucauauauuuauugaccauuucuaugucuuuuuuugagaaaugucuguucagaucauuugccgauuuuaaaaucggauugauuguuuuuuagcuguugagauguuugaguuccuucuauauucugaauauucauccucugccagaugaguaguuguauuuccucccauucuguaaguucucuuuucacucuugauuguuuccuuugcugugcagaaaaguuuuccaguuugagauaaucauauuuauuuuugcuuuuauugacugcacuuuugaggucuuauucaugaaaucuuuucccgaccuauuaaagagguuauccuuuuccuaaugaguggucuugucaaaagucaguuggcuauagauaacauggauuauguucuuuuguucuauguguucuauugaucuauguguuuguucucuuggucaaugggucuguuuuuaugucaguucuguuggucuguggguccguuuuugugccaguccaugcuuauuacagcuuuguaguauauuuugaggucaguaagugugacaccuucagcuuuguucuuugcucaguauugcuuugacugucugggguuguauguaguucuguacaaauuuuaugguuuguuuuuaaauuuuuaugaauaauuuuauugguaguuugauagggauugaauugaaucuguaaauugcuuugaguaauuuugucauuuuaacaauauuuguucuuauauaagcaugggaugucauuacauauguaugcucuuugguuucuuucaucaguguuuuuuuuuuuuuuuguagagguuuuucaucuucuugguuaaacugcuuccuagauauuuaaaaaaauuuuuguagcugugguuaaugggauugcauuuuuuauuuuuuauuguauguguauagaaacacuacuuauuuuuguguacuuauuuuguuucuggcagcuuuauugaauucauuuauugguucuaaggguuuugguagaguuuuuagguuuuuguuuauauaagauuaugucaucugcaaacagggacaguuugcuuccuucccaauuuggauaccuuuuauuuuuuucucuugcauaauugcucuggcuaguacuugcuuaacugucuuuuuuuuauuuuuuauuuuuuugucuugagacagggucuugcucugucucccaagcuggagcgcaguggugugaucauggcucauugaagccuugaacuccugggcucaagcaguccuugcaacucagccucccguguagcugggacugcaggcaugugccacugcacucagcuucuuauucuuaauguuuaucaaaaugggggucucacuguguugcccaggcugguccugaacuccugggcucaagcgauccuccugccuuggccugccaaaguacugagauuacaggcaugagccagugugccuggccuuuaacugccuuuuuucccacuugaagaugcuuugccuuuaucucaaacugaccucauugacuggcuuucucuuaacuacuguuuagggcaaaggucagcaaacauuuucuuuaauagaucagagagaauaaauauuguagcuuugugggucacauaaggccucugucucaucuuuuuuuuacaauguaaaaaccauuuuucauucacagaccuauaacaacacagggauuuuguccguuggucacaguucauggacccuuagcuugagguguccucguuguaguuugucuuccacauuuaguuacaacuuuguauuucaugguuuuuuuuuuuuuuuuuuuuuuuuuugagacaaagucuugcuuugucguuuaggcuggaguacaguggggugaucuuggcucacugcagccuccacaucccagguucaagugauucuccugccucggccucccaaguagcuggaauuauaggcacacaccaccacacucggcugauuuuuguauuuuuaguagagacggaguuucuccauguuggccaggcuggucucgaacuccugaccucaggugauccgcccaccucagccucccaaacugcugggauuacaggugugagccaccgcacuuggccaaaaaguuuuugauuguuuugauuuguguccguuagauucuguuaguagaguggagggauggcuuagguaaaguuccugccaucagagauacucuguuucuguuguaggauucagaaaagaaaaaaagaacaggaaguuuucuucuuuuacauacauacuuuauuuucuuuaaaaaauguguuuaugaaaauugaacauuaaacaaguauguuaugggaagugggucuggcuauaaggagcuaaaaacaguuauaaaauucucaguuuugucaucuuugcccaaaauaaauccaacuaauuaguguuaaaguaggugcagcagagcaucccagaaguagucuuguggccuccccaggacagaacuccuccccacccaacuguuugugaagacacccugcagaggucccugaugaacuccuugucucuggcugcuuuucuguucuugcuuucuuuagagaauguauuuuucccuuagcccuuugaaagcuuuugagacacacaguugguaugccaauuauagcauucuuuaucccugagaucugggggauuucacggucauaaauacacacuguuuugaauauauaaauauuuuucuggggagaguugauuguuuucaucuuaauaucaaaauggucagugaccugaaagaauuuacugucuauccauucauuaaagcaguuuugcaacaguaguguuuuacucuaccuaugauuaagauuugaacuuugggaaacuuuuuuauuucuugguaaaagauguaaauuuuuuggaaugaaaagauuucagucuaaaccaacaauuuaugauauugcucucuaugaaucucuuacuagugacuaauaaauauuaaggcacuuaauggauucacuuuagcuguauuuuuucauguggauauguguaaauaccuugccauaagaguaauaagcaaaauugauuuaguauauuuuugaacaaaugcauuuuugcuagaccuuuaaaguuuaagguuucuaugggagaguccaacuauguucuacaaucuacauuuuggauuuuuaauuuuuacuaguuuacugcuuauacaaaucugaaaauuuaaaaaauuaaaaaacaaccuuuuuuuuuuuuaaauuccagauggagaucuuauaacaauuuuugauaguucugaccuuuccuuugcaauucagugcaguaggauacugaaacugacauuauuuggugaguaguaaacuuucuaaugaauuuacuauuuuauucauuguauuuuaaagauguuuggcuuuuuuccuuuuaaagacucagguaagcaauaacuuauucaaauauuauuacauuuauuuguguucagguaguuguuuuagauuacuugaagcuuauggcuguguauguuuuuaagaaaaugauagaaguuuaauucaguaagaacagaguguuaaguauguuuuuuuugaaaucagguauaacuuagguaucccuggugcaguauuauaguuuuaauuuagcuguauuagaauuuuuaaauuguaauuaucuuccuucacauuacaguauguuguuacuuauuaucagggcuuaacauguaagucugauacuugaaaccaguagucgccaaccuuuuugcacuggaaacugguuucguguaagacaguucuucuauggaagggggcaggagaagguuuggggaugaaacucuuccacuuugcaugugcaauucacaauaggguucacacuccuaugugaaucuaaugccacugcugaacugacaggaggcggagcccaccacuuaaccuccugcugugcugcccagcccgguuugguuccuaacaggccacagaguagcacuggguuggggacccuugcuuuagacaguauuucccgagggguacuuaaagauuaaaaauaguucugauaaaaaccaauagaagacuaauuuuaaucuuuuagauuuuuucuuuuagaucuuaauagauaugcaaggcagaacucuuaagggacaagauagaaaagauuacagaguuaaaugguagugugauuaugugaaaaauaaaauguguacacuuuuuccggcuguuuuguuguuuuguuuagcauuaauuuuauuuuuuuuuaauuuuguugcaugaaacuuagaguucagugugaaauaugaucauggucuauugauuuaauuuguaucuauuucaucuccaucuaggaaggaugaauaugaauaaucagaauuuaaauguuaauaacaaaaacuguuuaaaauuauuuaaaauaaagguaucuuuuuacaguauugaauguaaaauacuuaacuauugacuaggcauaaagcagauuagauaaucugaagacccuuacuuuaaacaggaucugcuagauaaacuuacaaauguguuuucugaauucuguaacucagcuugcacaggaaaguaagggaaauauccagggaacaaaaaaguagagggaacuaaaggccugauguaccaaaagcugaaacuugggguguucuugguggugauaguagagauuuuagccugcauaauuuaaggaauugccaucuggugucuacaugguguaggcccuugguccuagucccucaguaggccaugcuuucaaaaagaauauuuuagaaaagucuaccuugauacagggaaagucaaggaagcuuaacucuuauaccuugggccgucaggggcuugggaagucucccuucaggauucauaauugugguccuuaggugaguuggguuuaaauuuaaacuauccauguaguuugguaacucccaagcccagauguuaccauuuuagaaaaaucucagaagaaaggccaaaaucucucuugagggguauauucucaauccaggucacauagguuucucacagacaaaaccguaagacacaugaagcugucagguaagcaagaaccacuggacacaacuaauagcaggauuagauuuucaacaacuucaguuaagauaugugauagucuacaaaauuaaaaguuauuuaagacauagaagaaggaauaagaauauaaaagcagccggccgugguggcucacgccuguaauuccagcacuuugggaggccaaggcgggcggauugccugagugcaggaguucgcgaccagccugagcaacacgguaaaacccuaucucuacugaaaugcaaaaaauuagccagcuguaguggugugugccuguagucccagcuacuugagaggcugaggcaggagaauugcuugaaccugggagguggagguugcagugagucgagaucgcgccacugcacuccagccugggugacagagugagacuccaucucagaaaaaacaaaacaaaacgagaacauaagagcaagaugcuauuguauuauggaaaaacaauaaacagauuuuauaaagaacuuaaaguaacuuggaaaugagaaauauaaucauugaaauuaaauacuaaguggauagguuaaacacauuagucauagcuaaaaagagaauuagugaacugaaaaggaaauccaaagaaauuacagaguaaagcacaaaaacacaggcaaaagagaaguugaaaaugagaacauccagaauauuucuauucagaguuucaagaaggagagaaugggagaguggaaauacauugagguaaugacuaaagaaauuuucagaguuauauaaaagcuauagacccucagauucagaaggcacggggagccuugagcagggauaaguaaaaguaaauccccacuggacauauugucaugaaacuggaaaaugucuuaagacagagagauuaccuuaaaaguagccagagagaauaagacugaucacauaugaaacaauuagacuguuaguagacuucuucauaguaauaauagaggcuaaaagacaguauuaucacaguugcaaacaguaaagaaaaauaacuagaaaaguagcauccuauacuccacuaaauuucacgaaugaggagaaguaaaaauacuuugaaagacugagaauuuaccacucauggacccuuguuaaaauaauuuuuaacaguggucuucaucaagaaggaaauuuaguccagaagguggugaaagaugcaagaagcaaugugagcagauaaacuguugcuuggucaguaggcuaugcuuucaaaaacuauuuuagaaaagcuuuuccauugauacagaaaaagucaaggaagcuuaacucuuaaaccuugggcugucaggggauugggaagcaccaaugaaauuuauguguacguuuuaaugagcauugauuguuacaaaauuaauagucuuagggaauaaaaacaauuugggacaaaaauacugggcaauaauauguaagaaaggaagggaugauaggaauaaaaauauuuuaaggacuuauuugggaggaacauuguaauuaccuuuagauuuuuuuaauugcauacuacauaugcagaaguaugcaugguguacauguaagaguuauaauugaaaaauuagacauugucaggaaaggagaaaaaaagaaaacaaggguaccuguucaguucaguagaaagugguggcggaauaaaagagguagaaagcucaauagauagaacagaauacuaaucacaguacacagaaauugacuacauauaucgguuaaaauaaucucuuaauggaauuuuaaaaaaaauccaguuccaugcuacuuccaagagacauaaaagauuauuaugcaaagcuugaaaguaaagggcuaggaaaagagacuagacaaaugcaaagaaagcugguuauuaacagaauagacuuauauaaaaacuugaguaguaauagucacuuuaugaugauaaaaagaauaauucacuaggacuauauagcaaucugaacacuuaugcauguuagcuuuagauguuuuccccuaagaaaaauugacagaacaaagagaaaucaauaaauuuacaauuaugggagagccgauaaaucaagcaggcucaaacagcguuggucuuguacaucuagcaguuagggagaaauacaguuuuuuuuuuuuucgaguacucauagugcauuauagaaguugacuguaagucaagucuuccagaaaaucccaaaauguaacagauaauuagauaucuuaaaggucauauucucuggcuucuuuagagacuauuggacagaauauguaacccaaauuucccuacuuuuggagacaaaauaugguuuuaaauaagucaaagaagaaauaauaaugggaauuauaaauaaguagauaaugacuucuauguaaccaaguuuuuagagaaugcuaaagcuguacuuagaguaguacuuacagccuuaaauacuuuauauuaguaaacuggauuggaaauuuuugagcaagguauucaaacaguuacaaaaggacaaaccucaaauaacuuggaaggaaauaauaagagcagacgugaacuagaaauuggaauuguuaggaucaacaauuuugaaaagaugcaguuggcaaaucuuuaugaggauuaguuaaggagaaacaaggcacaaauaagcaauguuagaaaugaaguuuauaguagaaacuuuaaaaauuuauauauaccaugaauuccuuuauuuaaauuugaaaacucaggugacauggacaguauccuagguaaauuuaauguacuguuucaagaaguagaaaaauugguugccccaauuaacauuaaagaaauugggccaacuauuuuaccaaauaucuaaggaacagaugauucuaaauuauacaaacuauucaagagcauaggcaaagagggaauauacacuaauucauuuugugggguuaauauaacauuaacaugaaaaccagccaaggaaaaugcaaaccagugucacguaugaacauagauagaaaauauuaaguaauauuuacaaaucaaacucaucagugaauauuuaaacacaccagugucaaaauugcucacccaaggagucuaagauugcuuuaaauuagaaaaucacauacuauuuuccauaaaacagauuaaaggagaaaaacuagaucaucucuagauaaagaaaagccauucauaucucaaucauguugaaaagucguagcaaacuaugaauaaaagggaauucuuuuuugugaggcagagucucucacuguugcccaggcuggagggcaguggugcgaucucagcucacugcaagcuccgccuccggggcucaccccauucucccaucucagcuucccgaguagcugggacuacaggcaccugccaccacgcccggcuaauuuguuuuuguauuuuuaguagagacgggguuucaccguguuagccaggauggucucgaucuccugaccuugugaucugccugccucggccucccaaagugcagggauuacagauaugagccaccacgccuggccaaaagggaauucuuuuaccucauaugggggcauuuauuacguagaacaacugcuguaugccuaauauaaaaggauuauaaauguaacuaaaauaccuauuauaauuauauacaacaaaagauacuugggauaaaucuaacauggcaagauuguuuuggaugaaacauaaaauuuuuuaaaaucaaguaggggaauggguuuugaggaaagguacucugggagauuuaauuaugucuaugcuguuucauuucuuagugguuaggagcaaagaugaaaaaaauacuaagauuuggccaggugcgguggcucacaccuguaaucccagcacuuugggaggccgaagugggcagaucacgaggucaggaguucgagaccagccuggccaacauggcgaaacuccgucucuaccaaaaauacaaaaaaaaaaaaaaaaaaaaaaauuagcuggguguaguggugcgugccuguaauccagccacuugggaggcugagacaugagaauugcugaaccugggaggcagagguugcagugagccaagaucaggccacugcauuacagucugggugacagagcaagacucugucucaaaaaaaauauaaauacauauuaagcuuuaacaaagauggguguuuaguaaguuuaucuuguugugugcuugaaaugguucauuaaagucuuaugauuauauucacacuaaugaagauacauuauuaugugugcuaggguucuccagagggauggaaccaauaagauacaugggaguuuuuuagggagaauugcaaggugauuacaaggcgaaguccggugauaggccaucugcaagcuggggaaagagagaagcugaugcugauaguggcucaguggcucaguccaaguccaaaagccugaaaaccagggaagcugauagugcagccuuugucuguugccaaaggccugagaguccccugggaagcugcugguacaagcccuggaguccaaaggccaaaaaaccuggagucugauguccaagggcaggaggaguggaagcaagcaucuggcauaggagggagagcgagcuaaagacccagcaagcaaacuuauccuaccuucuucugccuguuuugugauagcugcacuggcagcugauuggguggugcccaccaacacugaagaugggucuuccucuucugguucacugacucaaaugucaguguccucuggcaacacccucacagacacacccagaaacaguacuuuaccagccaucuaggcauuccucacucuaaucaagcugacaccuaauauuaacuuaauuaauuuaaacuuagcuaauuuaaacuuuuaauugaguauaauuuggagcuuagugcucuuaaacccacugaguagauaauaacagauuauaggccauacuaggaauguaaaugcaagguucuuaaaaguucugguaagauguaucagugugcuccaaagaccaccaggaacacaccuguaguugaaugaaguuggguuuacugacuuacugcagcaagggagaaugaauaccacggagaacaauaggaugucuuacaaguauguuagaaaaguauuuuuuuuugggcuuggguuuguguuaccugauuuuggauaagguucaaggaaguagagcuuugcucugcauuggaugcucucaggaaguagagaugauucuauguuuggguaucuuaucaaaucuuaucuagaaggugagaggaaugaaucuuacuaaaucuuaucuggaaggugagaggaaugaauugaggcuaaagcugcaguugguaaaguaguagcaguuacucauauuagccaggauaaaagguuguuuggucauuuuucugguguggucaguguucuuguuuuugucuggaguuuugacaugguuauggacuguugaucuaucacagauuauagucuugugugauguugguguucuuugaaauauuuauauucaacgggagaacaccacagccuaccugugagugccaggccagcuuccagcaacacuaaggccugucuuacuguaccagaccaguuucuggcugcuaggagcuguuuuucucaucaaauauuggagaaaaaacaguaauaccaagugaaaaccaauaauugauguagguaggagauuguauugaacuucauagcuaugcagggaguaugugaauuacugugaguuuucuucuaaaagcuuauaauuggugguuugauuuugaaacauguuuaacaaagaaucgcccugaacuuuuauuuucacguagauguccuuuucuaauuaggugcuucaggaguuuguauguauguauacuggcaaugugcaaagcauuuuaguuuaauuuuugaacgccugucuugggguuugcaaucagagccuugugucacuuucuuuuuaaaaauaaccugaguggugacaguguuuguugcugaaugaaggauuucauuuuuuucagucaacugaaaaucauuuggacaaaaugaauaauaagugaaguaauguugcuuucauuaaaaaaucacaacuagagauuaccgaguaaucucuggcauuuuguggcuuauauacuguuucuggaaguaacugcuuugaaggacagucaugauguagauaaguucugcauauauuuuuaaauuuauauuuauuuuuuaaaauuuuuugagacaaggucucccucugucauccaggcuggagugcaguggagugaucucagccaacuggacuuccccucccgggaucaagcaauccucccaccccagccuccugaguagcugggacugcaggcaugugcugccacacuuggcuaauuuuuuaagguuuuuguagagaugaagucucacuguauugcucagguuuuucuugaacuccugggcucaagcaguucucccuccuuggcuucccaaaguggugggauuacaggugugagccaccaugccuggcccugcauauauuuuuuuaacgauuucuuuuaagaucagcuauuuuaguuagcuguuuuuuuucaagacaaaguuaugcaagagggauaacagaccuaucagucauguuauaucuuuaaacauguauagaguaagguauuuuuguauuauuuuaagaauagcgugaaauaaaaugagcuuuuuaaguuauauaauuuuuauuaaauuuaauaauuucuauuaaauuuaauaaauauuuaagaacagcaugaaauaaagugagcuuuugaaguuaugauuuuuauuaaauuuaaucauuucuauuaaaaaguagagcucggauuuuccuaccaaaccuuuuuaccaguaaggucauaggcuauagguauggcaucaagaaagacugauaauucugcuuuuuuuccaaaauaaguuauuagccauagagaauucuuuuuuuuuaaaaaaaaaguuacuccauuacauugauaucuuguuuuuguuuuuuuaaaggaauuguauuuauuuuuccuuguugcauauuauuaguauacuuauucaugaacuucuaauuuuaagcaaauaaauguuuuuauuucaguuaauggccagccaagaccccuugaaucaagucaggugaaauaucuccgucgagaacugauagaacuucgaaauaaagugaaucguuuauuggauagcuuggaaccaccuggagaaccaggaccuuccaccaauauuccugaaaaugguaaacccugaauccauuguauucugacuuauuguucuuacgucuuuuuggagguuuuaaaaaacucuuuuuaaguaggagaaggauggcauccccaaugucacucuuguuucuuccucugccucucuacuaguauuuaugucuguguuccuaaacuuugcuguucaucagaauuacuaggagguuucauuauaccaauuucuggaucucaucauagaccuacuggagcguagcaccuggaaaucccauuuuuaaaguguuuuuugggugauucuuucgcaacuagucuuagacuuuuggauuuguuacacaggucaguuuucaaauccuuuugacacaugaacccuuuuuaguauaauagauaaguaaugaaccuugggaauugaaaaucauuucaugaauaauuacauaguguuggaaguauuuucaacuaaaaaucacuuagauuaguaauguucauuaaaaaugguauguuguaaauuugaaacacaguuuuuaauaauaauuaaagaaaaacuaauuuuuuccccauuguauaaugacauguacuguuuguguuaagauaaagcaaaaugugucaacauuuggaacugacauaauuuugggaccgaauguauuuuaaaauguggacugaccuuuaaguauguguuaaugacuugaaaguacaguuaaaaaacugcuuucuucuuuuaagauucuuagauguugcauuuaaagaaaacucuuauuauuauuuuuuucuuuuuacaaauucuuuguuugcuuauaauuuucauaguuuaaaacuguccauauugugaaauaguaauuuaaaaaaagucuagacuggaugacugcauauaaagggcuuaacaugagauaauuuuuguggauaaaugguauguauucuauuuuuggccacuaaauauuuuggaaguuuuuguuuucuauuuuuauuuuaguuacaguuuaaauaaagauguauuuuccaucauuucucucuuccugucuucuaauagucauauggaauuauguuaaugauagauguuuaauaaauauuuggugauugauuauuccuaguugcacuucuauuucagaacauaauggagauuugcugaauacuauaaugagauccucuuggucacuuuaugaugaaaccuuuuauauuucaggucaaagaagguugccuauucugagcccuaccucuccaaacaaaaauuuccaauuuuagaucaagaaucaaugaaaaaguuagacaauuuuuccagaagaauucauagaugcugacacaacauuugcauauaauuucaggggauuuaaccaucugcagaauauuaagaaguguagaugagaauuuaaccaguauagccaauacuguucagaaauuagcuacaguggcccacauucuacucuaaggaauggauuuaugaguuuuuugcuuuaggugaaacuuuuuccucaccucuuucuugcuacuguuuauacuuuauucuuugugucuauauuuuuuauacauacuguuagcuuuuuaccuauguuaauguaaaagguguuaaaauugguuucuucucugcauuuuggaaaucaugccauauguuguuuucuuguauggccauuuucuaguuauuguguccugucugacauaucugaugauaagaugauauaagaauaauacaaucugcauuauauuuuuagagauaguucuuauuuuuuuagaaaacaaaaacaacaagaaaaccauacaucagaaacugaaaucuaguccacaaaaugaaauugccaaucagcuaucagugcuauuuagaaccuguggcuuacccucaccaagaaauguggccaccuguggucuucagcucucuauuacagcgguucuuggaugcuuguuuuccuuuaagaggcaaaugauguguaaacuaccuuagauagaagauugaccuguugcaguaucuccagcagcuaauggagcaaguaguaggacguauaguauguuuccugaugguuuuaguuugugauaagugaaaagaggcauagguagugagaugugaggggaaacaacuuguaagacugacgugguaugcucuugggauuagaggaaggaaguugguagggaagauagauaacugguagacauguuuuaaaggaauacuucuaguaguaguuuucuuuuuccaaacauuuagaaaauauuaggguagccuggaaugguauguuaggaaugaaugagcugccagccagugugugcuguggguacuuauauucgguuuagcacuuaacauuuuuuucagaagauacauuuuguauugauuacaggggugaucuaagaacugauguucauuuacuugcuugguaacaaaagugauaaucauugucccuuaauugaguaaaugguuagcaacagucuuuuuguuuacuuguucguguuuuuuguuuguuucuuuugaugucuuuuguaucuuggacuuggauuccuauuuguaaaauguauguuaaaauucuugaacucuuuuucuuucacaagacaguaguauaaaugccuguggaauaucuuaguauccugagaagaaaagcaugauuuuaaauuuaaccugcucauaauauuugacauuuuguuuuucuguuguuguuuuaaacauuuuauuauagaaaaguuuaaguauauaagaaaguagacauuauaaugaaucccagaaacccacauccaguuucaacaguuaccaacuuauaguaucauauaauuacacuauacacauuuccgccccuccuguuacccagaguggaguacaaucucagcucacuacaaacuuugccuccuggguucaagugauucucgugacucagccuccugaguagcugggauuacaggcaugcaucacugugccuagcuaauuuuuguauuuuugguagagauuggguuuugccaggcuggucucgagcuccugaccucaagugaucuacccaccucggccucucaaagugcuggaauuacaggcaugagcuguugcacccggcuccccuccuguauuauuuugaugcagaucccauauacaucauuucaucuguaagcauuuuaauaaguauuuuaauaaguaauacauauuaaaauagaagguagcaaauucaaaaauguuuuuaaugugcuauuuauggaagauuaugaauuaauuaugguuggcuugauuuccauguaauuuaauaguggaccaguagacaguagaaauaaaauguaaaauuugagauuauaaccuuaguucaguuucuuuuuauaaaauaaagccuuaguuccuauaauuauuuuuuccagagugcccaguggguaucugauacuaggauauagguuauugggcuccaaaaaaaccaaaaaaaguaaaauguuucucuuuaucaaggagcuuguauuuuuuucaucuaauguuucuuacaaaaggagguaaauaauuuuuuuggaaagcuuuuguucaucuucuguuucuuuuugcccucuucucccuguuacuagaaggaaaaauauaaaaaaaauaaaggaauuaaaaugaucuguaauccuauauuccgacaugcuuaacauuccagacuaucauuauacaccugcauuauuucccuuguacuuuuaggccuuacugaauauagauaaaaaggaaacaaguuuuuguuuauuccucuauuuuuacagauacuguggaugguagggaagaaaagucugcuucugauucuucuggaaaacagucuacucagguuauggcagcaaguaugucugcuuuugauccuuuaaaaaaccaagaugaaaucaauaaaaauguuaugucagcguuuggcuuaacagaugaucagguuucagguaaguugguuuccaacuccuuuacacccuucguuuccuucaucuuuccguucuucccuuuccuucuuucuuuaauugaagaauaacuuggauauggugaagugcacaaaucuuaaggguucugcuuaacaaauuuuuacauauguguacacuuauguaaaagacuaacuagauuaagauguagaugauuuccagcacuucagaaagcuuucuuauguccucuccccaagaguagcacccucccccuuaaagaauaagcacuguuggguucaaguaaauuuuugaaaguaaaauuuagaaaguuuuuaaaaaucugaacuauuuuauaauuugauuaguugcaguauucgaauuauauuugauuugucuuaucuccucaucuuagagaaauugaaaauuaaauguagauuuucuuguuaaauugcuugaguauacaguggguuuuuauauaaauaaguuuuuaaccuuaaagcaguaccuauauuguuuuauucuguuuaacuuuugguuauaauuucuucauuauuuuuuccugcuuuuucucuuuucggauucuaauaacacauacauuggagagcuugauacugucucaugggucauuaagguucauuuuucuucagucuucucucuguucuucagguugggugauuucuguugaacucuucaaggucgcugugauuucuaauaugcuguggaaccuuucuagugaauuguuuaauugugcuuucagcucuagaauuuccauuggguuuuuauaguuucuguuuuucuguugagauucuuuauuuuacauucauuaagucuauauuuuccuuuaauuguuugaauguauuuauguuugauucuuuaaaaauauuuagcugcuuuaaaauguuuaucugcaauauguaacacuuggacccauuuggagucaguuucuauugacuggguuccucucccccacacacacuccccccaacuccaguagggucacauuuuucuguuucuuugccugucugauaguguuugguugaaaacuagacauucugguuaauauguuguagugacuuggacuuauauucuuuugaggauuuucuguuauuguugaucuagcagggaguugauuuguauggacuuaacauaaauaacaaacagaaaagcgcucucuaaaagaaaaagguauuugggaauagagcauugcauugaaaauaugcaugccauaguaaacuaugugcauauucagugagguaaaggcagacaaagguuuuuaaaggaaaaaaugaggagaauauauaauuguuuugaaauaauuauuguuggcuacaaagaucauuagcaagagugaugccagucugagguuggacaggcaguuucugggcagauguccucacagucacagaaguuuuuuuuuuugcuuuuuuuuuugcaaaguugugauggccuuuguguaggcuugugguuuuugaacucuuuugugauaguuuuugcaagaauccucucuucauggccuuaucagaguuuuuaauuuuuuuuuaacauuaaugacuucauuuugguuuugauaacuuucacauacucaaaacugcuccuucuuucucccuaugguguauagcagcugauauguaugcucaguccuuucagcuugcucuaggugcugcauuuuucucugagccuucuugagauauccucgucugcucucccagcccuauagucagcuggggauuuggacagaguguauauaccuagaucgugggucuuacccuuucaguagcaccuucacuuccgggauuuuccuccuaaaucuucagcugcuugucuagccauaagguuguuaacacugugguuuucugccauuggagcugcagaggucagcgcuuuuaauucuuauccauucuaauuuuauugggguaaacuccucugguuucugauugacuuucaguuauuucaaauaguuucuuuuguuuuguucauguuuuuaguuguuaccugggagagaguuuaucugauggauuuacuuugccuuuaucaguaguuggaaauguguacaguccauuuuguauuucuuagagacuuucauggaauuacucacaaaagagaauugugugaaaauuugaugaggucagacuuuuaaauuuugauuuaaauguaguauauuccagacuagaauaauauuaauaugauucacauuauuugaagaccauuuuucucacagcuuuguauguugaauuauaguaggaaaaacuguaugcauagcuaggauacuuuuguaguucuucaggugugaugugguaaaaauguggcuuauuagaauaaugaauguggcagugggaaggagggauaaaauauuacaaacauggaaugaauauuaacuguaauaaauuacauauaagggaggaaagaggagccaaaguaauaaauauauauauuuaggcuaauaacagugucuuuugugggaagaauguguguauuuaucuacauagauauaaauuuaaguaaaauggugguagauagaaaccaucauccauuuuauuuuggcaaucaucagucucucuugcauuaccacuauuauauccuaguuuagguucuuauuaauacuuggacugucagcugucaacugugccuaauacugugguaaguucuggggauacaucagagcagaagauagagguuugcccuuagagaaauuagucugcugauaauagcaaguacuuauauggaacuuucugaguaguagucacuuuuauaagcuuuugcuguauaauuccuuuuauaagcccaugcuauaagcucuuguaaacucauaauccucacaauaaccuuaucaaguaggaauuaguauauccuuuguacagaugaggaaacugaggcacagaaagagauuauguaacauguccagaguuacacagcuagugagugacagcacuaggauuugaaccuggguagucuagcuccaaaaccuaugcuuuuaaccacucuucugcauugccaaagcagaaagaauuuaaaggaauaagacauauuuacauuguccucagaauaucuuuuuugacugucacagcauuggaacuguaauauauucucuccauucauuucuguguucauuauuuuguaagaauuauaguggcuccauauguaaguuagagugcuaggccuuguucggcagacaaaaagaaucaacagucaggagcccggccaaaagagugcagagucuuuaagagggaaagugagagcuauucagaaaugcaaaguagaagucaguaugaguuaacaaaaguaaacuagauagaaguucacuaguagaaaaaguauucaugagucaagaaggcuuacuagaaguguggaauuauaauuggauuuuaaauaauguuauauuuaaauaugugaauguuauauuuaaauauaugggaucuagugggagagaaauagaggucaaaaaaauauuagcuauguuaugggaguagggagaagguuaguuuagcugaaagggaggcaugugagaagagaaauugugagaaauaauguuuggacccuuaaugccaaacuaggagguugaacuuaauuuauggucagugaagaccccuugaagaaugaagugacaauuuugguuccugugcagaauacauugcuuggaguagggggauauuggcauugcagacaugaguuuugauuuuugcagggagagguuaagacucaggaauauaguacucuacacuuuauaaggaaggaguuccaguuguagcuuuggauuaagagauuggagcaaaggaaaaaauaaaguacauacauuuaauguaaaaaggcguauuugugguuauauacuuauucuauaguacuuuuaguaucuuuuaaccaaacuuauuccuugagcuugcugggggaaggccuuguguuggauacuaaacugacuuuuuuuugacuauccagggccacccagugcuccugcagaagaucguucaggaacacccgacagcauugcuuccuccuccucagcagcucacccaccaggcguucagccacagcagccaccauauacaggagcucagacucaagcaggucagauugaagguaaaauagaguuuagaacacauguuugggaaaguacauguguagaaguguuuauuacagcauuguuguaaacacuucauguauuuagucaugccuuaaacacaggaaaaauuuugauuuacugacaugauuugauguuaaaaaaccaaauagaacaauaugucagguauguuuccaauuauuggaaugaaaaaaauaccucaaaaaaguguuucuaugaauauagauacagagugaaagaccagucauuagucaguggugacccuuggaggggaggauagugaaguucagacuggugauuucacacuuuauuuuguguuauagaugcuauuuuaucucccuccuuucuucaacaucugugcaugauuuuucuaauuuaaaaaagauuucugaauagagguaaaggauaacuuuaguuguaguggguuuuuuuuguuaagauuaguagccuuuuauaauuuuguaaauuuagcaauaugucuuuaauggaaaaaaagcaguguauuuuaagucagacuuuuucuucugaaauaaucuguccuuggauaugcaguuuagucucucuggguuuugauauucuuucacuguaaaaugugaaaacuggacugaacccagugguuucaaaagaaugucuuuaguucugaaugaaauauaaccugaaagcuccauauuuaaaauaggggauugaagggcaacagacuucacacagcaggcacuaaggugccucauugaaaaccuuggaguucugcagaaugugacuaaguacuuaacuaaucucuagggugccuuccagauaaugaagugugauuuuuguauugucuauguguguugggaccuuuaaagccgcauuccacuucaaaacaaacaccagguggugcucuaacuauuuguuuaacgggucagauagugguauaauguauuuccagccccagaagcaagugauuaagguuaucaauuacauuaaaacaaaaacaaaacauaggcuaaaaugaacugaccacuuuuggaauagaauccuaucauccuguggugauacuuucagaguuaccuggcuagguguggugccucacgccuauaaucccagcacuuugggaggccgagccaggaggaucacuugagcccaggaguuugagacuaggcugggugacauagugagacccugucccuacaaaauaaaaaaagauuuaaaaaaauuagccaggugcuauggcaugugccuauaguuccagcuacuugggaagcugaagugggaggauuguuugcauuguugaauugaaguggguggucuaggcugcagugagcuguaucacuccacugcacuccagccugggcaacagaacgagacccugucucaaaaacaaacaaagccaaaaaaaaaaaaauccacagaguugucuguuggaugaacaccagucauuauggacuagcaggugacauuuugcugaugaaucagugguuugcgaagaauuucuuauugcuuaagccuuuucucaaccaacuuuaauuaacuccuccucugcaccaaaaugcuacugccaaaacuagaacaaacuagaacuaaagcagaugucagcugaaauggacaaaagcagaguauagguaugaugagaguuuaaugccuacaucaagcgaacuaaagauuuguuuuuaaauaaaucccauuuuaagcaguguauacugugauacaaugacaguuggaaggaucauuguaccaaauaauguuugcuguuuauguauaaauaaaugggaauuaaggcgcuacuagcaauaucuaaacauucuaugaaguguuuaauugagcauuuucaaauaaguaaaauuuuaaaaaugcgaaaggacauacagugaaaauucucucucccaccucuguccacagcaaccaaauuccuuuuuucagagguagcagauuaacacuguuuauaugcauuuaauuuuuagaguaguauuguaugccuugcugcaauuaacuguuagcuuacauuaaaacauacaguaugaaaauuguacaauuaauaugugacaucauuuaaacuauuaauaacugaucuaauucuagaucagugcuguccaaaagaauuacgauagaagccacauguaguuuuucuauuuagcagcauuagaaaaauguuuaagaaaagguaaaauuaauuuuauuuagccuaauguauccaacguguacucacuauuaaaaaguuaauuuuuuugguacuguguauuggaagucugggauuugacacugauuuggaacacuucaaacaacaaacaacauaucacauuucaaacaagccacauuucaggugcucaauagccacauguagcuagugauuauuuuaagagcacagcuuuagauaaauauagucguuauuuauagauucccagcaugaauuauaggcuacuuuuacuuuuuguuguauaaugagucuuugacauugucaguuauuuagaucaacuacugguuauaauuugagcagaauuaccaacauaaaauguauuacuuauaauuuguuaacauagcaaucucuuacaauguguuaauaguccauacuaaaauuaagaauucugaguuguuacuuaacucccauaaaagggacuuuggaacugugaauuuuauuccaaauaaauguagucuuaauauguuuuucaguuaaaaggaucaacaagauauugagcaucauuaaaaaaaaaccaaaagggauaauguuacucuuuuucauauaaagccagugccuguuacaggaagacuaugugauguugccagaaauguaacugguaaggagaagaacgcuaaaaaucaucagagaucgggagauauugcuguuugacagccuaaaaaaaugaaaaagcauauaauuaaaaucuuuaaaaucauaugccaauauaaugaaaagcugaguagccuuuauuauguaaauauugaaacauacauagaauaaucaacucuucauguagucauguggcuucaacacuuaccaauauuuuggcauucuuuuuucaucauuuuuuccccacugcaccccuuuuaauuugcuggaguaguuuaaaucaaauuaugaacagcuuauuauacucagguauuucaguauauauguccaacugauaaucuucuuuuuaauauaaccaccaugcuguuacuuaacagugauucuuuuuauuuuuaauugugacagggugucacucuguugcccagguuggaguguacuggcuugauuacagcucaccugcaaccucaacagugauucuuaaugucaacgugugcuagucuguguuugaauuucccuaauuguuucaagauucguuuguuaaauugacuuguucaaaugaggggccuaacaagguucacacuuugcauuguuaaugugucuugagucguuuuuucuaauagccauuagaaaaaacuuacauguuucuaaaaucccuuacauguuucuaaaaucaaaacuauguguauuauuuauuacuguguaacuauuaucccaaaacauagauacuuagacaacaaaaguuaauuaucucauacaguuuuagacagauaucccggaaugguuuagcugggugauuuuggcucagcaucucucaugagguugcaguuaaaaauggcugcugggguuauagucaucugaagcuuaaccagagcuggaggauucaguucuuuaccauuuggacuucuccauggggcugcuugggugaccucaugacaugacagcuucaccagaaugaguaaucagaagagagugagguagaagauaaccuuuuauagccuguccucagaaaugucacugucauuucugcaauauuuucuugguauacaggucagcccuauucaguaugugagggacuaacagggagcagauacucaugugcuuguugcuuauuuggucauuuuuguauuguggaguuaaaucuuucuaauuucuaagaauauaaacgauaccaacccauugucauaaaugcuauacaugugcagaagccguugagggucaugauagagguuggcuacucuguguaauaaauaauucccagaagucuuaccauuacucuuugcuucauccuguucucuuuuccccuuaauuuuuuuuauuacuuuuuacuuuauucugucauugauucuuuuugaaaauauacauaaaacauagcuuauauauagucaugcacuguauaacauuucagucaacaguggacugcauauaugaugguggucucauaagauuauaauggaggugaaaaauuucuauugccuagugauguguagccaucauaauguagcacaaggcauuacuuacguguuuguggugauucugguguaaacagacuuacugccagucauauaaaaguguagcucacauaauuauggguaguaccuaauacuugauaaugaugauaggugacucucuuacucauuugugaauuuacuauacuauauuuuuaaaucauuagaguguacuccuacuuauuuaaaaaaaaacaaagcuguagaaccaggcucagauagguccuucagaagguauuccggaagaaggcauuguuaucauaggagaugagagcuccauggauguucuugacccugaagaccuuccagugggacaggauauggagguggaaaauagugauaucaaugauccugaugcuguauaggccuaggcuaauguguauguuugugucauaauuuuuuucuaaauguuuaaaaaaguaaaaauuuaaaauuaaaagaauagaaaaaugcuuauagaauaaggauauaaagaauaaauauuuuuguauaguagcacaauguacuuuaagcuaaaguauuaaaaaaguuaaaaaaucaaguuuauaaaguaaaaacauuacaguaagcuaagguuaauuuauugaagaaauggaauuuuaaaaaauaaauguaguauagccuaaguguauagcguuuguaaaccuuuaguagugcacaguaauguccuuggccuucacauucacucaacacaaguaccucacuuggagcagcuuuuaauccuacaagcuccagucaugguaagugcccuaggcaggcauaccauuuuuuaucuuuuuugccauauuuucacuguaccuuuuuuauguuuugauauguuuagauacacaaauaauuaccauguguuagaauugccuaaguauucaguacaggaacaugcucuacagguuuguagacugcuauguaccauauagccuagcuauguaguaggcuauauacaucuagguuuguguaaguauacuauaugauuauacagugacacaauuuucagaaccuacucuugucauuaagcaaugcaugaccauauuuuuuauuacucaaaacauugcuuacuauaaacaaugucugcauuuugcucucuucauauauccuauagaucucucaaguaugugaagaaguucauccuuuuucuuuuuuuaaacaauuaaacagacuucuuaauuaauuuucagaauacugugacagucccauuuggacuugaaugagguggguuuaaaguaaguaccguaaauccucacuuaacauuguugauagguucuuggaaauuguaacuuuaagugagaugacguaugaggaaaucaguucuaccauaggcuaauugauaugaguaaguugaguuccuacagcauaucucugaucacaaaaauacccccagacuucuagauaaagacuaaaaacaaaugugaguuauagauacauuuaagaaagauuaauaaaaacaaauaagauaaugauuuaugcaguuauuccaauucaggguuguggguggcugaaaucuaucccaucagcucaguagcaaaguggggaccaacccugacagguugcuauuccauugcagggugcauugcaaccacacacacacccauagucguucagacugagaucauuuagacaugcuaaguaaccuaacauacacaucuuugggaugugggaggaaauugaagugcccagagaaaacccacacagacuuggggagaaugugcagacucuacacagaacaguaaccccaacugggaauaauuuuuuuuuccuucucaguguuuuaacgaaacaaugucgaacaaaagauguuauuugaggaucugcuguguaaaaggaaucuuguguagagauauaauaaaccucugaaauuuuuaacucuagggauguuuuucaaaaucaauuuauagcaguuuaugaaaacaugcaaaaaaaaaaagcuuuaugaagaguuguacccuauaaauuuuuauugaggggaauaacugugguuuugaccaggaguuccuuacucauugaugaccacagucuacuacuacguggaaccuuaaucucagccuuuuuugaugaugcccaaguuaauauuuauauuguuuuguucaugggauaauauaugcaaaaugacuuuauaaacuaaagcuuuggaguuaugccugaguuccagugaugguucuuagcucuucaugguucuguucuuagcuauugacugcagguaaguugcuuaauuuuucuguaucugagauaaggaauacuaauaugguugaauuuuuuuaaauguguuuauugccuguuugcuuauuuuuuuauuguggaguuaagccuucuaauuuucaagaauuaagaguucauuguuaugugcuauacguauuuauuccccuugauuauauuucuguaccuacuuaccuuuuuauuuuagauucuggucacuucuauuccgaaaguuaguuaugaaguacaauccaggauuaagguggcaucuaaauuugguuaauuucugugcuaccuuuuaugcuauuagucuaaaucauuaagaaagcauuuaagaaacuuuuguaagcguuucuuuuuuuuucuugucauauuugggaauaggauaaauagcuuaaaauaguugagcugauuuuuauuuguauucuuuuuuuauuauaaagaaacauuugcuaggaaauaagcuggauauaaacauaguuguaucuccuuuagugcuacccagcacuaaaaacuuagacacguauagggcugagcagcugguauaauagagugggcuccgucucauuuucuaagccugugaguccuagcugccuacugcagcucgauuugagugggaguugauauaaugucuuuuuuuuuuucucacuucagcaguaaguaucugguuugcucauagucuuuugauuaauagguaguuugaauauuuuucaaagaaucagccaacaugugauuauuuuaaagauuuaaauaccagauagauauuaaaaugcaagguuauugcuacuagauauuacaucuagcuaaaucaaccauugugaaauaauugagaaguagagauaauaaagacauaaaccaauaaaucuuugcuugaaaaucacagguaugggaacagauugugaggacagaaaaauaaaaaguaaaaagaaaaaucauagguaauaagugucuaaaggguuucuucauaggaacagugguuguugaccccaaauaggacaaauaggacucccauguucaagaacacaucaccguuguuaaaaaggucugccauuauuaaauagugcaaugaagaaccauuuagacuuuauuagaguccacguuauuggcaaaagauguuggauauucauagaaaaucaaacuugacaaauuccaaaagugucuuucagcucuggaacaaaagaugucauauaguuccuugcuaccaaagaguuuguucauaugguaauagaggcccauaccuuuagagggcaaauacagugcuuuaggaaggacuuagaugauauaaaugguauuugucccuuuucucauuuuuauuuacugauuuucaacucacuuggcuuuuaaugaacauuagcguuacuuaucuguuggcagcuggguuggaaaacauuuguuuuucuagacuuuaugaaaugguagccacugguguugcacuuaauguuuauugccaguuaguucucugcaguuaauccacagcagaggaaucacacuucuaaaaugguucauucucuucuucauagacauuuaaaguugaacaaauacuuucuuguauauuguuacucuguuuggauggagagggaauguauauguaucuuaaaaauauuucucuuugccacauuaaacaugccuuuuuuccuuguguguguguguguguguuuucaggucagauguaccaacaguaccagcaacaggccggcuauggugcacagcagccgcaggcuccaccucagcagccucaacaguaugguauucaguauucaggugagcagguguugaaagggaguuggcucaugguuuuuuguuucuauacucauuaaacuuuaaguucuuaauuccuugauuuguaguacauugauauaauagguauuaaguuuuuauuaggggaaacaacauuuguuuuauuuauuuuuaaauauuuuacauuaauauuguaaaucaacauuucaguuuucugguggggagauaaaacuuacaguagaugauucugcaguaacuuguaguauaaaaaguuuuuaauacaaagcugucuuacuaacauuaucaguuuaucucuuaggcgacuuagugcaaguuuucccccuucccuccaccucuccauuuauauguaacacguaauuccaguguacucuuaguaccuguagaaauaugaacaguuuacuauacauggaaaggugauguuauuuaaauaagagcucaauuaagcuacuuagauuuuaaaaucucuugcaaguauguaggaauaccagaaauaggccauaaaaauaaaaucguauaaaauguaauucaggcaacuaagaacauuguuuaguuguuuuaaauaagcauccugaguauuuuguuucuauuuuaccaucuguccacugaagauuauauguauuuaaguaugauaaauauuauuaauguaacuuuggcuauaauuccaguauuuuuuacaguuaugucagagaguuuguguccaacucuuguuuuacagccaaagauugaaguaucagaauuucaacuguaauuagaaauaauuuaugcagguugaaucuagucuaaauucuauuuuauagaguuuugugguaucagcuagagcaggagucaguaaaguauagcccacaggccaaaucuggacuauugccuguuuuuuugaauaaaguuuuauuggaacacacuucuacuuuuauauucucuacugcuacuugggcacuagaauggcagaguugaguaguugcaacagaagaccauguggcccacaaagccuaaacuauuuacuaucuggcucuuuacagaaaaguuugcugacuccugaccuagaccauaacauucugucauuaauuaaaauuugaaauauuuugacacaauuuuauuuagauuguauuugcuguagagugacuuaacuuguagcuacuuguuuuuaauuguauaaaauacauagaacuuaaguuuggauuauaucaggaggaagguuauuuuuaggaugcaguucuuuuaaaaaaaucaguguuacaaacuauguuauuuauagaaagaauagcagagcugaagagauuuagucaucauuuaaucucgggauuucgguccucacuaugcuuuagaaucaccugggggaggcuauguguggggccccauucccagagauuuugaauuucauuugauugggugugggacucaggcguuugcauuuuauaaaugaggcaacuaguuuugaaagagauugugacuugucaaagcacauacagccauucaguggagggagcuggaucaguucaguauuucccuguaucauucugcauucuacaaccuagacuggaguuggcagacuuacuccauaaaaggcuagauguccuauguauuaaaaaaaaaacucacauaauuuccauauuuccauuuuuuugcuauuucugauguccuucaccuaaaguuauuuauuauuuuggagggacggaagggagacuauauauauacacacacacacaugauagaagcauugccacauuauguucaagagacuggugggcugcuaaugaaaucuucagccuguaggguuauucccuccccuaagcaauaauuaaggaucagauuacuuccaggcccaguuaaaaaaaaacaauucagauuucaggugccaggaugaaaaggcacuuuucuuuuuucucgcaguguuaaaaugaauaggcauuuucaguauaaagcugaauccaucuauuucuucaaaaccuuauagugaaaauuuaaguuuuauguagaggauaggagaacuuguaugacauucagaauuuuuuaugaguugguuucaggucaguauuuagaugcuaccaugaguuaaugcguuaaagauacuugauuuacuuauuaagaacuaagcuugcucuuaauaaauuuagucagggucuucacucugaguaaaauuuagucuuuucaaauuauuaucuuuguauuucugauccuacuagucuauuaacuugaauuugauugagagauauggaaauagucaacuaaauacucugcuuggagacuaagaggugguggugguaacauuggaccaucuuugacacuguugguuugccaguuucccucugaccuuuuccaguuuuguucauggacuaugucauaaagguuucuuucaugaguaaauuuugaacccagguucaaggugaguucagaauauacucaaauucauucaauccuuuuuuuuuuuaaugcaggguuguacauauuuuaauaauuuucuuauguaucugguauuuaaugcugacaggauuccagucaauggagagguuucauugcaaguagcugcagguguguuucaugguagagauaaaaguuuucagugaagcagacuuucguuguaaaaaaaauuacauccuaguaaauaaugaauauagauguugcuuuuuauggggcaauaugguaugcuuuuuauguguuaugcuguacugcuaaguaaaaauuuugaguuguaaaggcaaaaaacaucagauaccaaaucuaaaaggaaugauuuuaaagauugugaaaaugguacuuuuuauuuauuugcaaaauuuaaagcaccugauuaguacaauaagauguauuuauaguauuauuucauauaaaaauguucauucuccgcaauguguuuuuauuugauacuguuaaguaggucuccccugaaaaccugguuaaugacuauuuagcuuucccauuuuuggucuuccuagaaaguauaauucuuucauuuaucauuugagcaucuguucuaggaauuaugcuaugucaggaauuugcucucagggauuaugucuuagagaguuuaaaaaauuguagagaaugccucuuugauaacuacuuggucuugaaauauuaugugauggaaucuaccacucugcuuguuacauacauauuuauuaaauuucucaccauuuuugguccaccuaacaguaagacuaauucuuuggaaaaguaguuuuacuaaaagauaagauacauguuauuuauuuugccuuuucagcaagcuauagucagcagacuggaccucaacaaccucagcaguuccagggauauggccagcaaccaacuucccaggcaccagcuccugccuuuucuggucagccucaacaacugccugcucagccgccacagcaguaccaggcgagcaauuauccugcacaaacuuacacugcccaaacuucucagccuacuaauuauacuguggcuccugccucucaaccuggaauggcuccaagccaaccuggggccuaucaaccaagaccagguuuuacuucacuuccuggaaguaccaugaccccuccuccaagugggccuaauccuuaugcgcguaaccguccucccuuuggucagggcuauacccaaccuggaccugguuaucgauaaggaggcuccucuacaccaauuaauguagcugcuagcuauuggccucccaaaagacuccaguacuauuuuaauuuguauugaagaaguucagaaauuuaaaagcagagcauuuuuuaugauaucauuguugguguuaauugaaaguauaauuugcuggaacacaaagaccaaaaugaaaguuuuuuccucccugcuuaaaaauguagcagcuucuuaguuacuuuggaacacuacucuuacauguauaaagugauugacuugacuuucuagcuucccuuguccggaggauauuaaaaugcuagggugagguuuagccaucuuacuuggcuuuuuacuauuaacaugauguacuaaaguagagcccuuugagaauacaagauauuauguauaaaauguaacacugaugauagguuaauaaagaugauugaauccauu

SEQ ID NO: 21310 - RNA, 261494 nt, Homo sapiens
guauguacuugucaaacuguuuauuugccauucacacugauuguaacacuggauuuacagaagaaacugugguacaaagagaggaaggcucugguggcuccugaacagcagcaguccagcugcccugcucaggcugggcacgacgaaugcucccaggagaggggaggcggcccacccgacuguguaccguggacuguggacagugcagugccugcucuccugugcuaucuagaaacaccuuggagagaggguucugggauauucucucaugucaucuggcugaagacaccagcuugacaguuccccuuuaagaagcauuccauacguuuguaccagggagaaagaagcccacgcacgaauuuucaggauguuuugugaccaaacccaauaacugccacacaaauagacccuaggugggggcuggcuuaaauaggaccacauuucccguugcuuuuucaguagauguguuauaccgucauuucaauuugaaaguuuauuuuuuuccauugauuuuuauacauccagaauaacacaaauaaccaacaguucuuuuucuuuuuuugcacauucauuuccccuagaacaaaaaaagugaacuuaaaaaaaauuggaaccaugcuauuagcuguuuacaaaagugaauaagaaguagcucauuuuaaagucuaaaauaaacaaaguagaaagaagcauuuuuuucccuacaguauuuagcaaaccuaagaaaaaguccuuagaaacacacacaaaaaaauugaaaaaaaguuauaggcauuaacaauauuuuauaaugaagcuuaaaaucuauuuacauacauaaauacaauuaacuuuguugaugcaacucuucuggaaggaaaaaaagagccaaaugaucagccucaucaauacugaccuggcuaaaaacaaaauucccaacaaacacacaaaaaucccaaaacaaauguauacgcuacgguaaacaaaaaggcauuuuguucagauguaaaauauguuuugugagauuauugucaaacaaauuuucauguauaaaagacccaaacaugucauuccccccaaaaauaaaaaccaacaaaaauaaaaaucaucaggacggaaugucccaaagaaacagguauuucaaggcagaaaucugcaauccuaaauugcaggacauuugaguggaaccauucauuuccuuucuaaucagagcauuucuguuuaucugcacagaaacccaaggcagcagaaaggcugucuauuuacucacugauugugauuugcccaggaaaguuugcugguuuggacagcaagcagauccaauaugguuggcaaugucucuguucugcuggaagaaacccauaaacaggagaaaggcugacaaaccauguuccuuuaugugaagggggaagaacuggaccuucuuguguucugaaauuugguacuggguggggguaugugcuaucugcuuaagagaacacaggaaaaggaggagggagaaagugggguuuggaagauagaggaagagagaaaaaaagggagauauuggggggaagagagggagggaaauguauuuucagauagugagaaaaagaaagaacugaaauauguauccauguugaaaucauaaauagggacaugaguaagcaguagaaauggcuuauucaauacuucuccuggaccagacacaugcaguuauuacaugauuggcuuaagggucucauugauaccuuaacuuuccugagggcaaugaauaaaaagauaccuuaaucuaccugaagucaaugaaugcaauuuuucacacacacacacacacacgcacacacacacacauacaaaaauguguugcgugagaccuaucgccaaaacaacuacaguuugauuuuuuuugaaacaauuaaauacuauauaugcugguaagagucugugaaacucuaaaugaccaauccagugagccuacaauagugacaagcccccuccacacauggcuuugagaguaaagguucaauguaaaagauuaucuaaucagagcaugaggcugguuuugaguuggaauaucuucaguuaacagaauuaaacugaaaaacauaauuuuuuccuucauuuuucuccagcauuuuugcaggucagacaugguaacaugugcugaaaaaaaacauuuacguuuaauuugggggaaaugggcuaauggugcuuuucagaaauuaaauuuuuacauuugcugacauuuuaugguaauuuagcugcaaaaauguaauacggaauaauauaugaaacugaguuguggagggaauccugucaaaaaugaaagugaauauauucugaguuuguccgagaucugcuauagcucuucucuagauaagaacgaccugacaacauaagcugcuuuacucuuuaacucuuaccaaagugcuacugcauguguguaaaacaaauaaucaauauauauauaagaaaacucaaaaacaaguuguuuuaaauaaguccagcuguuuuugcugccugcagccaaagauuugccuaauuugaaugcuuaaauuuauaaaauaaaaaucaaacacuguucugaaguccugcuuucaaauacucuucagaguugaccugaaaucguuucaacgaauuuuaagagguacguuaaauaaccaccagaucauuuggagcacacaugugucaaaaucagcaguuaguauuuaugaguuguacaacaacugcauucugaccaaauccuccaauaaaaauagugccauaaaauuuacagcgacauuggauaccuuugaauuguagccacggacaguagugacaugaaucuuuccugucacacuggugcacagguaaaagcccauauaccccauaggguagggucucagccuggugaaagcaacacaaagauguuguugagugagcagcacaggacagggggucucgcacaggugggaccauguuuucccacuugucuccacugaggcacacagaggcaaauugacuccucgaggccugcuucuggugggcccuuaaauugcuauaaucguaaccccuaaauucauugauuugguuccuauguaaauguggcuccccuacacaguuuacuuuggcuguguucuguuacacagcaucugugaaauuaucagaugaccuuggggugagcaaaucccugggcagaaaucaaauccucuccaaagauguaauuauuggcaccugccucaacccucuggaacuagauugaccuucucuguuuuaaggaggaaguuagauaugagacccuuguugagccuggcagaaaauuccauacuucugauccuuggagugacccucagugucuaaaaauccuauuaaaaacguugcugcgugagcuacucacuuguuugauuaacaugaaagggaguuuaauguaaacaauacuucuggauaaccaagcgaucacauuacucauucuuuuuuucuagccuucuucaaugugauacauuuaacuuuggcuacuaucaagaacaaaagaaaauguaguacuugauauuuuucuuaauauaaguacauuuaaauaauuaaaaaauuaucaacacauaaaugucugaacaucaagauacauaaauaucuggggauuccuugugggaauacaguaguuaaaaaugacccaaagcuguagcuguuucucaaaaaaacaaaacaaaacaaaaaaaaacaacuacccaaaaguccaaaagaaaaguuaaauaaaacuuaaagaaaagggaaucauauuucuuuccauggucaaagcaagaaagaagcaagcucaauuuauauauauuuauauaaacguauauaaaaauaaaaaccacccaaaugcaaauacgcauuuugcaauugauaaggugcggaaaaauuaaaaauaagaauuagaugccaaacagggcgaguugcaucccuccucuccccccaccccaaccaaaauuccacacucuuuggaauaaacaacuugguuaaaaaguuaagucaaggguauaaaaucuuucuuuuuauucacagcauugcuaaaucagaagcauucacaguuucccuccgggaaucuuccuguuugcuuuccagcgcguccccugggugcuggggccggcggacacccucgaggugcgucgccucggacaccuccgcgagggccggggcgccagcagacggcggcggcgugggcuucugggcgcaggaggcugcgcgggccugaccuacagcgagauccuggccgucgggcgcccucggccccaggacgguggccgggcccagggcccgggaucccggcgggcuugucgcgaacaggaggcccgcgcgcccggaggcgaaggcggcggcccgcggggcccagccgggccaggccuggcgccucaguagggccuccacacggccuccuccaggcgcgcggagggcgccauguuggugggggaguugcuguggcugcccucggccuccaccacgucgcucugguucgggaggcugggguugagcagcgcggagccgguggaggcguuggugcagggcggcaggaugcgcggcggcgagcgcucgccgcccaccauggagaacugguaggagccggccgaggcgccguaguacaggugguaggagggcgagcuggcuuggaacgggccucccugcgcuugcgacgagccgggguagggcggcggcagguaggugugguagcgcguggccgagcccauggccgacaugccgaugccgaugcccgaggugaccggcgucggggaguaggugaaggcgccuggauagugcaugcgggggucggagauggagggcagcgcggggaacuggcgcgggucgcugaacgcugucaggucgggugccgcugcagggcgggcaagagaacggagcggaagugaguaggagguugcggaggccacagcucuucccucugccccagggggcuacccaggaugauaccgccuaggaggaugggaagccacccaggaugcuacugcuggggaggacggggaccacccgggaugcuacucccaagaggacgaggauuacccaggaugcuauacccagggggacagggaccacccaggaugccaccuccugagaugacgaggaucacccagcaugucaccucccaagaggauggggacuacccaugaugcuaugcccaggaggucggggaccacucaggaugccaccuccugagaggacggagaccacccaggaugacaccaccugggaggauggagaccacccaggaugcuaccgccuaggaggacgggggacacccaggaugcuacuguccagggagauggguuucuaucagaauuuaccgcccaggaagauuggaaccacacaggauugcuaccaccugggaggaugggggcuacugaggaugcugcugccuagggagaggguuucuacccagaaucugccacccaaaaagaugaggucacccaggaugcuaugcccaggaggacggggaucaggaggcugcuacugcccaggaggaugguauaauauacaguaauauaauacgguaauauagaauaucauguaauguaauaugacaugauauaugaaaugauguaguauagcauaauauguauaguauagauauaaugugcaauaguauauacuauaauauguauaacguauauaaaauguugauauaauccuaggguuggcaaacugcagccugccagccaaaucuggcauuuuugcaugucccaggagguaagaaugcauuuuacauuuuuuaaaugguugaaaaaaaaauccaaaaaagaauacuuccugaccuguuaaaaugacaggaaauucaaacuucaguguccauccauacuucggaacacauccucacucauucuuucauguacugccugugguugcuuuagagccacuacuguaaagucagguggucaguauagggacugcaggagccacagagcaaauauuuauucuuuuuuuuuuuuuuggagacaaagucucgcucugucaccaaggcuggagugcaguggugugaucucggcucacugcacccaccaccuccugggcucaagcaauucuacugccucagccucccgaguagcugggauuacaggcgcccgccaccaggccuggccaauuuuuguauuuuuaguggagaugagauuucaccacguuggcuaggcaggucucgaauuccugaccucaagugauccaccugccucagccucccaaagugcugggauuacaggcaugaaccaccgugcccagcccuaaaauauuuauucucuggccccuuacagaaaaaaguuugcugacccucuauuugaucaauauauuaauauaccaauaauauaaauuaaucugugauauuaauauagcagaugauaauuugacacuaauguaaaggaugcacaaauauguuacuacuaacacaauauguuauacauaauauauauccuaacaauauuaauauauaauaauacauuacacauaguauuuagguugaaugauagaaaauugccauuuuuauaggccuucgacaguugaaaaauugauaauuuccuaguauuuaagcgaaugcauggcucaguagcaacugcugagcgaaugucagggaauaccauuaccacuccuccucuccauaucuacuuucauacuaguuccacaauuuuagaaacaguacugccuugaguucaccugguauucucuauuaugcacuucacuaguuuguuaacacaaguagauguaggaccuugauuuaucuacucuguuuuuugcacauguggaaauuuuaccagaaauuguaaagcuuugucucuaaaacucacuuuguuacgacuguacauuauuuuguuaggauuauggauuuacaguuucaccaacuggcuuuagggcuguccugugguucacuggcucucucugcauuuuucuuaccuacaggccgcccuugggaacuacggaggauuuguguauuaggcaggguucccuauaucuguagaucagaguuucucaacuguugacacuguugacauuuugggccagaucaugauuugcugggguggagggggcugucucguucaucguaggauguguggcagcaucucugcuuuacccauuagguguuaguagcaucgcccgccccucuugugacaacucagaaugucuccagacauugccagauauccugcggguggggugacggaagcaaagucaccccagcugagaaccaccacugcagauguagaagggcacccuggagaaguucagguuccuuagaauuauucauuaaaugaccaggcuaggacucuccucuuuauaucagcaaauccacagacagcaacaaacaguagaaacaugaauucauuguuuuaaaaugugaaguucucagaucaacacacaaaauaacucuuaagcucagauggcauguggccuguguccuuuugaguucaggcugauagagaaagucgacagagccaaaagcuugcucugaaaggaaagcuaccaagguggauuaaucuguuuuuggaaggcagcggcaguugaucaacuuccucauauuucaagccuauuauuccagcagggagagcuaguguguuuucucucucucucgcucgcucucucgucucuuccacaccccauccucccucccucuaauggccuuuuauugcucuaacacauuuuuaaaaaugaacuccucuguaccuuuggggugaaugugaugaggggauacacuccucaucagagguaauuaaaguuuauagaaacagcccaagucuguagcagaucccuucacuaaugaggaaaccaggagucugacuuucaaacaaacacuccuguuaaucuuuucaaagccaggcagacaugugggcagggaaaacguuguaaacggacagugguucugaggcugcccuuccuuggccacacucuagucauucucgagccaggccacaccucauuccacaggguucaucccugcccgcucuuuggggccaucugugagcaagcccugugucacuuguuuuugcugacauggagagcugugacauguuugagaguuaacaggaagcuuuacuccauuuuuccauuuagauuuauagagucuacggagaagcugggacaggaggaaaagcauuaggcaaauacagucaguuuguugucaucugaugcaauacucuggacacaaauaaaugacucugcccauuauuccucuugcuucauuugcccugagacaaaaaggugaauccacuggaaaaugaacgaaaggucacccuguuuuacagcaaugucuggacaugcucugccaguagguuccaacuacuacaugguaauguggugaugguaccaaguuacuggaauccagagugaguccgugauuugucauggacauaaguacuggaaugauguuauggucucagcuguugggggaaaauaguucuuucacuugugaggagaacauccaaaagaaagagcugcaaugcugccugugauccuucuucuauguacacaugagcaacgucauacuacaaaagaccauccauuuggucaaacuaucuuuuuuacacacauuuugauaauacaauaucuuaggccuucuagauaugcucagauucaaaugcuauauucaaauguugguuuucaucuuugugucuugucucagaucccuuauucaaacccaucagucugcgcaguucacccauccagcuguagcucuucuguccuuuuggcuggccugguguccccugauucagcagaaguguggggggaguugggauccccugauauucacagagaguuuuuaagaguaggaaaucuggggcuuaggagguccagguauuuugguuggaaguguuuucccauugauggggcuaaauauuugccaugacagcucaagucuucgcucuccagcuugacauggaugaaagcagccucgcuacagggccccuccuacugcccccagaggauuaaacaaccugagcagguaauggcugccuuaaaaggagcuuuugcaugacucagauuaaugcaugcugucugucgcccagguuggcagcuaaacauuaauuuuuuuugaaaaagaaaaaaaaaaguaaaccucuagaugacaacucuuuucagacaagguguggagucugucugcaaaggauagagagagagagacagacagaguccaaguccccagcgcagaaggaagcccagguggggcuggggccgggaagaggggcagagcacaaagcugucgggcuggauuaaaaggcaaagcagccacagagcagugucagguucucaaagcugucggccaggcagccacuuuccuuuuauguauuccaccccccuccugccuccagguuuaugacaacacuuuucaggccugugcuccaggcuugauuucucagagggaguucugccaaauugaagagcagucucccauacuguucuaugccacugugaaagcucaucuggaauucuguccucccuccaaaaagaaaagaaucauucuuggguucugaaaugaggcaugguuuuuaucuacuucacacucccaugccauaaaauguucucucuuacuccuugggugauugaaguccaggauauucacaaauguaacugugauaugggacuuuggagugcacauguuacucauuccuuuuauuuaaaaagucacccuaccaucugaacaccagucagcuggaggaguuggccccuaggguucuuggacuauaaggugcugaucuugggugaugaccaagucaaaagacuuauguaauaaauuccaaaggauagacccauagcaggaacauuugaaggagaacaggcauuauuucaggugaagaccguagccggugugcagaggggugcccugagaacaaucaguaaaagcugacaagugccuuuguucuugagggauaagcuucuagaaaccacaagcuaaacaagaugccaagauaccugugcuacucucaaugccuuggagcagaauguaccaugaaaauauuggcauuaauggccaaaaguaaugugaaaaccaagcacuuaaguugguuuuccuauuuuacuguaccacccaagaacacuggaaggcagugguucucaccuggggacaguuuugccccuugggaaauuuggcaaugucuggaaacauuuuuuauuguccuaacuggggugagggggaugcuauuggcaucuagaggccaaggaugcugcuaaauauucuccgaugcucaggacagaccccccccaacaaagaauuauuuggccccaaaugucaauaguacugccguugugaagcucuuagaaggcauucugugaagcucugaacagcagcuaaggcaucuggugaaaccugaaguaaucacaacugucuggaaaacacaacauuacacaacauuuaaaauggcagacaugacuccacugccccugugccugcccccuaaucugcuauaauuugaucccaagagcugaaaagcaagacccgccccguucccccaacacacaugcgaguguguuugcaggcaucauaacacugaaguucucugaaguauuuucacaguuuggugcagcuccaauuucaaagccccaaacacuaaguuucuucuuuugccuucaacaaaggaauuuuucucuguaacucugauuucccugcccacgagcaaaggugagugccaagcccaaagggcucauagguuaaaugacuaauacuuaaugagcucauauuaacaacaauuaugcuaaccaugacaccugaguuuuucacgcuguuccucuggccucuguaugaacagcgcuuaguuggaaugucuaauuugggguauacagucgguucucuauauccguggguucugcaccuguuuaaccaacuguagaucaaaaauauuauuaaaaaaaaggaugguugugucuguauuagacauauacagacuuuucuucuugucauucccuaaacaaugcaguauaacaaguauuuacauagcauuuacauuuuauuagguauuacgaguaaucuagggaugauuuaaauacaugggaggauauauauguuauauauaaauauaccauuuuauaugagggacuugagcauccauggguuuugguauccaugggggguccuggaaccaguccuccauggauaccaaggggcggcuguauuuauuucccauuccacauguacucccgugugcuguccaugugaucugugaaaauuuaccaccaccgcauggaccagucccauuaguccagaauucauuuggaauaaugaguccuaaaaguugaaaacuuuggcuuuuuauauuguucuuaacccuucagucaccauccuuucuugccaaaugugaacaacuuuagaugucuaaggaaccuacuucuccaagccacuucugccuucacauccacaaucucugccucuuauguauccaagaaaaucagugcaugggcaugggacucagaguagagauaggucaccuuuaaaccauguuuuacucaauaauguucugccaacuccuucaugcaccucuagucuccuggaccuuccaccccagcucagcugcaaagaauguguuuucaaguggcuuacuugagagucgacuggaaaguucugcagagaggguugucaugccgcuggcacguccaggugaaaugggcguugcugggugcacagaaggagaggcaauggaucccagguauugguaggacugaucguaggaccacgguggggaugguuggaucugccuuguaucugaagagaaucagaaaggucaauuauauguaaaguggggugggauuuaaaaaaugucuuuuaauaagaaaugaguggcccuuguucaaauaugucacauacauguauguggccuauguaccaggguuuaauaagccuacucaaguccaaguaucugccucuguuggauuauuuucccccaaaagagacugauucuuggagauuuucaccugauaacuauuccuuccaaagguuuuauuuaaucaugcuaacaaugaugagaggaauggauuacacuuucaagguagaaguauuaauguccagacuguugaacugcagcacuugagaacuucaaguaucauaugacugcugacaugauuucagcuuugccaauaauuacaauuaucaucaucagaaacauuuuauaaacucaggggaucaccugucuguguucgguaagaacguagaguuuugggcuuuuuuuuuauaccuuuaccuuuggcaaaaaguauuccaugggcugguaaauguuuuauaguaaggcgaauucucucccaaggaugacaggaaagaaggucuggcugggaaaccggcaaugaggucuaaugacuaguucacaaacccagcaguagaacuggcccuaucaacccaagccuucuguuccuuuucaggacuucgaguuugcaacuuuuaaaagucagaguuuuuagcagguauuuuauagauugccauuauaagaggccugggauagagaagagacaaaagucugacuucaaaagauuuagacaaaguggauuuugucaauuugacuccagcguucaaaggagucuuaauuuucaaaagcaucauacuguuugcagaugaaaaggggaggaaaaccaacgcuauucuuaggcaaauguguaaggaaacuuaaauuggacacugucccacuagaagacaguuuuacauuucuuuggaguuaaacauuaauuuucucuuuaugucccaacuuuguggacaaagauaacagugaacuaccguaacucccaagggucuucauagccagagcuucaugauccugcagguagcaguguaggaagagcagacuucuuuaggaaaauacuggguauaaguuuuguauaggucaggacauaaagaaaugagcuauuucugcucauuauaaaauauucagaucugcuuccuccaggggcuuuucauuuccagcaguucaaguuugccuuucuguuuaucucuuugaagcugccacaguggauaacagaaucagacauuuggagacccaagucuuccuccccaguauucuccugacagccucccucccucccucauacugauucauuucuuucuuuuuugugugugagugaaaauaacugauuuuuuaaguuuaaaaaaccugguaguucccaggcaaauaguuuaacuuggaaucuuugaaaucuaauauuaaagaaaggucuucauuuuauuccaaauuuuagaggauuuaaagagcuggcaaggaacaaaaggagcugguccauuuuaaacucagcagaaaauaaauguucaaccuuggcugaagcuccuguguaaucuuacagcuaacaguguuuccaaugacuaaaggcaaacagaaauagcagacgguucaauauccccaugcuacugcaaguauuuugcuccaagugaaaaaaaaaucauauacuuagauauuuuguauaagacaugcguauauacuagauacacacauuuacuaagugaauauauaguacuccaauacuuuaaucauuuuaaaagcaaacaaaagagguuucagaacugucauaaagccccccggggugugaacugcaguacaguaauucacgccuuguuguguagacagccucacaccucuaaccccaugucuaaagccacacuaagcauaaaguacuaugccaugauucaugcuccgucauguuuuacuguagugaaaaagucgugcuaggcuuuucuaaacucauaauuaaaccaugcaaacguugcauaauauuucacagccuuuaaaaaauaugcuuugguaaaaugaucuuuaugauuaaaguccaaguucuaugaguuuuuuuguuuuuuaaagacaggcuugcagauuccacauuuucugacuucacaccauaacuuagcuuuucaggugcuggaggggaagauggcagucaacacccugaagcccacccaacccccacaucaguuuucuuucaugagaccacagugaccugugcuuggguucauugccaguggugggccagaagguggggauggugagccucuaauguugggguuuuaguuguuuccucuucuaccuguguuacuaauagaaaacaaaaacaaaaaaggccugauaauauggugcauucuggguuuaauauucauuacugucuuuggucugacagggccaacaugaacucaugggccacccgagcacuggacuaauaggcaggagaggugaacucuuggucuuucugucuggugagcaacugggugacauuggauuacucacugacacuuucuuauucucaccuccgaaggaggugaucccuaaauccuuuccaauggugacagagcaggauucuaauuccaauagguccuacacaguauuucuuugcuuuacuuguacauuaagcagagucagggaagaaucagauguggggugaagaguggugccuguaauaauaaauuuguguauucuaggaagaggaaguagaggagaguacgaugggaguuauccagaaaaggccccaggcugaggaagagaaccacuguaaaucauucuccagagcacagggcuacuuguucuugaaagaguugccucugauaagucaauccaucuaaaagaacaaaagcuuauugaacauuuacagugugccaggaaugugcuaauuuaccuggcaggagagugaugaauaagaccaacauggucccugccccacaggcacuuacagucagugaagaucccaggaucuugugaugcuuggaaaggcaucuuccuguggcauuaaucaucauacuggguguugcuucauucauuuauucauucauguguucaugaaauuacuuuuucauucacucauauuuccaacaaacauuuuugcuucacuugggccacuguuuuggggacucacuagugaauggaagguuccugccuucuggaaguuacagcuacuagggugcccaagggcuguaucugggcuaacugcuagauuagcugccuaauuuggacuugcaaacagcuguucccaagguagaaacaagaacccuagugguaucuauuacaugcuuauguucugccucugagaggaggagacuagggaaagcaccgaacucaaaucacagacaaauuucaguuugcauccugccuucaccauaaaccaacuggaugaccuuaggcaggucacuuauuuucucugauucauaguuagaauucugacuucaaaggguaauaggaguaagugagauaaacuauauggaaagcaaguaucacaauuucuggccauaguaaaugcucaauaagucugaauaaccuuuaugauuguauuacuaaaaaggaaaagaaauccaugccaagggacuuaucugauguucauuggugagaccacacacauuugcuccaggauaaggcucaaguaauaguguuuuguucacagcuacagucuugacagacacacucuucaggcuggagaggagcugggcucaggagauuaaaugguaaaggggcaaauuuccaaagauuggaaauuugggauuaggauggagaaggcaggaacucaguaucucaaccaacucauguuucuauuaaaaaauacuggauucagggccgggcgcaguggcucauaccuguaaucccagcacuuugggaggccgaggcggguggaucaugagguuaggagaucgagaccauccucgcuaacacggugaaacccugucucuacuaaaaauacaaaaaauuagccgggcaugguggcgggcgccuguagucccagcuacucgggaggcugaggcaggagaauggcaugaacccaggagguggagcuugcagugagccaagaucgugccacugcacuccagccuaggugacagagccagacuccgucucagaaaaaaaaaaauaauaauaaauaaaaaacacuggauucaaaaauuuaaauuugagccuuuaugcauacugguuuuccaggcuaaaugaugucugaugcagccacuuuacugaggccauuuugugauggguuauuuucagcuuuuuaaucaucaauaauggguaaaacaggccuucuacuccuugauccccauucccuuccauuugaaaugggaaguuagggauaagguagaguugagguuaguggugagcucagagguguacacggcauauaucacacaagaagaaaggagaaugcuuuuaucuuuugaugcagcaauauuaaaaugucucuagagucaacaaugacccuuuuaaauaauucaugucagaauguccuguugcuucuaguuucaguuccaaaauuuaaagagcuugagagucaucacucuuguuuuuauaagaaaaaaugcugaacaaacugaaaauccaugacuuuucuuaaguccaauggaaagcugaaguugcagggcaaacugcaaccccaaauuuugagaagcaggcaaauauagagaaucauagugaggucugcuugcugggagcagaauuucugaauucauaaacugaugagaacacuuaauggugauuuugacagauugcuagaggcucaguacagacuagugugcgaauaagacacuccuaggggcuacaguuucaggaggaagugcacuguuguggguuuuucauucaggaacuccaccagauucucacaggauccaauauauuauuauaacaguggguuauggcugaaagagcuucaacauacugacuaaggaggaguucauagagaagcucacagaugacaugggagacaaaaacaaggacgcuagaggaauuugaagucucugguaccuucugaaaacauuaaauacagcccaacucuuggguacaugagaauaauaacucacgcuaaaggccuacuaaguuccuauugccugauaaaucauguuaaacuuucaauaaaaaauuacaagaaaggcaagaaaaaaacacagucugaagagauaaagcaagcaucagaaccagacccagaugugacacagauuuuggaauuacaagacagggaauuuaacaaugauuaacauguuaauggcucuaguggaaaaagaagacaaggugcaagaagagauggaugauguaggcagggagauggaaacuuuuuuuuuuuuuuuuuugagacagugucucgcucugucgcccacacuggagugcaguggcgcaaucuuggcuuacugcaaccuccgccuccuggguucaagugauucuccuccucagccucccgaguagcugggauuacaggcaccugccaccacgcccagcuauuuuuucuuuuuuuuuguaauuuuugguagagacaggguuucaccauguuggcuagguuggucucgaacuccugaccccaggugauccacccacuucggccuuccaaagugcugggauuacaggcaugagccaccgugcccagccugaaacucuuaacacucaaaagcaaauucuaaaaaccaaaagcacccuaacagaaaugaggaauggcuuacuuaguagacagaacaugacaaagcaaagaaccaaugaacuugaagauacagaaacuuaccaaacaaaaagauaaagaggaaaaagaaagaacauccaagaacugugagaaaguuucaaaagauguaauguguaauuggaauaccagauggagaagaaaaagaaaacaguggaagaaauacuugaaguauuaauggcuaugaauuuuccaaaauuaaugacagauaccaaaccacagauccagaaagcucagagaacaccaagcauaauaaauaccaaaucuacacccaggcauaucauauuuaaacugcaaaaaaccaaagagaagagaaaaucuugaaagaagcuagagagggggaaaagccaacaccuuauccauagaggaaaaaggauaagaauuacauuaucuuucucuucagaaaccaugcaaacacaaagaaaggagaauacaugaaguguugcaacaaaaaagcuaccaaacuauuauucugcauucagcaaaauuauccuucaaauucaaagaaauaaggauauuuucugacaaacaaaacuggaauaauucauugccagcugaccugcccuaugagaaaugucaaaaagaacugcauaaaaaaggaagagcauuagaaaaguacuauauuaagguaaaauuaaguuuuauuuuucuuaacugaucugaaagauaacuguuuacaauaauaguaacaaaguauugagugauuauagcauguggauaaaugaaauaaaaggcaguaaugauauaaacaggaaggaagaagugguaguuauuugaugcuagauguagauuaguuauacauguacuuuucaaacuuuagggcaguaacuaaaaacauuuuuaaaaagaaugauuaauaugcuaacagaggagauaaaauggaaucauauaaaauguucaguuaaaccuauaaaagguagaaaaagagguguggggggaagaaucaggugcaacaaauauaaaaguuauaaauaugauugauacuacugcaguuauauuaauacuuagguuaaauaugaauacucuaaaugcaccaauuuaaagacagagauuggcaguguggauuaaagacaagacccaacuacauauugucuacaagggaccuauuuuaaauaaaaauauuuauacagauuacaaguaaagggauggaaaaagguacaccaugcuaacacugauugaaagaaagccagagcagcgauguuaauuuuauacaaagcugacuucagaggaaggacaauuuucagggauaaagaagggaauuacaugaugauaaugugggugaauucucuaagaagacagcaucuuuaauauauguccaccuaaaaacugagugucaaaaaacaugaggcaaaaacugauagaacuacacggagaaauagguaaauacgcuauuacaauuggagacuucaacaacccucuuucaguaauugauacaucaagcaggcagaaaauuaagacacaguugaccuaaacggcacuaccagucaacuugaucuaauuaacauuuauggaauacucuaacaacagcagaauacacauucuucagcucacauggaagauucaccaagauaagccauauucugggccacaaaacacacuuuaagauccuuaaaaguauagaaagcauacaaaguauuuucucagaccacauggauuuaaauuaaaaagccaauaauagauaacuggaaaaucuccaaauauuuggagauuaaacaacauacuucuacauuagacaugagucaaauaaaaagucucaagagaaauuaaaaaauguuuugaacuaaaugaaaauacaacuuauuacaauuuuuggaugcagauagaacaguacuuagagggaaauuuauagcauugaauacauauauuagaaaagaaagauccagaaucagucacugaagcuuccaccucaggagacuggagaaaauagcaauacagaccucaagcaagcagaagagaagaaauaauaaaaauuagacuaggaaccagugaaauuaaguacaggaaaauaauagacaaaaucaauagaacaaaauaucuuguucuuugaaaaguucaaaacaucccucuuuguccucgugcuccccacaggcgcugggagaagauggauagagaccccucccggcccuccucugacuguccacucuagggucuuuuaaacacccacccucagaagcuggguuuccaacagcaccccuugagcgguggcacccuucauccugggcuuggagaagguuauaguuagaaagccccuuccuugauuguguggcugacaucuuuaaaacgccaggucuuucagucaucucucagagcuauuuaaaaauaaaagucacauagaccacaggguucuaccaucuauuuuugaaaaaggcaaaucagcuuggugaacauauaaacccuaggggcagcccugguuauuucccuggaggaauuuuuucccuccuucauccuggaggaagguagggacguucccaggguucccuccagauucaccucagucauggggagcugguguaaugcccucuuggagaccucagaacacacaacaggaugugacucaggacucagagaugugagucaguuuccagggugauguguuagggcgagccccaguggugguuugcaucucacugucugggaccccugggaagaaaggccuaggcuccccuugcagacaaagggggugaccccagaugcuucccagcaucacaucugucagaggugugugaugucaggggccuuucagagucccugggggugggugacucugcucugaaagggacauuucccugaaaguuccacugucuuugagaagcaguguuuccucuggccucugcagcagggagcaaagcuccggcacagcacaaguaagaagagcagucaccuauuccuacuacagguacccccagguagcagacaccggcucagcacacuguugcuauaucauugaaaucccaugauaacaugagucagucagcaccagcucuggauccuggaaaaaagggagguugugaaacagcuccaggauuugccaaccguucgucucuggccggcugcagacaucuugguuagucauguguagcucagaugcauucguuguuccagcaauuacuuugaagagaagcagacagaccaagccggggcagaacccugccuggguaugcuguuuuaaaggccucagguuuugagggaucccauccucacugccgaccugccagccugggagguggcaggcugccugcgggaaggaagaagggagcccuguguccgccucuccaccacucccugcuuccgggacccguauucaucaccucgccggggaagcuuuguggcuuuguggucagggcccugugaaucaagaaugcugguuccucacaucaggccgcccccaacccugcugguucacccuggaguccuuuucuuuucaaaccucuguuuccucaccucuaaaaauggggguaaccaggcucacuugccucacaggugugagaguuaauuaauguuuguggggcagcuuugagauccacagaugaaaggugcucuauaaacgcaaaaugcaauuccucauuagcacugucagacgguucccaggggaaacaguucacccugcaccacgaggcugcuacccucagccagaugagucugagacacgucugggaaagggcuacguauuuaggcagagugcuuuuggagggaggguucaaggauaggucacuagcuuccagaaaagauggguguuuuuagaacaugucucauucucaguuggcaucgugucccugaggcagagggagaguggccuucagugcacacagcuggagggaccauaguucagagggaacagaaggcaccuucugguuucugcugccuccucccuugcagacagauucuuucucuguacuuuguuaaauaaacauuuguugcagacaucuuuuccauaaggaucuucugcacugugcacuuucugcaccucugccccccguauacaacuuuccaggccugaaggagcucuacagacagguuggguacauuccugcaacaccagcacaucauggauguuuagauucuucuauggccacccuauuuauuuccuuccacuccuccauguccuucuucuccaggaggguaaagacaacuuucugcucccuucuacuccucuggcaccuuugccccgcuuaguuccuugaaaaacaugagccagaaauauuguguugagggcugggauaucucaagcagccuccauccugagacuggacccuugguggagaaugaggauacucacuccaguaaaacaaaucacugacaccucaagugggagcugggaagcuucaagcagaagaggcacagcaucucccaggacugcacacagcuaaagaaacagaauuuucugaagaacacuccauugagguggcaccugauaucaagaggauugugcacgcuugauagucuaugcuuggaaggccuggguugggagacugucaucuccaaccugcaguccaggcugggcauggaaggccgugcuuuacagccaaucuccacugugcugaugaggggccggugggauuuccuagagaggcaccugugauaucucuggcuaaacagauacaguuaagagcugucgcuggggcagaucauguuaaguaacauggcugagauuugccaggguccauguaaugccuuagggugucagcacgcaagaaaaaaaaagaagugacuuuacgucugggacugcagaggcuacaaaaugaugaacccccuaaccuaugaguugucgauauuggagaauacgaugcuuuugagcccagcucagauggagaucuguuccacacaggugugugucaugccaguuugcagccugggcuuccucuggugacuaccccauccaucucugccacugccccagcucucugugcccaagugcugucccugagccagaccucuggugggagaggccgagggggcauggagcagugaucucaaaagccuuccucucuacacaaacccaaccacggguuucucagugggcauucuccuagcugcagccuuaguuuuuacuuuggcacuuuuuugauguuguaaaauguuagaacuguuugaaaaauucuagaguggcuugaagcccagcaagcagucucuguugucuucugcuuccauaugacaugggcccuaaggcaggcuuauuggauuuuaugccagggauucugguuuuaagcagcaaacucugaggcauggcauucuaauaaaaucagaagaaaaacucauaugaaugggggaaaaggagaauucaaaacaauaaacaugaaauauggcuuaacauaaagaugcuuuuguuuguucuggccccaaacauuuucaggauuugggaaccucaucccagagcugucucucuaaaagccaaaagggcuucaguaaggauacaauaagggcauaguucugcagucugagagguaaggacagagacccuagcuuggccccucacucacagugugcugaagcaaguaacuuaaugccuuggagacucaguuuccccccauaaggagauguuauugcaucugucccuuagauuccugggagggugaaaugugccccucugcccgauauugucaaugcaguagcuggcaccuugaaggcaggaaacagucuucucuccccugcccuuccaggaaaggauaacagugucuggagaguacuguuggcuuagcugguuguugcuccagguaacagaagagggagaggcuuggucucacaaagccaccagaaaugagaccuuccuuaggcagccagaguuccaaggugcacuauuccagcgggguagcaugcaccgcuaggaugcaacauaagcccuuccuccugcagagcagcagccuccuccuucacaaggagcaccauagccacccugcagaacacagcugcgucagggccucacagcaguguugcaccgugccagccacaacacagauucugaaagcugcauuuuacaaaucgaggauucacugcucuuugucuugugaagugugacccacaaugaauggcaaccguucuuucuuuaagagcuuccauuccaugcucccaauuugaaggauauccugacaaagggaaguagaauuccccaaguggaagugccucguccccuucaauaaacgcgagugaaaucaaagggcugcuucugugcucucuuccucuguuuuucucaugcaguccucccaucugacuaccuugucacagcucuucuuuuccuaccugcauccucuucaccuuguuuuccuuucccacacaucaggccaaggcuucuagaauuccuugcagcaagagcuggaggacagaaccucagggaacugcccugugggaaugcuucaugucgucuucuacacgcccucugaccuggccgcugcacacaggucuuucacucuaugugauucccuggcugccccuucaccuccaagagcucugaacggcuuuacaacuaggaagucucugaaugugcagaacaaugaguuucucuuucagcagggccuugccaccccaguuguuuuuauuccccccucugauaugcuagagauaaugauagauccaggaaguauauuuucuucacacuaggaggggccuugccccacaacuggagacaugccauuccugucuuuacugucuguucugaugggagcuccugagagauggcaggacaggcagccuucauuccuaaacacaguguccugcagacccacccgcuccagcuuauuuuucacagacauauuucuggaggaguaguguuuauuauaccucugaaacucaaggcuucuccaugcacagaaauagccuccaagaaacagcccucuauacccccgagaaaugcccccaagaaaccuccaugccccugagaaauagcucucuugcaccucucuauuuuuugaaauuucuuaaauauuugccaccaagcaacagagugaauaagaggcuaaaauguucccucauuuggugacaaguuccuaugcaaguuuugaauuauuuggaauaauuggauuucuuuggcuugugagccaaggggaaucacuaucacuuucuucuaugguaucagaaaacucccucuuucuucuaaguuccccugcugcagucuucucccccaccuucaugugagagcuacacaaggggaauuuguucacuuaaguuugcagccauuuugcacaccccaaagaguugaccuugaugugaacuaauugggauugcaguggguuaauaacacagguuggugagguggaauuugcagcauaaaggaaacacuugaagauaagagccauuugugcuuucauaagcucaucccuggugcucugaacaaaggacacaaacuaauaaagucagauucaucuaggggcaaucuacacucgcucaccccaaacucugauucagaaaggcaaauggaaaucugccagaauucuuuuaaacuccaacacagaucucgauuuaaaaaaugacacacacaaaaccgcuugguaauaagcagaccucugaugaucuacagauccacagcuucguuuauugacuuagagaaaguaaauggcauuucaaauacaaccuucauacuucaauagaugaggucacccugagaaagaugauacucagcccagcagugggaaaccucccuccagagaacugcuuugauuuacaaggccaaggaaggcuuucucauagaagccauauacuugggcuaaaauggaguaauuuuuuuuaaaaaaauuaaauguagagguugagauagcagacaacuaugaaacucuugcucaacaagagggaugaccuauggaagacaggaaugcuaggaccuacagaacugaagggucaaaauugacuuacuaccaaguuuagauagcuaaguaacucacauuuuuuucaggcauugagauccuguguauauugacuagaagauccuugugaauuucccaauuacucuuaaauagcgaucaucaaacgggugauuucuccuccaggggauuucuggcaaugucuggagacauuuuugguugccacaacugaggaagggggagugcuacugucaucuaguacguggaggccaggaaugcugcucaacauccuacaaugcacaggauggccccuacaacagagaaugauccugcccacaagaucaagcgugcccuaaagugucaaagaaaaccuugcucagggaaagcacacacugccacaaugguuucagcuaccaugaugacaagacggaagaugugacuucuagaggugcucuucaggaucggggaaagcuaacacagcauuguccccugggcacaguacaaaugaacugagggguaugaggagaugagguguguggugagcacuuucuggagcccuugugagaauccuggguggcugcagucaugaugcacccagggggaaacuccauccccauguaagguuuaaggcgacugcucucucagucucauggccuggcacccagacuuagagcuggcauguugagcccugggugagcugcaggugugaacuaccaacaagacugcuccugagcugaccgucggcuuugccaucugggaggguacaggcuagcacuugccucuccugggcuuccugggcaugagucacauguaacuagauaaugacgcaaaucaccgucaacauuacuuaagguuucauucuaaugucuuauggaaugauagagcagaaagcaaccuccgagacagcagagacaaccaugccagccccaucucagagaaagcugcagugcggaauggugaagggacucccccuauucuccacagcagauagcaacagagcagggacagaccuucuggcucuuuguagacuacugcuuuaacuacaugauaguuagaaacuauaacccucccaucaaucuaguuaccauguacugacagaacaaaaagaccuagcuaaaccucaaaaaaaaagaagucacuggaaagcacauuguccagaugguucugguggggaacaccuuugccugcuuauagcucugugagauccugagcuuggugagauggacugggaaguccuaacuucauuuaugucuucucuccacccugaaacgaugccaaaaugaccccaaaucucaaauaaaaguuggugucuguugcuguaaauguacaaauaacccaaagucaaaauuagggauggaaguuaccauuccuuuugccuucuguguuuugagguggucguggggaggaggaaggcuuucagggacaagcagacggcgacagggaucacacugucaccugugugcgccuuuucuucuaauggccuuaaacugccaaguggcugcaacugcagcgugcugauuuuaaaugcuuuuauggaaagcaccauccccuuuucgacuagcaucacuuaaaauaaugaguuagaugcacuuguauuauucugucuuucaaguggauuaaauucacaggcucgcucuccuccagucucgcaagcuuuggccuggcugucugaaccuccagauuagacugaugagcacaugccagacagcaaugaaaugcaauuacccaggcaaacuuuugaaggauuugagcccuggggcacaggcuguuuacgaaagacuaaaagcaccguuugugcugagcaggaccaguugccuccgucuuuuccaguucuggauccugccugccacuggacugcaggcaggauuucugggggccugauaacaucaggcuucuguccacaccucagcaccucggggucuuugcucuguuuuucaacaagaaaaugcaaguaccaacaaaagccuauuauaacaucucccuuuguguucacugacugacucucucucucucauugacuuauuuuuuuguauuguguacuaccccgaaaaaaugcagccaggaaucauccuauagcugacuggcuguguaacuucuuuggaaaugaacaaccuuuccaaaaaacaggaacuucccgucuucuuugaaaaaaaaaauuaaaaagcaaaccagucucaacagcaccucugaauuaccuuccccuugauuugaacaaaagagguuucagaggaacagagguggagggaagagaaaacaaagaaugggcaaagggaagguugacaaggagagugaccauggucuccccucugcugacccagacuuuuuuuuguuuguguguuuuagacaacugugggugacacagagguguuggaaugguucuucauccauucagcugaaaauuaaaauguaauucugcuaggagaaugcuggggaggggagggacuggggaagguuccuuggcuuuuguaguugcuguggaggaagcaccaagugaagccagcaggauggcagcacugaaacgcuccagggcugggguuggggguccugaagcccccgccauagggcacagggugggugugggaaagaagcuuccaugaggagugggaaaauacgagggauagcaagaaaaagaguaaacuuggaaggauggguuucagaagugcuggaaccaagaacaaucuagaaugcuuuuagagaaggaggccacacaggggcacaucugcacaccaaggaaggaggaagaacgccacugccaggagcuagcagugaguagggguugggauccaaggaagugguagguaaaucaugcacucuuacucuggggccgagaugucuuacaaaauguggaaagcagggucaggauucagaaggcagccuccgaugaggcugagcagucuuuagaggaaggaagaugaaaagaaagaagcugggaugagagaguuuggccucagagagggaaugggaaagggcaggggggcucacuagcuuaguuagcagaaggcugugaaagugaugagggccagaaagccaagaagcauggagacuuccuaggcuccuccucaucacaaacaagaagggaaauggcccaagaaagggcagguggugccagccaggcucuccccccagguucccagcugggaucugggaaaggagaaggaaagaauggagaaaggaaacagccaaagggccccagcagagaguuggugcuauguaaggaaagaaauuguuuagggcaggauauucugaaauuaacuuaaaaccuaaaacaaacaguuuugacuugcugucccaggagcaaggaaaaauccuuccucaacgacucaugcaccccuuucucugcagcucugggcuagguucguggggguccugggaaggagagagcguuccugcccaccuggaagucuccuuccaacuuguugaucucagaacccugaugugcucuggggagaagaguguguagcgggugggggcacgcucaggguugccugccuggauggcaucucggugguggugguugaguuuuuacugucuuacagcacagaugguggaaaaucauagccaugacaguuggugaagcgucacucaaacaugcagccuaucugguaacagcagaaggcaauguguggggaaaugccaaagugacagagaccaacagaucagucaggagucgggaagggagucagucugggccucagugaggacaaagauguucuggaggagauggggcaggugaggugcccugaagaauggcaggauucggggaugugguggggaggagaggaaggaacuuucuggguaggcauccagcauggaccaaagcuugugggcaggacuggucauggguguucagagaucaagcaggaagaucugcagcauucacccaccucaguguccagccucccuccuguucguuggcuugacuuuuuggucauuucagagcaagaaugagcuucggaagaauggagcaccuuguggcccagaacaaggcagggaggcauggcuagagaaggagacaggaaacuggugguuccauggucuccauagguaucaggccucccuggcaucagcugaccugaaauagcaacaccugcuucuucggccacuuuccuccaaaggugacauauucagacagguucuaccaggagugcagggcuaagggaaccuaugcagugcagucccuggacucucugaaggccaaaguaucaacagugagcacauugggucuucacacgucacucaaggucacauagaggggauucaaacucaggcuggaguguagccagaaguccagguugccuaugcucauugcuauucaccgucugucacucugcugccucugaaaaguuguccuuuuguuucucugggauugucaacugauguacauacagagauacaaggguggcugagcuacaaaugauuuauacuacaagaaacagacuggcgcaaccucaucucugguaaguccucagucucaaaugaaauaaacagcauauggauuuucccuguugugucgcugaggccaaauuaggagucagcaauggggcuuagugcuuaaauaaguuguguauggaugagaaggauagggcugcccauuccuuguuugagugacugcuggcaccuaaaugccucccggcucagguaagagccuaccugaucacaaacagagcugggagauuugucgaguuacucaagcccccaagacauggccacuacaugugugagauuuucuuagcucuucuacacaggcuccuuacuguuggcucucgcaguaaagagugguuuuugauaacucugggaagcucuuuuccugacuccuacacuaugggccuccacgucgugugguccugcaauagaaagucauuucaggguggcuuugacuaaguaaugauccuucagagcgaucaucacccuugaggggugccagccuguacccagaaggacuccugcccggggccgccucaugucagggccucuugagaacuggauuugcaaagugucugcagacguaaguccugguggccugcucugucugcucugaucacaggggacaggaaggcugaaccaggacagaacaguuugcgguuucaucaaugaauaauauggagcuggggacaaaguccccucuacuuucugcggcugucacugaaaugucagcaguggagggaaaaccagaagagaaaaccucucacugacaggcgcccucagugugcaaagagcucaaguuucagugcugggguggggugggggcugcgccccugccuauucaccccacuccuccccugggcugcuccacucccaugaugacugggaauuuauccuacaacaggccacgagcuccuuguucugcaguaggaaauuauccuucauaagagggcaacuguuaguauuguuuguuuguuuuuuaauuuccaaaaguaaggagaaguuuauuaaauaagagcgggggaagggaggagggagaaggagagggaaagggcccgagaggcagcugaccccagcauuucccgucuccccuuggcuucucccaucccccuugucccagaccccccuccuucugguucugaaugugaaaaauaagcagccugcaccuccucgacuggagaugugucuaacaaggcccucauugucucagacaggugugagauuggacuugauucggggccaacaccuccaguaccggagccagcucugugagccgaaaacaugcaccagcccuccaguaauaccacugcagccagccagagacucaacaauuuaaggcuuaacacacacaacauaaaucagaggaggauggaccagccgaccggcagcuucuugggcagaugccugcagacugucugcagaucauacccugccuguuuggguuauuugagacucuuuuucuguaauauaaagaugagaaacuggguggagcagcgugcagaggcacacggguguuuguccugucuuguuccaacagccccucuuucgccuaagugcuguuuugaagggacugcucaggacgguucacauugcuacauccaaauccuaggaauguguccaagcuggggaggaggggaaaggaaagcugagcgcucugauaugggugguaucugugugacccugggcaagucucuuaaccucucugggcucauccaucuaacaaggggucuaguuuucugcgauucacucaucucuaaugcucagaaguucaaagucacuguaagaagugcccaagucagaggaggucauuacacuugggaggaaacucacagcaccauugaaugcuguuucugaguggauccaugucuuugagcaagaaaagucucuccuccucauaccuguucuuuagaaacuugugguucucagacugcugaggcaagcccagagcucgagcccccgggaguguggucaugacauggcaagagccacacgcuaugggaggggaagauggagaugacaggucugcacugcuaguuacugccaugcuccagucccucuuccuaaucaauucuuagauaaguuucauugaggagggaggauuaccaagucaccaagucuuagugaagggagggggcccagaagccacccgucaaugcgggagcccccacucuggugccucugaaagaagggcauuuggucucugcaaauuccugugacauuccaggguagcuuuuggcccugccauucgucacccugacccugaauucauggacaaggacguggccgucacagggaugccuucaucuggucccagcucucucccucucauagccguguacucuguugggagcaauuggcaugaaguuuggcaguggcauccugaaccgggaugacaggaccaucagucagcaccagccucccgccccuccuggccucggccugccaaagccucguauucccacagcuguggcuccagccucugcccugucacacucgcacaccuguuugccauccugcuucuggcccgccagcccaagccacagcccccaagcaggcuuaaagggccgggcuugugggaggaaucggcacaggaugguauuuacucaaaaucacacaggacggugaaacuugguuaaaagaaauccuuuuguagcugcuucauuaaaaacaccaaagaggcugaccauucacauuuguugaaugcauccaauucaugcaaguaaugggacaggucaggguucacccuugccugcuacccacgugggcuuugugcucaggaagugaccugucggucuccuguagcugguuguccccaacagggagcagggcuggggugccggcuggggcugcggagggugggcauggcuuugaggaggauaucccuuccuugcuggguggggcugaguagaaugggcguggcuuugaggaggauuucccuuccuugcugaguggggcugaggaggguagguguggcuuugaggaggacuucccuuccuugcaugcuuuaagaaucccuccuccagccaggcaugguggcucaugccuguaaucucagcacuuugggaggccgaggcgggcggaucaccuguggucaggaguucgagacgagccuggccaacaugcugaaaccccaucuguacuaaaaauacaaauauauauauuagcugggggugguggcagacucuguaaucccgacucuguaaucccggcuacucgggaggcugaggcaggagaauccccugaacccgggagguagagguugcagugagccugggugacaagagugaaacaccgucucaaaaaaaaaaaagcaucacuccuccuuagcacgaauucaaccuuuuaaaaauggagacucagaagcagcacaugauacugaacccaaccaugggaccuagcaucucccugagaugguguauuuccagaaaaaggcagugugacguacagcaugguucagugcccaagugaaugauccacaccaacccuagagacuguucugaggcuaccucugaggcagacccgaaccagccaaugggaagagcacugggccaggagccagaaaaccuggauguuaggucugccucuaguucggaaaaucacugaaacucccugggccucgagugucucaugaguaaaauauagggcuuugagcaaagaaguuuaagguccuuucaacuuuaacaguuuaccauuuggucuuguggaacagugguuaugggaaggucuccuguuuggguuuauccaaggaaacaaaacucaaaugaaaauaccacuaaaaccaccaauaccuuuauccacucuggggcucccgaggaauaaggagacaccgggggaauuaucgcagaguagcugugugacuuggagaggaccgauggguacaacuaacuggugauacaacaaugccgccaauaagagcacauaaauagcaauaauagugaaaaagaauaacauugaccauuuauuaaguauugaaaguguaccgggauccaugcuaaauauuugauaaaaauauaucucaaagacuuugugaaggauuaauaaauacacacaaugcuucccaugugcugugcaucaagugauuucugcaggcuaacucauuuaauccucacaauugucccauguguuaggaacuauuauuguuacgacgguuugcagagggggagaagggacacggaggaauuacagacccacauucugccuuccucauaacgugcauucugagggcugucaucuuucuucugagucucuucugaggaugagauggaaaagauagcucuauccuggcuggggagagggauggacagaagaacugacuucugccuuaacaucuccagggugcugugucuuccucugagggagccaugugugaccagggagaaaguucgaaaauaaggacaauucuuuauagagccgcgaaugcauuccccuccccuaccccaaggcgugaaagaaucaaaugaggaaaucaggaagagauucuggaauaggaauaacaagauuucccuucccuuccacugaauuggccaucaguaauuuugcacaaauucaauuuugaagucaugcuucguaauuugugguaaaucauauuaaauuaaacagauccaugucugggcaacggcuucucucauuuaggaacauaugguggcucagagccucucacacagcagaacuauaaaggcuccuuccaaauaagcagcagagugaggggcucuggggcaacccuacugguuuuccugagaauguuaguuaggggugaccauuaauucacgggaacugcaguauccagaaugacagaauguuaguguugaagacaaccugguuaaucacuuacaugauagaugagggacugggacuuggugguaaaggaaacagugcugggucacgugaaaacaaaccagacaccacaggcaggaccuuccgggcaaugcuucccccuaaccaugucaugcaccuacaggugacuggugguggggauucaaugaaccagcaacauuggucuguucuauaaauacgagcuaucauuauuuuauuacucccuucaguaaacaugugaaccaggcaauguccuugucauaaucuugcugucauaacugcucugugauaacccagguauagacacaaucacaaacaaaggcuaucauuuuaaaacggggaagugggugagucucaugcuucaaaagcuucugcauucaucuuuaagauaccagccuuguuggacgaccaacagaagcgcaucuuaaaacucaggcaguuauggcuguuccacauagcgggugauuuacaacaaaguauagaugaagauuaaccggccuugagaugagagagcuaaauaaaccacuuagugggcagaaaggccaagucgagcccuugagcuugugcugacuuuuacagauauuuuaauaacuuuaucauuauauaauuugcuaucugauaugugcggagagaugcacuaauggagugagaguggccacaacaguguuauaaucccgcgagacuuaaucaaaccaccauguucgugucccucaugugaccugcaacuccaggaagugcaaucccuagucacauuauuucuuccucccuuuuuaucuugagauguucuuuaaaaaaaucccaaagcaacuggacauauguaguccuuccagugauauaaagaggaacuggcacagcauaagcucucugggucuuggaucuggcuuuagaaugacucagguugaacacauaaagccguaagguaaagaggacaucauccauagcaggaacuggcaauuuacagggcugggagacuuaaccgucccagacgggugagcuccugauacucaaguuagcgcugacucagcgagggccuugaggcuugacucacagaucuucccuagggaugcuuugcuuuuaugacaucaacugaaggauccugcaguguccuccauacuuccaggaggauugagcuggacauuauaguggcccaagucuuauuaaacggaacugaugauguugacuuacggaggcuaagauucagugacccaguucagauuguguggaagaaccaagacgguagaggaauuaagcaccauuuccauuccugguggguuuuuuuuuuuuuuuuuuuuuuuuuuuuuucagauggaguuucacucuugucacccaggcuagaguacaauggccugaucucggcucacugcaaccucugccucccagguucaagcgauucuccugccucagccucccaaguagcugggauuacaggugcccgccaccacacccagcugauuuuuguauuuuuaguagagacgggguuuugccauguuggcaggcuggucucgaacuccugaccucaggugauccacccaccucggucucccaaagugcugggauuaccagcaugagccacugugccuggccccugguguguuuuaaagcucaaguuucaugccaccccauagguguuaggugacaugagacacacaggucagaaucgccaucuccucuucccucugcccauacugauucccuccaggaaagaaaguagggaauuucaucuuuaagaacaagaauccccuuccaaaaagguuaauucccauaacaggaucuacggagaucagaauuggaagacacuuuucaaaaucuugaaacccuauugagaaaguucuaaacccuaaaaaugacccuaagguuguauggaauaaugauggugcccaggauuguggcauccugugucuggaggcaguggcugucuuuucugcccaaucuuuccuauccaugauucagucaacauuuagucaaacauucagucaagcauuuagugccauuguucuauuuuuucuuaaaacagaaaauagucuauuccaugccauuuaggggagcgugaacuggcuaaaacucaaccugaagacuuuccauagcuugcuaaucagaaaucaccugaauuagaggugguacauucuuccccuaucaauucucaggagugcaaagagagacaaaaaauaaacaugguuggccaauguuuguuuuuagggugaguucuauacuauuuuucuauuauuauuuugcuuuauuuacugugguugguaacugaaucucuaacaucaaaacaugagauguucugccagaaagagauuacagaagaaaagccuaugaaaagaaacuggguuugucagugaagauuuuauuuacaggaguuuugcaaucgguaucuuuaaucuccauaacaauugggcuauucuacugcuuugaaggcaauuguucaauaaugagaaggucccugugaggcuaaggcuuggaaggaagaauguaacagggcuggugacaauugaggcaggugaaacccucugccucugucaauuuccccuaaaggucagggugggguguucugagggccagagagaaauaagcaaagacacagguaaugaaagucccuccgcaucauuuaaaucacaaauacuggauuuuaaagagcccuaaaauaacugaauucgagugggccugaauuucuguuccauaaggcaaggaaaaaucauguagaugaguaaaaccaacucagucuggagaacuaugccuaauaagaaaacccaagcaguagcuuucuaaguagagcuguuuuucauauuagcauauauuguuuguucuucucucaauacaaacuugugguaaacuuugauacuacuucaugacuacaguaaaaguuucuuuuuuaaauguccaaauuugaaagacuaucuucaggcgauuuguaaaucaccauccuuuagaaauggguguguagucaacaaugccuggcaaucaagucacuuuuuuaaaaggcagcuugcuucaaaacaacagugacaugccuggcuuugggaggucaaauucuugaguccaucccaacugucuggcuuuggucaucaugucaucuuuuguucccauuuuucuguuccuaccaucuaagcugucaugagcuuuuggaggcuaggacaagaggcaccugggccuccuguuuccccaucuggcacugcucccgggacacagggaagagagcucuuucucuaucacugucaggaccucugauuccaucgguauaggugcucuagaaaauauuaaggaaauaucugaucucaucuaaaaaaaaucauacauuuuucuggcugggaaauaaaaauacuaugauguugcguucaaacaaaugauggacugagguuauaguaacacgauuggggcauuugugcaugagauguucaguucacauuuaccugucuaccauguuuguucugggggauggacuugggagaguuaucucuggacucaccugcugugccuggucaauggucugauguccccugucuuuuguacaaagauacagcaguuugaacgguggcuccagaaccauuuccucacccccagaacugugaaugugaccuuauuuggaaaagggccuuugaagcuauaauuaagugaaggauuuugaguucaucaugaauuaccugggugggucuaaauauaguaacauguauccuuagacaaaagagaugacacaaaggaggccauauaaagagggaagaagaaguuggaaugauacagucugauacagucacaagccaaggaaugccaccaguggcuggaagagauaaggaaguauccuccccuagaggcuucagagaauguauggucuugccaacacuuugauuuuggacuucuggccuccagaacuaagagagaauacauuucuguuguuuuaagccaccaaguuugugguuauuuguuaaaacagccacaggaaacuaauauacuugugcugugguuugauuaugucccucaaaaguucacauguuggaaacuuagaucccacuguggugguguugaugaggccuuugcagggagcaaacgggucaugaggauucugcccucauaaauggauuaaugccauaaucaugugaguggguuauuggugaagugccuuuguuauaaaagcaagcucucuugcacaugcuuucuugugccccuugcuuucugccuuggguuaaugcagcaaggaccccaccagaugccagcaccaugcucuuggacuucccugccuccagaaccauaugaaauaaauuucuuuuguuuucuuucuuucuuuuuuuuuuuuuuuuuuuuugagacagaaucucacucugucacccaggcuggagugcaguaacaugaucucagcucacugcaaccuccaccuccccggcucaagcgauucuccugccucagccucccggguaacuaggacucaggugugugccaccaugcccagcuaauuuuuuuuuuuuguauuuuuaguagagauggggguuucaccauguuggccagccugcucucgaacucccgaccucaagugaucugccugccuuggccucccaaaguggugggauuacaggcaugagccacugugcccagcugugaauuaaauuuauuuucuuuauaaauuacccagucucaggcauuuaacaaaagaacuaagacagaaaguugguaccaagaugugggguuguuacuacaacaaauaccugaaaguguguaaguggcuuuggaacuguauaaccgugaaggcugaacaaguuuggaggagcaggcuagaaaaaagccugcauugccaagaacgguucugccauuaggggcaauucuggugagggcucugaaagaagaccuuagaacuaggggaagucuaaaucuucguagagauuacuuaagugauuacuuaaguguaugugaccagagugcugguagaaugcugguaaaggccauucugaugaggcugcagauagaaaugaggaacaagguauuggaaacuggaguaaaggccauauuuauaaaauauaagguugcaaagagcugggugaaauugugucuguguccuaggacuuaauggaaugcagaacuuaagagggaugaacuaggauauuuguggaagaaauacuuaagcagcaaagcauugaggcugcuguguggcuacuuuuaacuacauauagugagaugugauagcaaaagaaugacuuaaagaugaaauuugcaauuaaaagagaagcagaguggaaagauuuggaaaauucgcagccuggccauguaaagagugaaaguguauuuggaagagaguacuaaggguguggccaagcaaccauuugccaaagagauuaguaugaaugcgaggaagccagauucuguucaucaaaacaaugggagaaagaccccgaaaagcauuucagagaucuucaaguugcuccucccaucauaggcccagagcucuaggaggguagaaugauuuuaggggacaggccuggggcacccuucaugggcucacugcccagggcugccucuagucucugcuuccugcauccuggugcagcacaccuuggccaccccagcuguggcuucagugggccuagguauaccuaggcugccauucugaagggcacaagcaguaugccuugauggucucuauguggugcuaauuccguaggcaugcagaauacaugcuguggaagcauggcuuccuccaccuagauuacgaaggaugccacagacugccuagaagcucaggccaagaccuaccacaggggaauaccacugcagacaguaccuagcagggcaauguugaacagaaaugugagguugaagcugccacaaagaguccccacuaaggcugugccuaauggagacacagaauuggggcuaucccugagaacccagaacugcagagccaccagugugcaacucuagccugguaaugcugcagacacaagacuucaacgugagagaggugaaguuugggcugagcccagcaaaacuguaggggcagggcugcccaaggccuugggggccuagucuuagccccauuguauccagaaggcagaacauggagucaaaggagauuauucuccaguuuuaagacuuaauauuguuuacccuguuggauuuugaacuuauaugggaccaguuaccccuauuuucuugccuguuuuucucuuuuggaguaggaauuucuaccuugugucugucccaccauuauauuuuggaaguauuauaguagacuuguuuuugauuucacaaagcuaauggaauuugcuuuaaauguuuccuugcaucucacccauaucugguuuagacaagacuuuggacuuucgacuuuugaguuaaugcuggaaagaguuaagacuuuggggaccacugggauggaauaaauguauuuuuaaaaugagaaucacaugaauuuggggaggucagagguggaaugcuaugguuugaaugugucuucucaaaaguucauauguuggaaaccugguugccaucauggcaauguugagagguggggccuuugggaggugauugagucauaagggcuccauccucacaaaugaauucaugcuaccauugagggaguaaguuaguuaucauggagguggcuuugucauaaaagugagcucucugacagaugcucucugcccuuccaccuaucugccaugggaugacucucagcagaugauggcaccuugcucuuggacuucccagccuccauagccaugagccgaauaaacuuuucuuuauauauuacccagucuauaauauauaagacuacgacaacuugauauuauugauguugaucauaacagcuaacaguuuuugaguguuaaccaugggcuggcucuaauguccacugcuuuauguuucacagugguccuaggaucugcuaguauaauuauuacucgucuuuugcagauaagaaaacuaaggcuuuaaaagguuaaguaacuugccaaaaguccuauagugaaugugguagaaacuaagguagucugccuguugagcccucauucuuucuuagccacuaugaucugcuaucuuucuuggcuauuagauucccagcucaagccuucugauauguagccaucaauaucaaauacaugcuccaacuacaacuuugcugaaacuauuaaucuuccaaaugaaaccuuuuagugcaugggugugcuggccuacauauuuacaagcauaaggggaaaguucagaacauaugcagucuacagaagaaauauuucaucacuaagaucaagcccugcagugaaucucugcagucaucccacugguuuucauuucuucucucucucucccuucuuuccuuuaauuauuuuuauuuauuccugugaacaccugauucaggcuuguugucgggguaagauuauaaugcuauagaccuggaaaggcucucauacccuacuacaccuuguuaaaagcuauuuuuaaaugaaaucauucaccugucauguuuauagccuauuauauaaauuaauuucucacauucugaauauguuacuuuguguaaccauuaaaugaccauuuauagauucacauaugaggauuucugguguuugauuguagccuccacuuucaagguaaucaaauagucccuacucccuuuguuuucaaacuucaaauugcuagaagaguaaggaagagagggaaggagagggagagagaaaggaaagcaaugcaaugcaguuggauauuuuaccuccaaggcuggaaagaggauuuaucuccuucuccuacaggaagguggaaagguuuucuuccuuuugucuauccagaugauaaagagagaaucagacggacuuaaauaacucuauacaacugagaaacagggucauuucaguaucucagaguuuugcagacagcagcaccagaauauaguccuuccuaaguaacuuuaauuuugggggaaaauaauuagcaagacagaaguuacuuggaauacuaaaaaucaagagaugauuugagaggucagggaccccucuuggccauauggaacacucaaagugaggcacgcauacucauaaaaguggauuagauguugacuggguuuggaugauaagcacuuggucccaaugaacuucaaaaguaggaaggcaauggccccaauaaaguaaacagaguggcugguaagccuucucccugcucauauacccccucuuucacucuuauuuagagauucauuauucugaguuuucuuuucucccaaacuuuauaaacaaaugcacauguaccaaaggagacaguuuauuaaggugcccaccacacagccuggccccaaaauucuucuuauuaucaacaucuaauuauaauagaacauguucaauacaagaaugccaagugaguggauagcccaacacuuuuuccaucccuccuuuggugauugggauucuucucgacacuggucagcccuguaguaaaucgauccuugacccaagagugcacgcccagggaacggccaucccacuugcacuggcuuuguagcaaggaaggucuggguuugcguccaaguucaucacuuacaaucuuugagauacugggcaauuuuuaaccucugaauuucgauuucucugucuauaaaugauaccacaggauuguugagggaauggaauaauauguacaaaugucugacccacgucaaaauagcucacaacugguccaguuaaagaguuaaaucuucuuccuacaugcuuaugacaaccagcaugcagaagaacaacaaaaugggcuuccuaguuuaucuagguuucaguuuucuguaccagcaucuauuacuccauccucauauucccagaaaggaggaaauuacgacaccuuaaaugugauacaucauauuuggucaaucaggggugaaauuuuaaaaucacucacucggguugcccaaacccaucucuaggugggaguugugacugaacaggcaucgguaccacuagcucuagaaucugcccuguucuaucuuuugaaauaaauuaaaaaagaauucuaagacucgaucguagaaguuaaugaugguguccugacugggagaaacguguagcccaagggucuacucaugacaaaauggcuuucuauucuauuucaugacaaaauggcuuuaccaguuuaagaccugguaaaauaggaaguugaaauaaaccucagcccuuuaauaguuaagaccccaacaaauaaacagugguuuaguggcaugacaacuugcccccucucaaucuguaccgugcuucagauaauuugagaugucuauuuugagugacccuccagcacaugugauucuagguaaguauuggugcuauucuauaucaguauuuucuugcugacagagucagaggagcuggcauaacccuucugacaaaguccuagcaagguaggguuccugagccuuucuauaaaucccggcaagcucgccaaacccccgguuacugacauuucuguaaagcugaaaaacauucaugcaucuggacagcaccacuguggaacuacucugacaaauuggauauuuuucugaaaacuaccacugccauuucaaagaaagccagaaacacaugcuguauuucuuaaaguaucuucguaaauauaacauagaaauuucagggcugagccuggaaaauaagcauuuuccuacugucaagaacaaacugaaggucuuggcugaacaagacuugcauauuauaccuguuaacuuuccaauuucaagagaaaaagcccaagggucuacucaaaacaugauuagcguaaaacagcguuuucuuauaggaaagaaagaacaaaaggaaaaggaaaaguuguuucacaugaaaauauucuggauacuuauuuuuuaaaaguuguuccuaaaauuuuacaagugaaguacugaauaucaaauucauauuuuggaaagaaagaacaccagcaauauaguucacacauucuuuagaguagcaaccaagcccguaggaacucuaaaagcgaguuaugauuucuuaaauguugcagaaguaaaaguuuucaagaggaacaaaaaaggggcgaugcuuaguguuaaaccugauacucuacuaagcauauaggucuccaaagagcugacgaaugcccaucacacgguccacaauaaugcuuuugcccaggagcuucagaggaugagaacucaaugugcaacuuccccccauuuuuuuguuuuuguuguuaaagaggcauaucugaugaagaaggaaaucagauuagauucacucuucaccaagaaacagagcaacucaauggugacaauaucaauuuucccccauguggcugaauuuuccauugccuuuaaaaaugcuuaagacuuuuuguucccauaucagcagaaaaaggcaaaucccuuaaucaaccuaguaguauaaauggccaguuaggcaacgagagacuaagaaaacagucuuccuuuugauuuuacacaugaauagaugaugugaauuaguuuucugaagauuaugugaauuaguuuaaaugaccuuaaaggcaagaugaaagaaucuccuugagaguuguauccucuuuggaagcaaaguauuguuuugccccaagcccaucucgcucacugaacauaccauuugacuuaauuuaccauauacgcuuguauuuuggaauuuaaaaaaaaucaauguacacauuuuaaaucauuauuaaugauuauuauguaacaggaaaccagugguuucauggauccucuuccuaaauacaccuaaaugaaccuauagaugacaggcagccccccaaaacaucaagcuuuagguuucuguuuguuuacaaaaggguuacuccacagacaggccacuuagcugugugcauaguaucuucuggaaagauuuauuuggaaauuuuccaaucaaguagaagaaccuuccccagaaaccuaacagugagagcuaauggcaugggcugucaagcuccaugggagacagugggcaugccuuuugagaacccauguuuuuguuuguuuguuuguuuguuuuuugagauggagucucgcucuguugcccaggcuggagugcaguggugcaaucucggcuuacugcaaccuccaaccucccggguucacaccauucuccugccucagccuccugaguagcugggacuacaggcacccgccaccaugccugccuaauuuuuuguauuuuuaguagaguugggguuucaccauguuagccaggauggucuccaucuccugaccucgugauccgcccgccuuggccucccaaagugcugggauuacacgugugagccaccgcgcccggccugagaacccauguuugaacccaaaauagagagcuacuggccuggaaacccaaaggaacagaugauauuuguacaucccacaauacaacucacauacagaaaaugccuggggaagcuaauuccugcuguccgagaggggcaaagagcuaccacaucgauugcuggccaccugcccuuuuccccagauguguugcuuaucuuuuccuuaacaagccugcuacuuugagaaagaaauauuacuguaaaccauaucacacacagcugcauccugcauggcacagagaaaagucugcauuuuggauuuuugaaacgguaucacagagcaaacagucauugacgucacuggucuacaguguaaaugaacuucuuguauuaucuaauuuggcacagugggccuuaggcaauuauugcaucuuacagcgcuuuaguaauugccagcuagccccaugggcuggggggaccugcauucucuauugauuugcaaauaacacccuugaugugaugacauccauacauuucaacuauuucuuaauaauaaaaaaacacuagauacaaaacccacaaauaaucuggcaauagcgagaacuugaaacaucccaucuucacuuugcuugacgugugugugugugugugucugcgugugugucuucaagccuaauggguagguaaaaaaauagcauagccaaagcuaacucuuaaaaaauucaagagagcuaucuauccaauauggauauccauacccagagcuccucguauccucuguagcagugcuuuuccuuguggggaucugguuacaaugcagaucugacucggugggucugggguggguggggcccaagacucugcauuuccaacagcucccagguggugcuguugguucgaggccuuucucugagcaucaaggggaaaccccaguuggucugggaaggugugugcacaugggggccaguugugggugguggcccaggugcaggagaggcgggcagugggcuccaucugguacuuacccugcaucugacucugaggcugaggguuaaaggcaguggagugguucagggaggcacgaggguugggcgugggggcuggguggugugggcugacccucauggcugugcgccgcagcugcuccaguucacugagccgcucggaaaaggacaagcucccgggcuuggucugaucaucuaguuucugccgauguccuauuguggggagcagggaggggaggggauggggggagggaaggagggagggaagagaucagaaaaaguauuguggauuuccuaaaacuggggcuuuucuugucuuuccccucucucuccccucaccccaacauagacucgcuagagauaugccagcugaauuuggggccacuguccucucagcagaaugggcccccuuucaccgccucggccacagagugcucccccagucugggccuuggcacccuccccaacccucuacacccacuuccaaugggcacaacucacugagauacagaacuuggcggugguggugaugccgggagggaaagaggcgcauuaauuguuggcacauggccacaugccaggggcuaugcuguggcagccaggaaagguggccucccaggggcaucagaacggcuguuccuuacugcaaacccagccacuggcacguuuuagaggcggcaaagugggccccgcagcuuagugguagggccccuuccaagaggaaaugaggcguggcugcaaacccacagccucuggggaggucccauuuccagguacacgcagggcauccucagccccucagccccucucccucucccucuccucacaggcuuuucacaagcauuccuucuucccugaagccgacucccccauguaccccuaaggaggaguugacaggaaggccucgccugugucuuguccaauauucccagcagaauaggcccacuggagcccagagguagcuacagccuaucuggugagcuuccccagggggcucaggacuggugggaugggaugaugggccccucagugucuauauagggugggauggugggccccucagugucuauauagauagcaaguguccucaucaugcucuucaccaaaacaaccgucaccaggaagcagcaagcagaggccacucaugggggacuggggccuacgguuuucucaaaauguccuuaaaccagagccaguccugucgugcaaagcugaggcuccaagguagggagguagccacaggaggccugggccauucauuucucuuuuaaagacaauggccuccugcugcuuccucagccuuaugguuccaauaaagaguccuugaucgauugcacaaccucuguucccuauugccaaauguccccaaagccagacugagaaacagccugcccgcugcccccauaaagugcuauuucacaugcccugacccaauccuagacuagaaagaggcccccuugauuccacucccgcagccugggguaagagcagaccacgagaagugcacuguaguccagcucccaauggcuacaauuauaaaauuaaaugguauaacuugcaugauggcugcaaaucuccauggcuggccauuucuuccugcugccaggccccuuggcacaguugacauugucucaaauuccagaccagaaaaaaagggcccacuauauugcagugauuuuaucauuaacgagaccuguuuggcuccaaaaugaggaaaaacacuuaagcauaauauuuauguaguucaaaugcaauggccccucuugucaugugucaccaaggcaaaucuggacucugauucagcgcuccagcccacaacaggagacuugaacgcaaacagccugagucacgcaggcucagcaugcaugugggaggccuguucuuggcugcguauuuuaagcaccggcuuuguggaugaaaggccauggggccaggucuugcagcaacccccaucaucccuuucccucagaaguaugaaaaugucuuuuuucuagagcgcucuguguuggucagccauggugugacucagugccucuggaugaagccuuccuuagcuccucccuccucuuaucucugccauagauccuuggcuuccugaugaucaaacugaaaaaucugcaguuuucuugcagaaaaacaaacaauuccaauggaacaaccauucaaaacauaauaacucagcccuuuaaccuccuaccacagucuaaugccuggcauuacgaguugggguaaagaagaaggcaggaacaaugauuguggagagcucuaucugccucagaaauaaugccagucggcaaaggcugccggcagguuuugugcucauuucaaaacuucacauuccucaggcacuuaguggcauuuuugaagaacacugugucaaggacagugggugacccaggagagugaugugagcgaggucauucugaauacacagcacuugacgugguagagucuacagccacagcuuggaaaaacagcucuuggcaguugugucucucuuagccagcaagcguggggaccugugccacggagacacccaacaggaaucaucauuccagguaagccaguccuguggucaggcacaacgugagguauuuuuuguuuguuuguuucuuuguuuuuuauuuuaauuagucccccucauuacuauauacuuagaaaugagagcuuuaacuugugagcaauuucuauaccagcugauaccugccaaaauuguagucauuuauagagauuaacugaugacugucugcuuuagcagaaguguucaggcauaacucucagagaaaacaauucuucacucuaagcuguuuucuaagcccugggagucucagggcugaguuuaaugcuggaggauuggggaagagcccauuccacucuccccacguguguuccugggagucaguaggaacguuauugccuugguaggggucuugacccucaggcucacaauggugcuggagagcugugacaccaaggcacaggggaaaugagaagcauuaucauauucagggugugguuuggaugcacuuacaagcuagaucgaaggaacaucuaauucuuacuuucugaaaccaucagaccucaugugccaaauagcaauauuuugcaugaaauauaggaacuuccgauauaaacuuucaagcuggggaaaaugaauacuuuaugucuucaguuuccuguaucuguguucaguuaaaaggcucauuugccccccgaauguuaaauagaggaguauggaaaaugucuacuauccaauucacuuuucuucuuucucacugaguaccgggcuuuagagggcaacagggaauucgacccugggucaagcccuuggguagaaccaggaugcagcucugaacaccugcaugcuggcagcuuggcuucuucagcauguuuggaaucaacugugaauguuuacagggcggugcuuuaaaguagugggcacaucaagauuucacccugggacaucuuaaucuuaagcagaguugaaaaagguccuaaauucuucuaguaccauuuucucauuuuugaaaaaaaugaaaguacuugcuuggaauuuuauuauguaugcagagucauaaaaauccaaaaaaggggaaaaaauuguauauaauaaaaauaagucaaugccguuugcaaaauuuuacuucauuccaaaggcauuccuauuguuuucgggguuggcugcucauuaggccauccuuaaauguuaugauauuuugugacggauagugagaccagcuuucacuuuucugccauacaaaauaaacugagcagguaugcauaucucguugauaaccgagcugccuuuuucaagacaccauugugaucuguggcuguaaguaacauaaauguaauauaugaucuuccauuaaagaaaccagauaagguuaaauugccaccguuucuuggaaaauuuugguuagauagaauaaagaauuuucuggcagucaacaacauauuagucuauguuuccgauauggguuuacuaguuuucuugauagauucuuagcagaaaaaugaggaagguauauacucagaagacugucaugaugagccguugagccaaaucuaugcaaaagcauaauaccaaaaagauauauuucucucuguauauacauguauaaaauugugguucuucuaaaagcauauaagaauuuuauauagucaauuuuaaaaggauaucuguauuucagaagauguuggccagucaauuggauacucacuacaugaaucuggauauaaaaauaugggguuuucuuccuuugauuugcuacuguuuuaugacaauggaaaagaaaucaauguguguagagaacagcuuacuuuuccugguaucacagucuaaccuuuagguugcagggucauuaggauuucaaagugacaguacugaaugugacucuuccugaagccccuugcagaugguaaaauaaaucucccuaauugcaaaccuaaccauaugcuggcuaauuuaauguugggaaauauucuucaauauuauuuaccauaccacauguauauuauauauacuauauaauauaaacuauauaaugguauauaguaugucaguauacauucuaauucauauuauauaugcaugcuuauauauuguccagugcuacguaacuauggguagccucacuuucccccaccccaauuucuucucauaucguuaagcuaagacaacaccacaagguuggaguacuucagaacuggagaauggccacagaaaucagccuugguuuuuaacuaaugugugggaagugagguucagagagguuaugucauuugcccaaucucacacggccaguuacaggaagagggcaggucugaaaacacacacacucucaacacccaccgacacacacacucggaauguacacucagugcaccuagaaauucaacacccacggacacacacacucagauauguacacucagugcaccuagaaauucaacacucaccgacacacacacucgggauguacacucagugugccuagaaauucaacacccaccgacacacacacucgggauguacacucagugcaccuagaaauacacauuucugugaacucaaagcgaacaggguggagaagugcacaaugcuucauaguuuuagaucucagagacacgaaagcacuugaacuuuugcauucugccucaaccaucucacuucugcucccaguguguguguagaaucagaagacagccccagccacacugugaccugcaggcugugaggcuguguuucaccugcuugagugggcaauggaauuaccugggcauucuaguuugguagguuggucuagggugaagggccugagaauuuggaguucuaauaaggucccaggugaugcugaggcugccgauacagggagcacgcugggaauaucugcaugagagggagagcuccuccugauacucaagcuuccaaugugcauuacuacuucccuucuccugccugcuucugauuugcugugugcuggggagaaacacgcgaacuaaauaugccugaacuguguuuagacuguguucaugagcaaugacugacggccuccuuuuggugauaacuauuuggccgucuuuucauuuuuuuaacucuucaauacacacagagcagcugaaaaugcccaaacucugcccugcagauaggccggugugugaccgucucugucuccuacaauaacugggcacauucugucagagucacugucaugauaaucagucugauugcuaaggugaaccccagauucucaaguaggaaguaauuucugcugugccaucuauagaaagacuuuggggaauggcagggaaggguuacauggaaccuuuauuccguuccacaaaugcagcaguuaaguucucugagugcccacaggaccggguguuaaugcagaugccacaauccuccuccccucuagagaaacaacauggucccagggaaacgugaaugcuagaguaggcguuaagaauucuccauucuaaaucugcuuuucuaccaaccuuugcuguggacaagaacaagucucuucaucacugaggcuccguaucuggaagccuggaauuaagagacuaagaaggauuacuccaagggacucuaaaagcauccacaacaauuacaucugcugccauuaucuacucaacugguucuaagcacggucuuucuugaacaacuucuaaugagguuacgacuuucaaaguuuucccuuuugucuuuuuucaggcagacaccuggcugcgggagccacugccaagucuagcugucagguuggucucagagcucugucuugauccccaccaggucgcccagccugcgaucccaccuggccugcucuaucuuucugugugcugggggucagcagcuuugcacgagguguccuaagaauucacucucccucugccuccagcuguuucaucagugacccuuuggacaguuaguuaugagugaccuuggacuucaguauucaaaggugcccuccucucucccuuaagccuucacagagccuuucgugcuacccuacugacugggacauuccauucugcuuucaccccucccccucuaccaucccaaggcugaguccagagggagugggacauuaaacacaccuuaaaauuugcuaggaaguugucagaggcugcaccugggaagaaagccacucugcggaacacucauccaggcucucauuucccagcuucuugucuggguuggaaaacaaugagacaucugcccugaaugcccaccuuuuccaucaguggcaguaggcacauaagucuuaggugaguaccugucacccaccccgcccacacucccugugcaggccccuguuccucuagcucaugccccuaagccucuuagagguggaugaauccuggcaaguccccuaggauaccuccacuuccuaggaaucccuuuuacccacucagcgauuucuagaggggugaugcuuuagccccagagaaucaccagcaggaauagcagagccuuuggucggaaagagcuuuuguacucuugugggugguaacaggaaagcaagcacucacuggguccaccuguguauggggcuuuccuacucugggccuucccgaaccaugguccuacaguggccucucaggugacaugaaguacaggucaugucaccugaggucagguggcauuuucuuaagccuguuuucuaaggcaaaugccuccuacuugaaacuagaaggcagauagguugagcuccccucuuugcuccggcagcaguggccaccuugcucuugccccugugucacugcccuggggccuuugcacuuacuguuuccucugcucaggaagcucuucccugagaucccuguggaccugaucccucccacccuucaaguauuugcugaaaugucaucuucucccugaggaguuccuggagauccccuuuuaaguugcagacuaucccacauccagccagucccuagcccuuuggcuuagguuuucuccauagcacauguuaauguuauccagggucugucugcacccaugggacuguaaagucuacaaagacagggauuuuguauuuuuucugcacagccaugucuccagcaccuauaaaaccaacuggagccuaggaggcucacuaauguuggcugaaugaaugaaugaguacucagguccuucaugauuggugcuguccaaucacccuccacuagguugugggaaagcagaaaucauuucaggugaaggaaguuguaauuaaaguuuucagcugaaauguaacuacagaaaaacuucuuguugagaaaaaauacaauaucauaacugagcaguuucaugagaauugucucauuagaaguugaaucaguccgggccugauggcucaucccagcacucugggaggccgacacaggcgggucacuugaggucaggaguucaagaccagccuggccaacauugugaaaccccaucuccacuaaaaauauaaaaaaauuagccaagcaugguggcgcgcaccuguagucccagcuacuugggagacugaggcaggagaaucucuugaacccaggagguagaggcuguaguaagccaagaucgcuccacugcacuccagacugggugacagagggagaccucuccaaaaaaaaaaaaaaaaaaaaaaauuaaaucaaucaggaaaacucauuuauuuucauagugaaaaaucaaaaagaauaggucaaaggcucuuuugcugaguugagaguggcacucugacauaagcaaaguccaccagcuucuccuguuucuuuguagugaguacccucucacacgcacacacagagagacauacaaaaacacagauggcacacaugcacacacauacacacauacagacaugcauggacaaacauacacacggacacagccauacacauaaaaacauacagaugcagcugggcgcgguggcucaugccuguaaucccagcacuuugggaggcugaggcggacagaucaugaggucaggaguucgagagcagccuagccaguauggugaaaccccaucucuacuaaaaaaugcaaaaaguagccgggcaugguggcacgugccuguagucccaguuacaaguaaguggcugaggcagaagaauugcuagaacccaggaggcagaaguugcaaugagccaagaucaugccagugcacuccagccugagcgacagagcgagacucugucucaaaaaacaaaacaaaacaaaauauagauacacauggacacacauguauaaacacacauacagacacacauggacauauacacacaaacacaggcaugcauguaaacacauacagacacacacauacacagacaccuggacacacacacagauauaaaacacacauggggauacacacauauaaauacacacagacacauguacauacgucacacagacacauauauuaagacaugcacagacacacauacacauacagacacaaaccaggacagacacauauauacagacgcacacacacauauacauauaucacacagggacacacaugcauauacacacaggcagauauacagacauggggacacauauauacaaacauacacacauacugacauacacacauauacacauacauacauauacauccaucacacauccauacauccacucacacacacacaccguucugugaucgcccucaggacaugggccaagacaaguguagcaagcaacagucaauggacaggaaaggcuggccaacgccaaggcaagaucaacaaccaauacaacuucaagccagagacgcacacaggccugccccuccccagccccccugcaccaugcgcccaagacucacgggacaaaaacccaaacaaaacucugcucccugaguccagggcucauugccacgagcaguggaguuuuucgcccacucacaugagacucgggccucuccuaaaagcagagcacucaaaaucuaaaucugccauccccggucgccagggcucacuguccauuucugucuggugacuaaggagguaacuugagcucagggcagagaagccaccugcuggcuuuugcucuugaccagagguagcccucugugggggaaguggaggcaguuucuuaagaagggugcagacagcucccaaauucaagguuuuucuucuucuaccagccuauaaucccaaauauuagcaacccucccuagguuaaggucuuaucucaaggaaacccccaguuacagcguaacugaaaaguaaccagagagugguaaccaccagugacauggauuuguugaucagaguagcuccugcccagggacagacucuaaagagaaggcgacuugcagaagagaaagaaaguauugguggcggguggcgcacuauggagauaugagcacugacucacagaacgcugccuggagcuucugacauggcuuuggaguucaggcaucagcagggcuaguccugggguagacaggcaagaccugggggccaggagaagaagauccaggaggcgcacacacacugcuugcgugagcauguuaccagcacugaggcucuccacacuggccuccuaaccucccugcaggaaucucaguuccccucccgcagcagcagaucucauacauaaugggcagagacacugagcauguuuggacaggaccgagguaaaggcagggcccuuccaagguugggugaugccuccauaaaugcuggacaaauaaaugaaugagugagugagugaaugaaugaaugagugagccccuuuccuggacuagauuuauucuggaaugcucauccagcaguguggaggaugaucucuccuccucuguacuucuaaaaagagggaaggaaauucccuccuauuucuaaaagcccugcccccugggccucggggacuuucccaacagcaggggaacagcaucugacucugacgcucucuccugucacagacgccaacugagguucuaggcuggccuugcaaagcccuuggacagauggcugagcagguccuggcugguacagaaggacaggguacccuggccacucacagcuccugaguacucacuaguacaaaagccaaccgcagcaaguuguuuugaacagaacguugacccucccucacaaauaaggcuuccgguuguuugugucaugacagccucauucaggcaucaggcucacuucuaugcacuguuguccacgugccagaagcagccaccugcugagaagggcaucugugaggagggagaccucuucuaaaguuaccugaaugggcaaguggcuguuugccuagacucccacagagcacagcauggugaugaagaugcuggucccacugucugccagguaacauugggagggaaaguucuguuuauuccaagacacuagugccuccuauucaccuuggugaccacauuugagccaguuaggaaaugaaggaagggaagguuccauccuugccagggauggagacagggauggagggcaaggauggacgcccaggacagccuucuguccggcaacauucccccuccucaauccuuucccgauucgaaagguacacaacuucccccuggccugucuaccuugagucucugccuauggcugccuggccuggugagaccagccucccagcuccucuguguuacgcaggcaauaggagagcugccuuuucaacaacuguuuugaacuuuccucuccuuuuaacuccuucaacagucccucuucugugugaacacucuggugugugaaagcaagaccucagcucagggagacagcccucauaaacugccgcagauuacccugucuuuucccagccggagggggaccccgccccacucccuucccagucucuuccccacccccaacuuuuuuuuuuaaccacuucugcuuccuucauuuucucagcagcugcagcggagagauauaguaaagcuacuguauaggauuuugaaagcagggccuccaagagcuuuccaaacuccacacaagccaguuauucucugccuuguuuucuuuggcuucagguuaguaacacagaaugagucaaacaguauuaacuuucaauagggaagugguguggucaaccaaagcuguuugcggcuagauuaugaagauagguagggcagguaaugcagaauagcccauaauacugugaggaggcagaggagggaggcggccccacucagaaacacuccaacaauuaagucaacagaacuuacaccaucuuuuuuuaguuggcugaggaauuaacaccaaggucucugaccagccagcuuugggaaguuggccauaauggggcuuggacaauugaguacuuuguggguuuaaggaugucuuuuuuuuuuuuuuuuuuuuucaaauguugccaaagucaugggaacucuaguuaggaagauuuccccuacuuagagcaugucacucuggcguggaccuucauucaucucuuuccccggccugggguugauccauucucccuucuucccccuucuccugcccugcccccaccuucucagucacaaucuuugucuucccaguuuggcaggacaucccaggggccccugggcuuuccuuccugagguuagaagauggugcuuugaaagaacaauugcuccuacaaccaucaaaucaaacuuuuagaagcugauaaagaccuuaaaaaucauucaaucuccucuucuuucuccuucuguagaugaggaaucugagggucuaagaggagacaugagcugcugagauugacugagcuagcagggccagacauagacuccacgggcaggcccgcagucuuuccaccaggucaggccacucccucgcccagggcucaagauuccuuuuagaguucaacagagcagcucccgagaacagaccagcccucaagacucaaauuucagugguuuccaguucuuucucccugcacucagcuaccuauuuauuuugagacuggcugaaucacccgaagaauagaacggguuucucugaagcugcucccggcagcaugucagcaaaugaacaggacagcgagcuggccucuggagccuuggaagauucucaccuccaagcagcugcaguuuuugacucguccugggaaacuggcacugagacucagggguguaacauuucaccucccugaaaucaaauccagaaaucucaggcgagcagcauauauaaaaagccacaggggaaaaaaggaauacggacucagcaacucuuaggugcucugagccucuucccaagccuucugguucugugagcauuucauugaaagaaaauggaauaacagaguuuuagaagaaaaacuguauuuggucuugcaagagaaaaguauauucauauaaaacucaguucucaacuauuugccaagguuacuucuuuuguuuccaacauuuaaaaaggguaucuaguuguagguagagaaaacauuaagauaugugaauggaaaaagguaaaauuucuaaaaguauggauucacaguggggucugauuuaaauguuuaaauuuuuucucuuuaauuucuucucaccaauccugaaagacacgacgagauaauaucuacuuucaauaaaucaauuaauuuuauuuaaaaucccuaagauuuuaauauaguacaugcaaaacaauaauagauuuucuauuuuuuaauuaucuaauuauauuuauauuaucuaauugacagacuacuuaaaaagcacauugauauauauuaucucaauguguccucaagaacccugugcaguaggcagaacucauaguauuauucccaucuuauagaugacccaggggaagcuucuagaugcucagagcuuugcaggucacacaacagcauaggugcuucauguuaagaagcagaacugcauuuugauaaaaccuuuaauuggaaaaagaucaccucucccucaaggaaguagggcaacaugguugacaggguuauguuucaaugaggaauacauuuguugaagccaguucagugaugcaguaauuggaauuaauaauagguaguauggaaggaaaagagaaaaagcccuuauuguacuguauugugagggccaaaucugccaagcuuuuuuuuuucuucuuuuuuuuuaaguacuuggcaaugguaaauauuuggcccccacuugaacagaauuccauuuguuuccucucauaaggucuuugggacauggucaaggggccuacccgucuagagcaugugcuuuaauaauagcagcuaauauuuaaggaacacuucugugcccagcacggugcuaugcccuaacaugaauuauuuuauucaauccgcacaauaauccccaacagagggauaucauacuccugguuuuauacccaaggaggcugaggguggggagguuaaucugaucccgaaggggaggccaggcugaaucaggaagccagcucuggagcuucgccaucagccacugcuccagcucgccuuucaggcuaucucuuuuaauccucacauccccuagcaagagagguaucaugcaguccauucuacagaugggaaaacugugaaacgcaguuuuagacuugaagcuccaaacuccuuucucgcucaccgaggcuaccugagcacccugguucacuuuauuuuuugagacagagucucacucugucacccaggcuggagugcaguggagcaaucucggcucacagcaaccucugccucucgaguucaagugauucuccugccucagcaucccgaguagcugggauuauaggcgccugccaccaugcccggcuaauuuuuguauuuuuaguagagacgggguuucaccauguuggccaggcuggucucgaacuccugaccucagguaaucggcccaccucgggcuuccaaagugcugggauuacaggcgugagcuaccgcgcccagcccccugguucacuuuugaaacacugggcuaugccuggcgaguaguguccgagaggcgcgugggacguggcuccgcauauuucuccuagcucuuucaaaugaaugaacuggaaauaucauacaaccacuucaaagguaagugaaaauaaggugguaccaggaaaauauucaaagggccauaaaucuauguaguaucuaggaacuuauuucaaauguuuacucuuuauuuuaaauaaucagaauaugacuuuuaagccauggugaacaaaaacaaauacaaaaucaaacaaguaucaaauguucgacauuucaguauauggaaguacacugaaagauuucaauagcagucuggguuuuugucaauaauugcuuuaauggaaacuaaguauauguauaucaugaaaguaccaaaccaauguacugccuuuaaauaacuuucuaggggucuugagaguuggcagauugauuccauuguguuacuuuuugaaaaggcaaacagaaaagaacuuugcuuuggguacauauauauauauauaauauauauauaauauauauuauauauaaaauauauaauauauauuauauauauauuauauauacuauauauauuauauauaguauauauaauauauuauauauacuauauacauaguauauauaauauauuauacuauauauaauauauuauauaguauauauauuauauauauacuauauauuauaauauauaguauauauauaauauauauuauauauauauauauuagcuuggcuuucaccuaugaaugugaauccagaauauuuggcuauucaugacagcaaauuuuaccagugacacggcauaauuuacacauagaaguugaugaaaauauaccaugugucaaucauacuauaaaaaaggaauuucacauccaacuaaaugucacuggcuugugauaugucugauaauauagccauaauguacgguaauagauuauaccuaauuuacccuuucuguauugccaacuuuucauaauuaauacuuugauagcaaaaaaaagcaaaccuucucuaaaaguugccuuuaaaggaaaagaauaugcgaugaacaggagaacacagaaauugccuaucagcucaaaugaauuuaaaugcagauaugguguaaggggguagcuuuuacuuauuuaagcuaaacuggaauuauuauuauuauuauuacuauuauuauuuuggugguaguaguggaguuccaugagacccaguguaucaaauucuuacuaaugccuuuccuaguuacauggcuuacaggaaaaaacaacaacaacaaaaaaaacugaagccuuugagaaaacucaaggagaaauuuuucaaaaugaaaaauggaaaguggcuaggguaugagaaaaauucuaaaucuaccugaaagcacaggaguugauguauuuuaaugugcugggaugcugugacugccaaccgcaauccaucugaaagcuguggguccauccauccccaugggagacgugcacccaaugacaaggccugaccaucucagacuggggcugccccaucagacccccaaaggacacaggcagcaggcggagcugccuugcacacauggaagggucuccagugcuggucacugauuuaggaaacucaguggguggccggccauguuuaugugcuugcaaagcuuggcugcggggagagaucccaggcacgcuugggagacacacugcauuugccuaguacaagaauuccgaccccaagacaccugcuacauuacacgucacguuucuaggacaguguggagacuucugcagcugugucaugccucuacugaacaggacccauguguuagaucuuaagcacugauguuugaugucacccacacgugacuuuucuuucugacuuuuucacaaagugcaacauuugggggcaaggccauuucacccguuagugacuuaggaacagugcccagaguguuuccagggcccaugcuauacuagaaaagaaauuuuacugggucucaacacaaaacgaaauccagaaaaauaaaucaaaauuuauaaauguuuaauuaaauguaaaaaaaaaaguguaccauuauggcaacuucaugaauuuuuaaauuuaggagccacagaucuuuuuugguuaaaguuuucucauuuccagaaggauuucaagacuaaaucugaauuauaccuguccucuuuugaguauguauugugugccaggcaugguucuaagccacagaggcugcugcauucagccuuccagugaugugacggugguacuaccaacuguccccguuuuggagaggcucagucagaccagcugcucccccaggaaucggcucucauaguguuagcaagugccaaaauggagaccucaaccccuagucuugauuacauguugguggcagagaaggcagggcagccacuuacagccagagaauuucagaacaaauuagaaagcccuuuaaaaacuuuacagcaaaaaaacgacgucuaucucauguaccaccugagugcauguggauuugccugaugugauuuaggauggcacugcccagggaaggccuggaggccucggccucuaaggggccaguuuacgggaacgaacuuacggcuuuauuuugcugaccauauuuuguuacccuuuuugcaugagaacuaauuuagagauuaucucgucccauugccugguucaacaggagaggaaaaugaagacgaaaguauuuaagauaauugcucaaguucacacccacuggccugguggcaccagugugaaaacccaggucccuaaauucaggauccagaaaacuuuuuacauguuugaagcuuaagaaacagaagccuaaaugcagacaggguuuuuuuuuucuuauggcaugucauacaaugaauucuaacaaggacugcaauauauuaguuuagauccugaccucacugguguggcauucaaauuagugauaugguuuugcgaggguccagacggaaagagaaauucaauguaaugguguaaguuucuucccucuucucugcucccacauuggauugagaaggugccuagaucaucucuuuggguuuucacauuaccuggaaggaacucuuauuuuguuuucuuucuauagcaauacaaaugccaucuuagaaaaucucagugguggccaagcacaguggcucaugccuuuaaucccagcacuuugggaggccaaggcggguggaucagcugaggucaggagauggagaccauccuggcuaacacagugaaaccccaucucuacuaaaaauacaaaaaauuagccgggcgugguggcacacaccuguagucccagcuacucgggaggcugaggcaggaaaauugcuugaacccaggagguggagguugcagugagcugagauggcgccacugcacuccagccugggcgaaagagcaagacucugucucaaaaaacaaaacaaaacaaaacaaaacaaaacaacaaccacacacaaaaaaccucagugguuucuguauaagacaggaaaaguuaccaagaauacacaggccacgccagcucacucagagcugcaccagguggguuacugccgcuucugggacagaagcccauucccuucacgguccucuuagguucccauucaccccaggggcccuuucagaccuuaaccuccacucuagggucaaggaagucuguaugcauguaaaauucuucuucuuggacugguuugauacuacuaaaaauauucaacagaaagacauucuaaaauucgcuggaaacauuuaggcacgauuauuauuaaugcuuuaaaaacugccuuugccaagucaucagguaguugaggagcuuaacacagaaggaauuaaaaguaccagggggaaguucccccagaacuuucagcuuggccugaaaugccuuucaaaguggggaggaggggaugugagucacgacagcauuuuccuccucuuugagccucugccuugcuccugcuuuaggugggaggggaggaagaauuacuuucuaauuccuguguggaucaggauugcaucuagaaagaacuaaaguccaaguccaaaucugaugaauucaagggaagaggaauuaaguagcucaucauucacuaccuggaaaauacgcuugaagcaauucccagugagcaaugcgauuguggauugguaauuacaauccugagaucacagauccauaaaaccaucugacauuuucauaaucauucaagagcaaagagugacacaucuuuucauccccccggcggcuacgugcugugcacacgggcccuccacgaaacccuuuguuaaagggggacccagacuuggaccacuacucugcaggucacuccacuuuacccaucuuucgugaaggccaacaccggaagaagaggucuauguuguacaacaccccggggucaggucccccuucaugccagguccccaaguggacccuggugacagaagcagaaccaacugcuggcaccugugaccagcauggccauggcuguguauuaugaacucuggggaggugugggaggggaggguacuuccugcagcccugccggggaaaacacugauucccuccugucaguacaaaaaaaaugaugaaugccaaagcaacagggcucugcuuucuugaagaaaacuguaugugacccagaacuuuacugauaaacucucccaauaaaaaauacaggaauuacauuaccaugaagcucaaaaagcggccagugcaguucuuaaaaacagacccuggcaucggugcgugccagcaucuggacgccuuaguuuacaugcuggcuuacuaguugcgugacuuugggcaagguauacgauuuauuuuuucuucaauuucccugccuguucuuuugaagauuauauaaauuaauaugcgugaagcacugugaacaguguugggcaaauaacacuauuuaauguuagcuauugcuauuaucgaguauuuuuaugauuaagagaaaauaacaaugugaacuagguguuacucaauccuaagagcaauuauuuuuagguccauuaucaccaccaguuuacagguugguuccuucccuuccuucccuuccuuccuucauuuuuuuuuuuuuuugagacaaggucucacucugucacccaggcuggaguacaguggcaccaucucggcucacugcaacuuccgccuccuggguucaaccgauucuccugccucagccuccugaggagcugggacuacaggcguguaccaccacaccaggccgauuuuuguauuuucugguagagaugggguuuuccuguguuggccaggcuggucuccaacuccugaccucaagugagccgcccgcauuggccucccaaagugcugggauuacaggcgggagccacugcgccuggcccauagguacuuuucaugcauuucucuucuucacuugaagcacauucuccauauauaaagauccuauuucucauguucacauauauaauagguuugcuauacacacucaaagucauagaagaauuauacucauaugacaugaucucaaccaaguacuuuaaaaaguagcugagugaagauuaggcccuuugaucaaccuauuuuaacuauaacucccucuaaaaacaaaaaucagacagaaagaaagcuagugccucaggaagcacucuacaguuuguaaguaauggcuccaccuuaccaucucuaugaaaaaaauuaaaaaauuagccgggcauggugguggaugccuauaaucccaacuacucaggaggcugaggcaggagacucgcuagaaccuggaaggcggagguugcagugagccaagaucgcaccacugcacuccagcaugggcaacagagugagauuucaccucaaaaaaaaaagaaaaaaaaaaagaaaaaagaaagcugcacauuuuaccuuacucccuagcugcccucuaagccaguaucccagaugucaccugauguauggaugcuagaagccccacccuuaaacagaccacaucacaagacucuacguuaacagccugguccucaaggacgggcugcccagagagcagaggcaacgcugccuccacccaaaaggaaucccgugagcucuagacauggucauccuugccugugaggaggggggcagcugcagaggccuguccuucccuccagguuuguacuucccggcaucugcuggguuacaccuuuccaaaauuacagccagcucuuucacuuuuaaaauagaaauaacuauauuuaauuaaacaaacaaacaaaaaaaucaagagcucaagcagaacacagucacgugaaagacuccuuuaaccuggggacagacagaaguuaucucagaaauggccaauacguuaauuaaccuuuuugauuuuuaauuuaguuucucaauguuccagacguaacaaacaccugaccagacagguaaaggcugcccaauccauaccaccaggaccagccccccaagacgggucaguuaggguccccacugcucacucuccucaaccucuccuuggcaaaauaucuuccuccauggcauugaaccaauuccugcauugaaauuauuuaaugaaaucucuguagagaagaugcuuugggaucucaauauuagcauagagacaccuaaauuacagauuugugagcugagagcuggaguuuuucauuagauccuagaaauauaaaacauacauuaaaaaaacaacucucagccauucguaguagcucaugccugcaaucccagcacuuugggaagccaaggugggcagaucacuugaggucaggaguucgagaccaggcuggccaacauggugaaaccccgucucuacuaaaaauacaaaaauuagcugggagugguugugggcaucuguagucccagcuccuccagaggcugaggcgggagaaucgcuugaaccugggaguggggcagagguugcagugagccgagauugugccacugcaccccagccugggcaacagagugagacucugucucaaaaacaaacaaacaaacaaacaaaaaacucucaaauauccuuuucuugaaaaauccuuucgcucuaucuuuugugcuuaaggaggagacacucucaguauaucaacaagcuacuaagugcucuacgugcuaaccgaaaacagagcccaccuuggugcugguaagaacccauuccaggcagaggauaccuuuugauggugcucuugcuccaugauaaaguuaauuuuucaacaauuaauaauuucuauauuacucuaagauauuucuuaaaauccuauggaauaugagaaaaacaaguuuugauuuucuaaggggcagguccauuacuguaaaagagcaagaaaccaucugaaacgaaaaacacuuuaaauucccuuuggcguaaacuuuuggcuacagcuucaccacugaaaacccuggaagaggggagggaugcaucaaguuuacccgucggcaugaaaaacagacgagcuguggcacagcuucucauucucaguccuuaacuuagucagcggaauggcagguugaauggcaguuugucccuccaaaugccagauaacugcuuuauuuaguuaagcuugcacgcauaccucaagucaaaggcuccacaccugcaaugaggcacuaccauuugcccuucuauaauagacagucuucgagaugagccaaauaugccagccaaucauauaagccaacuccucauuuuaaaugugaggauaccgaggccaggucaaagagucuauaagaaagaaauagaugauguacagacaguaugguauggauagagagaugaacagaugaauggacagguagauaaaugaaggacagcacagaaguagacaucaggaacuccucauucuguuaacgcuucaucaucaacuaucucuuuuaaagcuaggcaaaccguuucauuuuucuggggcuauuuucccuuaccuauggggugaugauccuaaaggcucuucucaggccccuccuagcucucauugucuuugauuuuaugaaacuagagaauuuuccaaaaugauucaauuugaccuuggcaaugccagggccauuuugccaggauuucccagaauucauugcaccauaaucauggaggggacucgggaggucuuauucauccagagaucuggcaacaucugggcauccugauuuacaugcaguguccucucuuuauguuacacuggaaagcaacugugagcaaagcuuacuauagaaaguucccacccugaaugaagacguucaaaccauaagaaaccagcauacuaaaauuagcagugauggccccucuugcuucacagggcaaauagaaaagucagcauuacccaagucaaccugggagucugcaugcacuuggcuuuuuucuagaagucccuuguaaaaugugagacuuucuaccuggggcuauugcaccucuauauaucauacuuauacuuauuccacgcauuuaguuuuuccccaggccccaaauuccauuuggcagggaagacuguguaaaaauggaugcuucuuuggcgcaaaucccuucugucugcucagagggugcuucuccauauaacaacuguuuucuuaaguuguaaaacagcaggggcagaguaaacuguauauacagccagaccguuacaaucgcauagacaucuuuuuuccccucugacugccaauucuuaaaagucagagucgccaccauuuguuuucugaagcucaauaacuuuguuauuucuuugaauguuacaggaaaugcuggcagugaggcaaaacccagccuucuuuaugcaugaggaaauaagagaaguagaggguauacccagggucaccuggcuucggcuucuucaggcuggucggcauuucaacugucccagagacggcuguugcuucuaguucuaaauacagugguucuacagccuccugaaggagcauuucucuaaguuuagucacccucaaagucgauuuucuuauaccuaacaacugccucccucccagccaggccccuugccauaauucaagccugcuuccucuuugguccucuguggagaacaaacuugcuuugguguuuauguucuguuuaaugcaggguuacauuaacguaggaauguccagguugacauuccuacucuggaaaccuaagaagagcucacagucauuccuuagaccugugugguccugucugugucuauggccugcuuuucacucauaaagaagaaucagggucuguuaucaagucccacagucucccaagucuaggcauggccagaaagucucgaucagaaaaagcugagagggcccucuggggaaaaaugcagucagaucuggagggagucaccgagcacagcaaauggaaggaagggaaaaagcagacgaggaacaccauauccugguggccugccccuggugggcauggugauuauuugcagagcuccauccacucaaggacuuugggaaaguugaugcagcuuggggaaugguuccagaaggugacccagaugccaugagguuguggccaggaccacagggaaggcugccauaaaagcugccgugaucacaggauagccugcagagaacuaccuuaaaaccccaccuagaaaccaccaugcagggaaggucaucuagaggggacuggagcaguagccagggaugaaagcagggaugcccuacuggggaucacuaacauuuccugccuucauucucugcaucaggcacacagcaucauuuggcuugaucuuauaaagaagcucucauuauuauccccauuuuacagaagaggaaagugagguucagcaaggcucuguagcucacugaaggcuuaagaauuccacuggcuugcccauaaagcccaaauucuuaaccacuucauuuuacaaccugaccucccugcaucuuggcuuuuggggacaguaggaagcccuguuuuucaauaucccucacuccaagaagagaguauauuaauuuuccaccagggaccugauacgguuuggagacaucuggaugcugggcgggggugcugggcaguuccacagaccuggaacuguaacccagccucagauccuggggaagggugugguucuggaaaagagcguuacucugguguuuacucaaagauagucauuaagucacugugaagacaucuuuucugcagacuaaacaaccucacucauuuuuuuaaaagcuucccucacaggaguuauuuuuugguacuaucuuucuauauuuacugguuuuccccagacauucuucuacccucccacucucuaucuuaaaaaugccuguaauaagauuuugaucugugccauagaaagaaaagggucauuuucauaguuuucaucucuggcccucaugaauuaauaaaaggccagcauagacgguaauuacucccuugugguccacucugacccucagaccucuuugggcugccucugugccuggccaaucuuccauuuacuauuuguuucugauccuguugaacuuuacuguauauugaggaagcaguccuuaguuucaugcugcccugaaugguucuaacauaugauucagucagccuaauuuccuuuugcccucuaaaaggaugcuucaaaaagagcucagugcacagaaacaagcuuugaguagcgagaguauugacaaugcaacuuuuuggcuuuacgggggccugacaucccccugggggaaagguugaacccaaggaaucugagacauggucccugaguauaccagccuggaggguguaccagccuggaggguguaccagccccaaguggaugcacuuacuucgagguucucggggcccauccacugugauuuugauggcucugugguagguggcgacuugcgguggguuugugaagacagugauggucagagugaagcuuuucccuguggggacacgauagagaacaaaacagaaugagguugguggccugaacauaucuguugaauaaccaaucauuaauuuaugcuguccagcccuucagcacaaguuaccaguuuugacaacacucccggaauuuuggcuuugcuucaauucuggaauacacaccuaugauaguugccuaaguguaacacuucacauaguuauauggcuuuaauguaaucaucaauaaacaauacaagaucaagaaagauuagaauuuauuuucuguuaagucaggauuuccggaaaccauagagucagauuggcagcucuccacuucugguucccaacuucccugcucccaucuuucccaauuauuuauaauucagggcaaauaagaguagaagaaaccauauccaucuuucucuucuuacuuuguaccuuugaagaucaggaaagauagaauuucuaaguuugaaaacaggcuaaauuagaaucauucugucuauauuuuuaaaagacgaagucuggcugauuuuaaauauuauuugaaaaugccagauguuauuagagguacucaugggaucagucagaauaaaauugaugacucauaaauggacuuaaguauauguaacugacagacugagauucaauaaguacuaguaauaaaaaaugcacaaaauuuccauuacacauuuuacauauauuuauaaaaggugagaaaaucuucauugcauagauuuacuaaucuaaaaacauuucuuguugguaaagugauucagaagauaaaucuggcuagcugaccuuuggcaagucacuagacaccucuauguuccucaguauccuuaccaggaagaugguuacaugcaaauuuuccuaccuuagagaguuuuaggggagauuaaaugauuuaccgugaguaacccuguuaaaacaguuaucuggcacacgguauucaacagggugugucugugcguguguguguguguguguguguauguugucugcuuuauuucucuucucuguuucucacgggucuauaauaggacccuaacauuugauuaagucugauguucaaucuuccuacaucaauacaguaguucuuuaaucaacauaguuucuccucuuaaucauguagcauaaaguaaaucaaagacagaugaaaggaaaauauuuucaauugucacacaugucuuaauacaaaggaaggccacagaaaaacaaaugucaugcgugucuuaauacaaaggaaggccacagaaaaaugcucaaugaaaauauaaucuuuggccacagcaagccacgauuccuaaucgugagaaaucuccaccgaacacuccccaaagauguggauucuaucuguauuaaagucuauaauaaaaagagcaauagcaaguaacaauuagaugaugaaggcugcucugcccauugugccuuuauaacuaaagucucagcugaccuguccaauaaacgaggugaggaugcuucuggggagugacuuccauggagcagagcaucagggaugccaggagacucugccuccaaauccaucuuucccaucaacuggccuguccccagaaccuagagacgagucuuguuggccuuuggggauuugccaguuuuaggacaucguucagauguuaucaggcgacacucuggaugcuuuccuaccguggcaucuagcugaaggagaggacuggguagaagaggccuuggccaggcccagcaagcaggguaugugaugugauguggaggaagaugcugccgcagagggaggcagguccugggggcaacugcccaucucacugggcagucucuggcuuuccaagaacagauccaggagcaaugacagccacagacggggagcagccacauccacauguuccagagcugacuaacagauuguccuacaagccucauggucagccuguucccucucugucaagaacccaugaagguuaucaccuguaucaucaagacugaacuccagaaccugcuuuuaggaucuucucacuaauaagacccugccccaaguaauuucucacucacccccucuccuccgcauaccugacucccagugugcacccuccgaguucuacccaugagccauggcauugagaugcugaggucuuccuuccuccagccacuucgccaauccaaggcuccuugcugcacccuucacccgagucuuccugcccuucagcaucuggcaacgggcagucacucagucacuuguuuuccaggcagccuuccuugaugacuacauuuugcuuuauggcuguuugggcugccucauaaaucauccuucaccuuugauuauuuagggugucauacugaaugcaguuugcggcuguguagaccuagucucccagaagguggggacccuuuucuauauacccauguagcccucacagaaaggugggaaagggugcaagugggaaggggcuuuaggagagaggggguauuuaaaauuaaaaaaaaaaaagucccuugaggacacaacaauagauaaugccauugucccaguccugaguaggucuaggggugcauguggguguaugagagagagagagagagagacugaggugguucuuucagcaagagaguuacaaguuuggggaugcaauacaaacgauuuuaccucuccagaucucaguuuccucaucagcaaaaugagggggguucaugggaugcaugcaaugucccuuucaacucucugauuucaucuuccaagaaugcagcuggccugagaugcccauagccaugugcaggcgggcagguccacgugugauucuucuguugccuacaacucuagcaccucagugacuucauaaaaauacuguauuuguuuccuggggcugcuguaauaaauuaucacaaacuggguggcuuacaacaauagaaauuaagacuuucacaauucuggaagucagaagucccaaaucaagguggcagcagggccacacucccccugagggcucuagggaggauccuugccucuuucucgcuucggaugguggccagcauuucuuggcguuuccugacuugcagcugcagcacucuagccucugccuccaucuucacaugacugucuuccuacuggguguccccucccucuucuuagaaggacaucagucauuggacuuauggcccacccaaguccaguaugacuuuaucucgauuacaccuguaaagaccuuaagccauauuuuaagguucuagguggacauacacuuuuuggagaacacuauuuaacucaguacaaauagcaauguaguaagagcucccaucauggcucuaccagugacaacugcucuacaggcacgcguguguuuuacccucuggaacagucuugcuccgauaguggcucuccuaccaccacgcuauccacgacuacccaaaugacaacaaagaaugguugcauucauaauacuggcauuuuuaagucguguagaacuuacaacuuuuuaaacaccuucccauauacuauuucauuugguccucacaccaaucucaugaaauaaacaagauggauuuuauuguucuugaugaauagguagcaaagcuaaggcccagaaagguuaaguaauuuucccaaagucacacagcuuugauauacagcaaaacucauaucccugagcuuucuacucacuguucuuccgguuauuaucccugaggucauaaaucuccacccgcaaacccaauagcaccaguacaagaaaucuggacuggagauacuuuauccacaccuaccacugccccaaaaaguaaaaucugacucugugauucuaauguaccaaugguacucaaccuggguuauagcucaaaagcauuuucuuacugagcugcguuugggccucuggcaguugagcacucaugacaccccaucugguaaaccacagacuaaccuauauaaucaggaguaaaacuuaaucaaagugauaauuugugaaaugaauggucauuaucugaauucucauuauuucaugcccaucuuuuuuuuuuuuuuuuuuuuuugagauggagucuugcacugucuccugggcuggagugcaauggcgugaucucggcucacugcaaccucugccucccggguucaagcgauucuccugccucagccucccgaguagcugggauuacaugugcauaccaccacacccagcuaauuuuuuguauuuuuaguagagaugggguuucacuaugucagccaugcuggucucgaacuccugacauugugauccgcccaccuuggccucccaaucaugcccuucauuuuaagcacagucacaagacauuuccaccgagcacacacuaguagguggggcguuuuggccagucaugugguucucccucacaaagggcucuuguuuacagcuuuggguacaaggacauuugcuuauuaucuuacagacacagugaugacuucuucacagguguaggugacauuuuuccacagcacgaaaacugccuuacacguccuuuguauucuuccaaugagacccagcagagccuugauacugggcugcagucagcaacgggcgcaccugacaggagccacaugcucugcccuccacguggcccugcccucucuguggccccaccccauggcggcugggacacagcccuucuuggccagcaucugcagaaguaggaucugugccucggggcacacguguuaugagccaaauucccucauugaaaugaccuauaggccugguauuuuaaguacauggguguggagcacaaaagacucucaaguguuucucccagcgagcugcagccggaauagugagaaaucacaggagagcaagggagggcagguuggcuaaauagcaacggccccaaaaugggcuuuucaggacccagugcagggguggaaggauggggcugcugccgagagggccgguguuucuguuggcagccuggaggauccaaggcucccugaagcacucacuggccuuggucuggugaggccagcagaggcuuuggucagugcacagauggccccagcacugauccugugugugcugcuggaagucggcagcucuugguuccagagggggccaccacggggucacaggguggccugcauggaaggaagccaaggaaagggguaaacaagggguaaacaccaaguccuuccuccugcucacugaacccugaccaccacagcagcaucaguuccagccagggcuuggguuccaggaggaccauuagaagaccauuagaagcaccaaacgacacucauacugaauaagaaggugagaacaaaaaacaacagggcagaugagguuugucuugauguaggcuuggaagcagugagagagaagaauuccauauaaaaucccaugaagguggaaacacaguggugauucauucaguguggacucucaaggcaaccuacuuagguucaaaaccucgcucugccacuugcuagcugugugaccucaggcaaguuacuugaccucucuggggccucagcuuugucaucuguaaaaggggguuaauaacagucauuccaucucguagcauuguucugcagguuaaauggaaugcugaauauacaagcagagcacagggaaaggucucaguaaaugucaguggaaugaucauuaaagacaugauaaaggugauuccacaaagaccagagcugugacagaucccguaagaaggagcuggggaugaaguaggcacugacgucugacaugaggagggguuuugugcguguguguguguguguguguguguguguguguguguguguguguguucagcaggugauggggcugcuaccaggccuaaacgcaacuugaacuucaaguucaaguucacuccugccccgccagcuggcgaccuuuguaaggcacaacugugaguggcugauaugcuauguaaacaagccaggccagugcuccucacugcaacauguguugucucccucgacgccaguguguccauccaaaugccagggcaaaauacuaacugcuuuauuuaguugggaagaaggucaaggggugagucuuccuggacacucgcugccaugacacacuccccagggccagucagcggggaggccccaggucuaggcuugauuagucuugacguuggcggcccuggggcuggugaacucugacagccaauuguggucaaauaaagccacggcuggaaccugcaguuccgcauggcccagcgcacucuccacuuccucaccacaucugggaaguggcuaaaccucaggauugcuucaaaugugcacacugcuccccaaagagcugaggguggcaaggagauuacaaagcaaaaagacaugcagcucggggucauuucuugccuaggugugaagaacauauuuaaaagugcauccaggccacaucagagcagaauccuccuauaacaccccgugucugacgggcgagccccgacuccuguugugacucggccuccucaggucuaguuugcagguauccccggucuaccugaguuggcucugcagcagacucuguuccugucacucuccuuaguguaggucuguaagcaugagucaucuucuucuuuuggggacaguuucaggggaugugaaacuugcccuuugucacgcaaaggaaggcugcagacacaaaggagccgucugcccugggggcucagaguccuuaggaaacacaaucgcaacauuuuucacucuuguguuugucugcaggaaagccaguugugcccagagucuugaaacgcccaaagagugagaaaggaaaaauaaaagaaaaacaucgcagcuuuuaaaaaccaagagagucagugaaggcucagguucugcucuuugcaaauucaggaaaucccacaagauccugaaagguugcagggagauuucuccuuuuacaauagauggcuuugggucuaauuuuaauugcggauaacuaaguauaaaaauuaacguacccucggauuccaggaguagucugcauuuggaguauuuuuuaugaaguauuuuuaauuuugauuucucacuuuuccacuggaacaaccuaacagccaaaauucaugcuuaugcuccucuuccauuuccuuacccaaacauuugccacuauuuuugacaguggaguuguauaauuaauuuauuuggggauuucuggacgggauacaaauccuucaacuugcacauaauuuccugauucuccaugcugaauugaauuaagaugucggcguacuguauauacuugugugcaaagugccuguauuugcagauugcuugauccaaucgcacucacaucacacaugcaaaaugcagacuugaggccuaagcuacuggcaccaggacuacccucaaaagucagacugaaaaucagguccuuagaauauagaacucaguuuuccauggaaauggcauuuguuuggaauuauggauuguuugaaaaauagcuguuuuacuuggagaaaaccgaagacaugcaaagcauuuucucuggagauguucuaugaaaaugaguuguuugaggacagggacagaauuuuauucaucuuuguaucuucuauucugaggcaauaaagaaaaguuugauaaaugaggccaggcaugguggcacaugccuguaaucccagcacuuugggaggccaagacgggaggaucacuagagcucaggaguucaagaccagucugggcagcuuggugaaaccccauugcuaccaaaaauauaaaaaauaaaauaaaauaaaauaaaaauaaaaaauaaaauaaaauaaauuagcugggcaugguggcacacauuugcagucccagcuacuugggaggcugaggcacaagaaucacuugaacccaggaggcggagguugcagugagccgagaucacgccacugcacuccagccugggugacagaguaagacccugucucuaaaaaucaaugaaucacucugcaaacuuucaguuugacagccaguccuuuacaacgucgaauuucacuuggaaggcauagcuugcuuuuuccaaggcacagguaugcugggcucaacugcaggcaggggaaaagcucagguuugcaaaaggaguggaggggcgggccucuuuauuuggcagaauaucaccuaucccacaaaacaccaugauguucucaugcaaucuugcauuuccuuuccugagauuucauuuucccuuucuaaucuuccuuuuccuuuugauaccacaguucccuaggaucucagcuggggaaccaaguuuuaaccaaaacaccccaaaacccugaauucgcagcccccuggagaccaaggccacaccugcugcccugugcuucccccaaggacagccaccagauuuaccagucuucacucauccaucaggcuguguguuugggcuggggucacacagggcaagugaccaaagugaccuccugggccuggccuccuccugauuccgauagugccccuagccgggugccucaaacacacagcccaaggccacacagagcugcagcugggaggccugaggcauggacauucuucagggaaggaaggcuuggggggcgucagcuccugcucaccagccuugcagcacuugccacugcagguaggaagaaaggcaggugaguguggagguagagagggaagagagggaagcuugaggcaagcuugaggagggagcugacuucuagguacagugccaucuaccaaaugggguccuugcaagcuggauauacacaugccuggcgcugcuugaaaggagaaaggagagcuuucagucucuggaugggucucuaagcuccccacgcacccuccaaauguccuuuccauucuuuaaacuguaagccaaguaucuuuccacaauuuguaucuggaguuaguuauaagugguucuccauuucauuaggaucagaccaaauucccaacguggauguuaaggcaauccccgcccuaucucucuguaaggcuccccgccaucacuccccaaccaccgccacuggagcaucucucagcucccaacaggccaggugcuccuuccucacucugcuuucucugcugggacaugauucuucaugccuccaccggguuagucuccuugucaccugcaggucucaagugaaugacaagugguccagggagacccucugaaccuucaccagguucuguaccucugagccuuggcucccgccacacccaucuaucauguguuaucuacucacaacagggauggccuacuuaauugccauguuccuuacuagcccccaaggcuguggguucucuuuggcugaccgucguauuucucaugcuagcccaguuccuggcacacaguaggugcacaauguauaucugauaaaugaaugaaugaaagaaaugcccuuaguaaaugaccuugggggguggggcagagggagaguucuaauaaaacaggaauagguacuauauuuccaucacagggucaaugcccaauaaaaguuuguaauuauauuauuauuacauaggcuuuuacuugugaauacuuauggaaugccugcuguuaucucaugcacucucauuuuaguaggcccuuagcaggaccaaggaauauaaauuccuugccaucgaggagugggcccugaaaaacagcaucauucccaacuuuucaaauucagcaagacccaugcugccucuggcuugcucucuccccuccucccucagggauucucgcuguagaaggaagaacaucaucaagaggggcccuagcucuucuuccuaaguauaguuacauacacaccaucucgcuuuuaucauccuaacauagaugauauaagucauagaugaaaggcacucuuaaaccuauugaacacagauggggagacugaggcuggcacaucugaguccuacaggugugcccucuucucauauuacauuaugcuacuuuucuaggacucacagaaucaucgcuaauagauguguguguuuucuaugucaucauuacgaaucaaaggaauauuaaauaggacacaauggguucgguguaaucuagaguucagggauuuggccagaaugcaagauaauaguguaguaagaacccuuccaagugacagccagaugaaccagugcugaguuuauacguggccaaaagagaaaaauaugcauggauguucacuugcaguuuaugaaaaugcugagacacaaccuuaagaauggcuuccagcggaacauccggaaguccucaaguaguccaaggcgagcugccguggcacugcuacaaaaccccuucaacuuggguggaggcagcaaugaucacucaggaagaaugugaugcugccaggugccagccuguguaacccagcgacaggacaaagggauuauucugcuucauuauuaaaaugaaguguuuacuguuaaaauacgauugggaauuaaaaggggcacauaugaaucauaaauauuugcaugccauuaauguuuggacaaaagaguuggaaaggcugaguugggagaacuucuuuucccaugaaaagcagugcuucaaauuacaguacauauuuaauuucguuucuccuauugcuaacaggaaucucagggccugccgcauauaacccuuucacgaccacagaaccguauggggcccugaaauaaggauaaggauuguguuuccuccuuggaagcucacccauuuagacaaacaaaaaaagcagaccucugguuguuguugcuguuugcuguuguuugcuaugcacucacagaguccccauugucugccccaugguguuggugucacugcaaaaaguaacaacuccuaaccuaugucuugucucagguaaucaauccucauugucccucugucuucccacagacaagggcaaaaucaggcuuagacaggucaaguagcuuguucaaggacagauagcuccaagccagugguucucaaccaggggcgauuugcccccaggggacaugacgcaauggcuucagagauuucugguugucacaaccaggagggugggugcuaguagccccugaguagaggccaggggugcuguuaaauguucaaccaugcacaggaaagccacucacagcaaagaauaacuggcccuaaaugucagcaacacccaaguugaaacacaguggggaagccaguaaaguccacgugcugaccacuaggcuguacugccuaacaucaaaacaguccugggcccagcacaguggcucaugccuguaaucccagcacuuugggaggccgaggcaggcagaucacgaggucaagagaucgagaccauccuggccagcgugaugaaaccccgucucuaugaaaaauacaaaaauuauccaggcgugguggugcaagccuguaaucccagcuacuugggaggcugaggcaggaggauugcuugaacacaggaggcggaggcugcagugagcugagaucacgacacugcauuccagccuggugacagggcgagacuccaucucaaaaaaaaacaaaaacaaaaaaacaaacaguccugaacagucauucauucacagaccauguaucaggcaucaucuaaugucacucaugauaccaccuggagcuuucuaguuaaaggcuggaucucuugauuuuggaaaauuccugugagcccacuuccucggggcuccugagcacaucuuccuuuccacagugcuugggucuccguuccuacacacacccuugcaugccacagcuguuuucaagcuuuuuccccagugaccuucucucuagagcacaccuacagcaacucgugagcucugugcagucccuggcucagacaccguccacgaacucccauuuggauaguuaaugcuuacuagucacagauuacaugacacacaagugaucucugucgaaucuaggagcguugcucuacuguagggagcuuaaaggaagcagauguauacacggagaaggaaaauuaggcgugaggguccccaugcagcacaaaagcaaggaaacggacaaacaaacaaagcagacacagccugaccuauuccagaaacucaaccugcagcaggcucuaccuugaugcacugggaacaccuaggggagucucccuacggauuuuuguuuucaaaucaucgugcccugaaucucaguguaaaaaccggugauggcaaaacugacaugcuggggcaggugggauaaagcuccagaggaacccagccaucugucugcggguggcaucugcaagcccauccugugggcggcaaacccacaaaccuugguccugucuccccuccugccacguagugccuucauuuuuauuuaggguaugcagacugagccauuuuggugucugggaguugucugucagugacacacaccaagaccuugcuuuuaucacuuuuuuuuuuuuuuuuagacggagucuugcucugucacccaggcuggagcgcaguggcauaaucucggcucacugcaaccuccgccucccugguucaagcaauuuuccugccucagccuucagagcagcugggauuacagguaugugccaccacuccuggcuaauuuuuguauuuuuaguagagaugggguuucaccacguuggccaagcuggucucaaacuccugaccucagaugauccuccugccuuggccuccuaaagugcugggauuacaggugugagccagcaugcccggcucuuuaucacuuuuuuaauaugaguggacacuguccacugacaucaauucccauuccuagaucaguggcuccauggacucucugcugaaguauucagggaaaagcagugagccucuggcagagggcuuccuaguuucugcaguccucguggaccucaccugugugacauucaugaggggguggcuacaguggggagccuucucggagaagcugcccugcuguguguaccacccccaccugcagccacuccuccagccacugcacaucccugacccaggauagcaggcagggucaguggcgccagggggauggugcaauucuaugcauacagaacacugcuguuuucccuuuaaaaaaaacuuuuaauauucagugauguucucuauuuuuuauucugugcaauguuuuaaaaauaaguuuuucauaaaauuuaaaauaaguuuuucauacauuuugauaaguuuguagggaggcagaaugucagaauaaaaggggcaagggaaacauuuuacaaccuaugcaugaucagggcgagaucacgcaugacuggagcuagaugaguuucucaaucucagcacaacugacauuugggucuuuguuggggaggcugucagguucaugguaggacguuuaguagaucccuggccucuacuuacuagaugccaccggcacuccccaacccaauacacgaccaccaaaaaugucugcagauauugccaaaugucuucugggagucaaaucaccccagcugggaaacacugagcaagauuaugaucaaaauugauaagcagggagacaagauacugauaauaaacugcccagugguuucagauagaauaaugaaggcaggacauuuguccuagguacuagagacacaccauuuaaagaggcagacaaagccuuauuaugaugugaguuagacuagcuccuuacuaauuauagauagauagaaagauagaugauuaauacugacuauccucuauacaauaguuucaaauagaaugaaggaaaaaaaucuguaaagaccccaacccaaugccuugagcaaacuggaguguuuccaccuccagagaucugaugagcacacagaugaccaauuaugcucaaucugcccauauuccugugauuuaccuugguuugcauacggugacucaauuagggccauacaccaccccagagugcuggccagcccuccuauuaacuggacaggcacguccuugggauaggugaugggggaggugggguaguucugcagauggcccugcccauacauucuuaaugauggucuuaaaucucaagguaaaagcccaaauuaaucuaaguugagaaauaaacaggaaauguacuuacaucuucuuugagaaaaacacaguuuaaauggcuccuaaaugaaugcuuccucacuaaggaaaucagaggaaacgcauuuucagucuagcagcagaauggccgugagccucucaaaggaaguugcugggauuccucuauggaccucaacugccugacaccuucauuggagaacguucggugaugucaaauggagcuccugaaugggacaugcugcccaauauagacuaacagggacugggcaauguacuggaaucccaaaucagugcagugcaaacugaaugccgucgauugcucugucuucaacagagaucaaaauacaucuccguugaauguaggacucacagcagaaccaaugauggaguaugcgcgcugccugaaguccaggaaugcauguuuauaaauacagacguugaagugcugcgaucuguccccaugccccgccagggagccgacaaaacgagcgcaugucauaguauucauaggcagcucauuaaauccacacugcucacuuauuaauuuccauuaauugcuuuauuugggcuuuagaugagaagauguuauuagcaugaauuuaguccucaaagauaauuuggcccaagaagucucucaauggaaguauggauauucucauucucucucucucucucucucucccccuugcacacacgcacacacacacgcacacacacuccacuggcuaagaaucaaugaagccuucaaaagcauacacucuccccauauugacaguauaugauuauucauaaacaucucuuuacugaucugaacuugugucauaaucaucuacagaaagaaaacagccuuaagacaguacaccggccagguacgguggcucacgacuguaaucccagcacuuugggaggccaaggcagguggaccacccgagaucaggaguucaagaccagcccagucaacauggugaaaccucgucucuacuaaaaauacaaaauuagccaggcguggugguggaugccuguaauccccagcuacuugggaggccgagguaggagaaucgcuugaaccugggagguggagguugcagugagcugagaucacaccacugcacuccagccuaggcaacaagagggaaacucugucucaaaaaaaaaaaaaaaaaaaaaaaaagacaguacaccaucucuccuugucaacaaguaauuuuuccuuaaaaaaaaaacaacaaaaaaaccagaaacacagaauauguucuucuuuagccaaccuucuccacccucucuugccccuugccaaccagcacaaaaaagaaaauacaaaacugauuuauuagaaccagagcaggguugcagccguuggcuggaucacuguuuaugucuauaaugcuuguugcugaaacaggaagcucuaaaaaucacucaaccauuauuucucuugcaggcacuuucugauugauagucuucugucccgaccaaaaagaaaugccuccaccaaacacaagccggcuggcaaggaagggguugaggguggguggagagaaguacagcuucugcccaucaaacuauaaaauauuguucauacaaauaaccucaauuuaaaaaagcugugugacgccaucagcaaugccugacacuucacaaaaucagcaagaaaacuaugaagggaucaacugcgaaacugccuguugcaagcacaagcaguuuucaagaaagcuuuuccugcugguccuugccaugacugggccaccccaggcuuuaagcagggcagggagcaacuugcuuuaggaaaguguugcuauccuuuuauuggcaaaugugaaaccgaaaugagaaacuuggucucuagagaugaauucuacaucagaucauggaggcaagcuuuugaccugcccgucgaaaagcagcauuuguuagggcugguugaggcuugguauaucagagacugggucuuuauucaucuauauuugcuugcaaugagaucugaauacagauuucaguauauauauuauuuuaaaguguagaucaguauguaacagaagaaagugggaaaaugggagaguugauuuuaauauaacucaugucuuuuccuuauauucucuccaggagaucugacugccaguuuauaccaugaacauuacccgugaaacaacucugggguggucagaugaauuuuuccuucuucuauuauaugaaucuguuaauagaauagagaaggacugggauccuacgauaauacugcgagucauucagaucaucucuugguaacaaccgcuacauaaagccaagccaugucucuuuguuuagaauaucaguaccguuuauccuucccuaaauguaccuucccuuccucuugaccacagucuuccacucaccugaagggcaaccucccacacuuuagcccaaauaauguagaauaauuuaagaaugaaaaugccuuaagcaacuaacauuacacaaauaugcaauaacccagauugugacaggauaaauauuaugucugggaagauauucacagcaagaacauaccgaaggaauuucauuguauaaauguguugggaaaggauacuauuuugaaagugggcaagauuaaagcugccagggaggucaauguaaacacaaauuccgccaagaaacucaacgccauccugacaggccacagaacacuuggccuuacagggcuggguguggacacaguacgagggaagcgacuguccuuucaaugacagaauaggcccccuccccuuuacccgugaugauaugugggcauaccugauggccauccaaaggccuggccagugguuucaaggagaucuacuuucuuaauuagacaaaccagaccccggcgauaacaaaaacacagguguuaccaaaacagcacagguucaagaaaaugucuagcucauuuguacauguauuuauucauuuucaggugucuacuauaugcggcauagggcuaagcuggcccuccaugaucaaugcaaaguuccaaauucacaaauuuuuggccuagggucuguggauccccagaagguccauaaaugaguucugguagccuagaaacugaaaugauauacguaauucuguguguaagugaacacgugcauuuuuuuuuuguccuuggaaaaagccuuccaaaggauuuucaaaaguaucuaugauguuccccaaagauuaaaaaucauauucuaagaaaaaacuagaaagaaaugugcaguagaccaucuuuccuccugcagcaacaaugcagcugauaaagcagcuggagagauuucuucuuugguucugaaaugaaauuacuaaagcuguauuuccugauugaucaguuauucucugacugauuaaauacuccaacugggaugaagcagucacagauuucauugcuaaaauuucuuuuucuuuuuucuuuuuuuagauggaguuuugcucuuguugcccagacuggagugcaguggcgcaaccucggcucacugcaaccucuaccuccuggguucaagcgauucuccugccucauccuccugaguagcugggauuacaggcgcccgccaccacaccuggcuaauuuuuuguauuuuuaguagagauggcggugucaccauguuggccaggcuggucuugaacuccugaccucaggugauccacccaccucggccucccaaagugcugggauuacaggugugagccacugugcccggauaccaauugcuaaaauuucuuaaauuucucucagcugaagccaugauacacuuucuugucauucuaaagguggcaggugauguagcacuugccucaacugcagauguaaacugauauaagcugcucagugaauucguuucacauaagagaauuccuuuugacccugaacuucaauuuuuugggggugucauggagucccaguccauuuggcuaaaaugugaauuauucugaacaauaaccucugugcucacaugaccucuggaguucagcccgguccccagagcucccuaacccucaucuccugggagcugcuaucucuuccuccuuuguaaaggagcggucgauuuacauggagauacugaaucaaagagagaaacauuccaagggugagauacacucugaaccaagauuuaaacugccaaggagaaaaaggagggaauggaagaaaagagagaagguucaggcuucuacagggccaguguagccagcgaggccaucaaagccggacaggcagguuuucccaguuacggaaugaacccgagguuaggagcugugauccuggauggcagccagcgcccagauagauucguuuuguagaacagagaaaaacccuuccauguucaaccucuggcaguuucuaugagguuuacaauccccauggacuggcagcuggucacagaaagagaacuucuuucucuaccuuucauuuugcaccacuuacuaggccccuuggagaauccaucagacugguggcuuuugacagaauucaaaauuggcacugaaaguuuggaugagccaagagccagggccuucugagccauggcgugguguguucaugccaaggguauauuuucaagcacauuuucaaaaacagaaaaugagacaguugucuuaagaucacuuaauaaaacguaaugaaacuguuaaagguaagauucagugaggaagauuaagacuaauuguuaaaauuagucagaaugaucugcucucuuccuaaugggaagcaaauugcaaaaaaaaaaaaaaagaagaagaaggaaaaagaaagaaaaaaaucuggcaggcuuugguguugacacuuacacuugaaagagaaaaaucaaguuauauuuuaugacuauggaaagaaauuaugacagagucaaaucgggccuucagacagcucauuuacuuuuguagcgcugacuaaaaaaaaaaaaaaaaauauauauauauauauacacacacacauauauauauacaucucaagaccaacaauauucauauccacaguaauuacaauugggucaaauguuccauuaggguuuccguauuuuuuauugcuuauuaucacuggugggaaggagagucuguucaaaauauugucuguuuauggcauuucaauuaauuuucucauuccagaguaugggaagacagcccagccuugguugcagcuauuuuacuuuuugggguuuaugcaaacucaagggcauacuggcacgaauccugcagccaaaugcaaacacuccacaccuuggggaaacaguucacuguuacccaaguaaacacaagcaccuauuagucacccacucaaaacagaaauggucaaugagggaugcaagaucagccaucaaugccagaaaagaaagcacacugcuuucaaaaucucauuuuuuuauuaucacugguuuacugugcauugccggaaagccacuacugaacuucuugugggaaaaugucacuggcacggaucacuaaauaguuuuuaaaacuuuuaugaccaaaaccuaacuugaagacccacacagaugcauaguaugaugauaacacuuucucuagaaaagcaauucaaugauacuuagcuauugauuccuaacagcagaaauccacaagaacugaauuaagagaguuagcuaggccgaugggcauggaccaggcuguggggccuuuguuuuuuauuggcuucucacccacucugccagcuacucauccgaagccuuuaagauguuuucuagacacacaucucugaaucauaaugcaaauuccauuuacugaaagguggggacuuuuaauacaacaagugaacccauuuaaugacuuaugcuuuuauaucuuauagcaucacucaugcuuucaaaaaguggauauaauuuucuuugcauuacccuauuauuaauauaguacuaugaauauauauuuucaaucacauuauauaaauuuuuuauuuucuccagcuaugauucuauuaugaaaaugcuccagauagcuaggauagcaaaaauaaucaccaaaauaaucaacucacauuuaccccuuucuccuuucugacuaaucaaauucucugagaacugagauuuucuuguuuuuaaaugccuuuuuaaagaguaauaauuucucuuauuuuaaauguuguuugauuggugcuuccauuuuuuucaauacgagaacuauuacuguuauuuagguauuuaccauaagucuuuuuauuauacuugaaauaacuuauuuguaagcuuaaucgguacuauauuacaaaaaaugaguuuaaaaaacuaucuuaccucccucaacuaaacuuuuacuacuuguugcuauuuauaaaauaugauuugguucuuacaauguaaagaaaacauaauacuugaaaauaauuggaaaccagaaaaaauuacaauaagccaagauuccuauuucugcucuaaugcuuugauaaugaguuaaaggcaaggaaaaauaaaaucacacauggagcugaaguaaugcaacaauuucuuggauaauccaaucucuaauauuauuaguaucuaaaaugcuaaccaggcccaaccccuccuccuaaauaaggcauugaaaagaaauacaacaggaagaucauacugccaucaaugguacuaacauuauuucuucaugucuuuuucuaaaaagguaagcuugcuugaaaccauguuucaacaucauacacuagaaaucccuaaaauuauuagaaguggucauucgaaacucugucacuuuucacagauagcccacagaucauacgucaacaguuuccauuaaauagcuuuuguauuguuauccaagagagaauccucauuguaauuguauaauccuaguuucauuaaagucaguuuuauauuuuuugcauuuuaguaaaaaucucaggcguuucuuugaaauucacaauuccuacguugcauguuccaaaucagucuuaaauccacucaguaacauaaagcaauaauauagagauucugcuaaaaauauuaaacuucaaauaaauauuuuuaagagcuugacauagcaauaagaauguuaagacagaccgaguuucuagggauuccaucacagaaaucacuagaauuuugaaauguggguuuguugccaugaaacguguuucaagcauaguuuugacagauaacguaccucuuccacuucgaccgacaaaccugaggucauuaaaucuugcaaccugguucuucauggcugcgguagcauuucucagcucagccgaguaguuuucaucauugccagccaucacagugaccagagugccaucuggaacauccccuagggccaccaccuaaacaccagucaaaggacaaaugcagacaucagggauguuauacauacacuuuuagggcauuuguguagugauuauucuaaaauuaaauguauauucaaugauuucuuuuuagguugcagaggaauagcaaugauaacuuaagcaaaacaacagaaaaguuauaaagagaagacacuuuuuuauuauauuuuagguuggugcaaaaguaauugcaguguuugcaauuuuuaacuccaaaaacugcaguuacauuugcaccaaccuaauacauuauguauaacuauauguaaauuuucaaauagugacacauauacuaaauuuaccucauaaagccauaguaggucacauagcacaguuggaacaagacuaaccauagcaagauaucaaggauuuugaguagcuaugccgucuccugaauacaagcaucucuucuuaauuucucccguuugagaaacagaacauccuguguuuguaaguuuauaauccaacccaucuuuuacuugcucagaccuccacuaacaggcugaacaaggugcagacuuuacuuuuagaaaauaaaacaaaacaaaaaaacacaaaaaaacccaauuucugcuaaaaguagauuucaucuugcugacgauucuuaaguaacuuaaacugucccucuacaguucaucuuugauaccuccuacucaucgcuauuaucuugaguuuuacuagcaaugaauucuagcacacaagaaaaaaaaaucagaaaugcacccuucguuuacuaauuacaaaaucaacagaccucagaaagacgggacauucacuucuaugcacuccccucaauucagggguggaauuggguugcauuuuuguaucugugagucucagcguguguaaacucauguccucacagaugccugagguuuucugcuagcccagcugaucuugaccaggaauuuauuuaauguaacugaguaaguaugaagucuuaucagggcuauuggagaaaacugguagauaaauguuuuuauacucagguaauuaagaaaaugaauuccaaaguaaaauacucugaaaagcaugaccuaaagauacuuuguacaauagcaucaauuucuuggcuaucauuuaggccuucuagaaacuauuuucuuggucuagacauuuacuauuggcuguauuuccuuuguuucuauuuuucaaagcagucauacaacuucaaaucgaaaugccccaagcuguauuuauucugaucauuucugacauucuuuacgguaaagucaguagugacauuuauauuacucauuccaauuacaucaucauuuuugguugcuguuuuugaauugguaacaguaaagcauuccuuaaucuaguguuaucacuccuuccucugccuccuacuucccaauuuuuaccuuaauaacugcuacauaauuuuuuguaguauauauuuucaggccucuuuuucuauauguaaaaaaggcugccauagacucacuuguaugauaucgaagucauguuucucaagauucccauuuucaugaucugcuuagccaucacccuuucccuguggccuccagaugacuaucuauuguuuuuauucauuagaacugcuucaguccuuguggcacagaacacgaacuaacucacuaugagagaugaacauacuuccaaccccaagacuacaccaggauaaucuagucucauagaagcagggaggcauuuuccucuauuuuauccaacuugcacugccaaacaaggucugggccuuuucucucuuuuuaauccuuucauuccaauuguuggacauguuuuccauauaggagauuuuaaaacucugcuauuuauuccccaagcacccucuaauuagcuauuuaguucccauuauaaguguguuuguugccauuuaauuaagagcagugauacgacaauucccuuuuuguuuuaaaaagauaucacggaaauaaaucucccugaucaguuauuugguuauugcuacuguuuuuuuuuuuuuucuauucccgaaaaaugggcuugcuuuauuuugcucuuuuuagucucucacaacaaauuuuccccuuuuuuucaugauuuucacuucccguuguaaaguuagcucacaguguugaaaugcccucuuugaacacauauuuuuacuuccucauccuccucucccugugguaacccaggcuucucuauuguaacucaacauucagcagguauacagagacugccuccacuacguggguuucaaacugaauaacucauuguugggucuggaucuguaaaaaggugaaaauaaauaaaucuucuuuuauaacuacaggaauguauucugaauuaucugccuccuacugcuguuccccucacagugcuccaagccugugccucucucaucuuuccaauacuauccucauugguaauuuggcaaauucaggagaccuucgccaagucgaaacaaacauagaauaaaauuaucauggaggcuaaauaagaaaaggcuguugauguuggaacuuaagaagaaaaaaauuagaaguuuaacucccacuccucuuuuuuuuuaaaugcagcagaaucaaccauauuugggcaccuacauaucauucacuuggccuuguauugaucucugaggguuuuuuuuugguggaggcggguggguaaaggggaacuaguaaauccagggcaauucauuaauacuguauaucguccaauuguuaacaagcauacuuaagccagguuuaaaaaguuucuuuuuaauucaaaacuaacaugcgugcuaauuugauacagguuuugucacugaugggcaauauggagagaauguaaaaauaucuaacuucaaacagaaaaaagaaacaacuggaaugaaaagcuauaaacaauagguaaggaaacacaaacauuuacauuuuaacacagaccaaacaggcaagaagggacuugcuggccaaagauaucucauauuuuguuuuacuucucuguuuuuaaaguaucaggaaguugggccaaauaucaacucucuucuauauuacauggaccucccaauacuguucuuggcuagccuguucacgguccaaacuggcauuuuaaaccaauucuaauuagguugaaauuacaguuacaauucauuuacuucaaauccguuaaccuuccaguguugcaaagaaggcuguggaguggaacacagaauucagcugagaugauauuuaaggcauagcuagggacugugaucuugccgacaaaaauauuacuuauuuccuuuuuaugaaaagaauauuaccaucagaauccaagaccuccgaacuucccugcugaaggcacguuuacgucuuuggacucugguguaccagggccugaacaagcuauaacaccaugguauuaccaaauacauccuaagucaucaaaacagcuuuuuaggcuaauucuguaaguacagcaaaacacacagcaaacuuaagguuuucuuaguaguaaaaaacauguaucucucauacuguaaaaaauaaagguguuccaugggagggaaggaguagggggagaacagguuggggcucaaaauaagcaaguaggguuauuguaaucuauuuuaaagaaaauucauaauuuuaaaucucucuuuaguucagaagauugacguagaggauuuaccuacagaacuucaggagauuccuaagaaggccuucagugaucuuuucaucaauaucaucaggccuuaucauuguuucacauuugcuucucuuuaccauagggaauauaauaauuauuuacugguuaacuuccuagggagauugccugcggcuuauuuaagauccaaauuuuaaaguaauaauuucuguugaagcugcuugugaggugguugggugggcagauagagugaagccagggacacacacuaaaugagcccgggauguaggcagguuuugauguuuugcuugcuuuuaucccuaacauuuuaucccuucacguuuacugucucacugaacauuuugucuacucuucuaguuaugcagugagcaggucuccuccaggaagaagccucuuuuuaugaggauugggguggugacagacaauaaucaaauggucugauuucucugcuauccuuuccuuuccccuaaauguucucaggggaucugcuugaacuuuuuucaagagcucuguauuuggauuuuuaguagccuauagauuaucacucaauaaaacaaauuaauuguuuuuaagugaauugccaaaagucauuuuaaaaaggaaacucuaugguuauuaugguuucugcuagaaagaauucugacagcucauaaaagcaauauguauaauuuuucauuuuuuagaagaaaauaaauacuuucauguaauggcuugagacucugaauugcuccaauuccugaagauuauuuauuaaucauuuagucuuuuaauauauuugaguguggguucccuggcagaggagggaguucagaagagacccugauuucccccccaaaaggaagccacaaaucucuuagagcccuagugcauuggggcagccagguuuuaauggccuuuggugguuaucagcccgucuugccucugcucuuuaucugauagugaccccauggcccaacccuguuggguccccucucaaugcgggugcccuaaagagucaucgcugaguccauuuaggcaaaggguuagaaugauuuaaaaguaaaauggucucccaaacccaaaucuaaguaaacggagggagggaaaaaagagucaagcaagccaccacguuccuucguuccuucuccucauuuccacccccacuaaaaaacaaaacaaacaaaaaaaacugcuuuuagaaaagugaguggaaaaagaggccaaucuauagacacagccaacugcaaauuucguuuuguuuuagaaaucacaaucuaaguguggaaacuguauaaagcuuaaaaauaaccgcaacaauacuuuuuuaaaaagugaauauucgucguuguaauaagaucaagacccagcugaggcuuggaacuauaaaaagcuuauauuaaauuaaucucccuuuaaaggggacaauuauuuaaacuuuuuuuuuaguagcuuaucuuuacacuuggaaccaccugccuugauucgcccuuuaaacgaacaggaaaugacccgcacugauuuuacuuagucgcaucuuuucaaacccaccaaagacaaaacagaaucuccacugcagaaauuaaauuccuacugcuugcugcuaguguaguagggugauuguuuagaaacgccugggguuguuuucauaccccuguugaaggucaagguuuuuaaaggcagcucaaagcuuuggggaugaucaggggugaaaagugaagggagaucuuuggagccgccgcgcugaagucuccggcuacgcgccgcccccuccucuagcaggaaagcgggccgcugggaccccuggcucuccgaaaacagccucgucaccuuucgcuaccccuggcuuaaucuaggugagcugaugauagcauucagaacgguuccgggaaaagaaacaggauucgauacuugcggcuucuggcaggagcaggcuaaaaagcucagagaacucuucagaaaacuuuugcaaacuuaacuacgcccgcuguggacuuuggacaugcuaauuccuauagggcgguuagagaaggggaaaaaaaaucccugacaguuucccuaguuaguuucuuuucacugacuugaaggcagaaaagucuuacuauuuuauuuccugauccuuucaucugaggaagacaaaaugguuuggguguuaauccagcgguaggggcagcaguaaguuagcagacgggcugucucugccgggcuggguuauaacuuuuccuacuuuguaucaaagcuaaggccccugccagggaggucccgaccggcucccaguggauaucuuuggggacacccugauguuuucagcccuccugggaggccgccccagaaagcugagacgagugccucccgagggucgccacggcaacacagcaucccccacaucccaagcuaggaagaccgacccggggcugcgggggccccuuuccagaauccggccccgcccgccuggccgcugcccucgcggaucucccccggccucgccggccuccgccuguccucccaccacccucuccgggccaguaccuugaaagcgaugggcagggucuuguugcagcgccagugcguaggcagcacggagcagaggaaguuggggcugucggugcgcaccagcucgcccggguggucggccagcaccuccaccaugcugcggucgccgcuccucagcuugccggccagggcagcgccggcguccggggcgcccagcggcaacgccucgcucaucuugccugggcucagcgcgguggaaggcggcgugaagcggcggcucgugcuggcaucuacggggauacgcaucacaacaagccgauugaguuaggacccugcaaacagcuccuaccagacggcgacaggggcgcggaucuucagcaagcagcucccgggagaccaacauacacguucaggggccuuuauuacugcggggggugggggggggcgggggugguuaggggaggagggagacuaaguuacuaacaguccaggaggggaaaacguucugguucugcggaucggccucugacccaggaugggcuccuagcaaccgauugcuuagugcauuaaaaaguggagacuaucuuccacgaaucuugcuugcagagguuaaguucugucuuuggcuguuagaaaaguuccugaaggcaaaauucucauacacuuccuaaaauauuuaugcgaagaguaaaacgaucagcaaacacauuauuuggaaguuccaguaguuaaugccugucaguuuuuugcaggugaguuuugucuaaagucccaacagaacacaauuaucucccguaacaaggccacuuuuaucaugcaaaacuggcuucagucccgaaaagcaagagcugagacuuccaaagguagugcuacuaauguaugugcacguauauauaaauauauacauaugcucuacuucauaaaauauuuacaauacaaucuguggagaauuuaaacacaacagaaauccauuaauguacgcugcagauuuuuuuaaguagccuugaaaaucagcuucaguaguuggagcagugcugagcuagaaguacuugucauguucucuguucucucaaugaauucugucaaaacgcucagugcagaaaauucagcguuucagagaucuucagcuaaucuuaaaacaacaaucauaagaaggcccagucgaugacacucaggguucuacagcucucccacaucugugaacucggguuuggggauguugguuaaguuuguggcugguccucugguuuguugggaguugagcagccgcagagucacacacaugcaaacacgcacucuucggaaggcagccacugucuacaucagcugggugacucagcccugacucgggcagcagcgagacgauacuccuccaccgucgcccagcacccgccgguuagcugcuccgaggcacgaacacccacgagcgccgcguaaccgcagcagguggagcgggccuugagggagggcuccgcggcgcagaucgaaacagaucgggcggcucggguuacacacgcacgcacauccugccacgcacacugccacgcacacgcaacuucacggcucgccucggaccacagagcacuuucucccccuguuguaaaaggaaaacaauuggggaaaaguucgcagccaggaaagaaguugaaaacauccagccaagaagccaguuaauucaaaaggaagaaaggggaaaaacaaaaaaaaacaacaaaaaaaggaagguccaacgcaggccaaggagaagcagcagagguugacuuccuucuggcgucccuaggagccccggaaagaagugccuggcggcgcagggccgggcagcguggugcccuggcuggguccggccgcggggcgcccgucccgcccgcgcccgcuggcucuaugaaugagagugccuggaaaugaacgugcuuuuacuguaagcccggccggaggaauuccauucccucagcucguuugcauaggggcggccggcggccaaucacaggccuuuccgguaucagccagggcgcggcucgccgccgccggcuccuggaauuggcccgcgcgcccccgccgccgcgccgcgcgcuacuguacgcagcccgggcggggagucggaggccacccccgcgccccgcauccaagccugcaugcuggcccggggccccgcccgcgugcggaccccuuuccgcagccacacgcaggcuugugcggcuccgcgaguggccacgguccggagaccuggaaaaagaaagcaggccccgccggcccgaggaggacccggccggcgcgccgcacccggagaggcccggccccgcgagccgcugcaggcaggcgcaguggccgccacgaggcucccgaaccgggcugcagcccgcggacggccccagauccugcgcggccgcccagggccaggccuccgcuuccagggcgggggugcgauuuggccgcggggcccgggggagccacuccgcgcuccugcaccguccggcuggcagcugcggcgaagcggcgcugauuccuugcaugaggccggacggcguccgcgcgugccguuugcucucagcgucuucccuugggucgguuucuguaauggguguuuuuuaccgcugcgcccgggccgcggcucgaucccuccgcgcgucucacuugcugcgugcgucagcggccagcgaagaguuuccuagucaggaaagaccccaagaacgcgcggcuggaaggaaaguugaaagcagccacgcggcuugcucccgggccuuguagcgccggcacccgcagcagccggacagccugcccgggccccgcgucuccccuccggcuccccggaagcggcccccgcuccucuccccgcccccgugcgcucgagcggccccaggugcggaacccaccccggcuucgcgugcgggcggccgcuucccccugcgccgguccccgcggugcugcgggcauuuucgcggagcucggagggccccgcccccgguccggcgugcgcugccaacuccgaccccgcccggcggggcucccucccagcggaggcugcucccgucaccaugagucccuccacgcccucccugccgggcccugcaccucccggggccucucauccaccccggggcugcaacccaguccccggaucccggccccguuccaccgcgggcugcuuugugguccccgcggagccccucaauuaagcuccccggcgcgggggucccucgccgaccucacggggccccugacgcccgcuccucccucccccagggcuagggugcuguggccgcugccgcgcagggacuguccccgggcguugccgcgggcccggacgcaggagggggccgggguugacuggcguggaggccuuucccgggcgggcccggacugcgcggagcugucgggacgcgccgcgggcucuggcggacgccagggggcagcagccgcccucccuggacgccgcgcgcaguccccggagcucccggaacgcccccgacggcgcggggcugugcggcccgccucguggccuucgggucgcccgggaagaacuagcguucgaggauaaaagacaggaagccgccccagagcccacuugagcuggaacggccaaggcgcguuuccgagguuccaauauagagucgcagccggccagguggggacucucggaccaggccuccccgcugugcggcccggucggggucucuucccgaagccccuguuccuggggcuugacucgggccgcucuuggcuaucugugcuucaggagcccgggcuuccggggggcuaaggcgggcggcccgcggccucaacccucuccgccuccgcucccccugggcacugccagcacccgaguucaguuuuguuuuaauggaccuggggucucggaaagaaaacuuacuacauuuuucuuuuaaaaugauuuuuuuaagccuaauuccaguuguaaaucccccccuccccccgcccaaacguccacuuucuaacucugucccugagaagagugcaucgcgcgcgcccgcccgcccgcaggggccgcagcgccuuugccugcggguucggacgcggcccgcucuagaggcaaguucugggcaagggaaaccuuuucgccuggucuccaaugcauuuccccgagaucccacccagggcuccuggggccacccccacgugcaucccccggaacccccgagaugcgggagggagcacgaggguguggcggcuccaaaaguaggcuuuugacuccaggggaaauagcagacucgggugauuugccccucggaaagguccagggaggcuccucugggucucgggccgcuugccuaaaacccuaaaccccgcgacgggggcugcgagucggacucgggcugcggucucccaggagggagucaaguuccuuuaucgaguaaggaaaguuggucccagccuugcaugcaccgaguuuagccgucagaggcagcgucgugggagcugcucagcuaggaguuucaaccgauaaaccccgaguuugaagcccgacaaaaagcugauagcaaucacagcuuuugcuccuugacucgaugggaucgcgggacauuuggguuuccccggagcggcgcaggcuguuaacugcgcagcgcggugcccucuugaaaagaagaaacagaccaaccucugcccuuccuuacugaggaucuaaaaugaauggaaagaggcaggggcuccggggaaagggaaccccuuagucggccgggcauuuuacggagccugcacuuucaaggacagccacagcguguacgaagugaggaauuccuuuccaccaagagcgcucauuuuagcgacaauacagaauuccccuuccuuugccuaagggagaaaggaaaggaaacauuaccagguucauucccaguguuucccuggaguaaugcuagaauuuacuuuugucauaaugcaaaauuaaaaaaaaaaaaaauacaacgaagcgauacguugggcggaugcuacgugacagauuuuuccaaauuuuguugcggggagagggagggaggagaauugaaaacggcucacaacaggaaugaaauguacauuucugcaguggauuuaaaaaguacugcuugguuaguuggaagaaaaauaauuucauuggaaaacaguaacagugcauugacguuuuucuucuacaacuuuagguaaagaacuauagguggucucagaagauaacuaaaucuuuuaccuuuuugcucuuucaaaagccuccccaaaauaugcauaaagaugggauuagaaucucaacaauucucuuaaaauuacccuuugcgagcaauauauuuccaaaaucacauuuguaaaaaugcaguacgucuaaaagaauuauuucuauuuuaaaugaccauuuacauuuuaaaaaauagaauguaucuugcuaugguuuggaaccaaauagcugcaguuuguauugaugucacagggauggaaaacaauuuugaugaagaguaacauguauguacaaaucaccugccauacacacuauccaguuuugaacauuggaauuuaauuaaacauuuuuuucuucugaaguggcuuugagauuacuucacuuuucaaaucuaauuacuaugagaggggggaggagagcccuuaguucuuccauuacauccuuccuccaucugaauguuucugugggaugcuaugguuaaugugugaugauuucacuuucacuucauaaacccauuguguaccucacaaguagcaagcugaggacauuuuaaaauuaaucuuuuuaaaauuuaggaaugcuuaguaaacauuuuacucucauaaaaaucuugcauuaccacugcuauaacacagguaauaagcugggcugugagggaagccaagcucuguuuuguuuuuagagaguuguauagaggcauuuaauagcaucagaaugcaccuaugguaaacgcuguagaacugaggguaucauuuaagcuuucauugaaauauuuuauaugguauaacauuuacaauauggagaacugcuuuuaaguauauuggaaucagcagaaacagccuuaauuauuugguuaaauuauaucacaaguuauacauagagauacauagauauaaaaucauauacacaucuaugaagguguguacuuuauuuaaaaauauaacuuggaauuuaacauaccguggacgucucuagaaggauucauuccaaguaugcauucugaaauaacagaaaguaggaaaauaaaaguaaugcaaguuuaaaaauuaacuuucccccgacuuuuuuuuuuuugcuagcucauuucuucuuacacuuuuuagcacuggagauuuuuauagcuuugacacaaaaaugacuugaaauaguaaaucaccaaauaagaaauaaacuguuccuuaugcacgugguuuuagguaccuucaaccaauguucuccuucacuagcuaauacugaauaucugucauagaaucaccucuuuuaagcuccgugugugauuaaaaugugauuuauuuaaugaagauuuaaaauauauuuggaagguguaggaacauuagaauucaagggaaaauuaaaaccaaacccuaacuuaacgcaaaaacauuuaugaucauuuacuuccaaugauaggacauuuuagaaacauuuuccccugcuuacucuccuucccuucucucugcuaggcagguaaauuauuuacaucgaaaccucucacaaguucuaauagauuauaucaauuauuauuagaaauaauuguuacaugauaauucccaaauauggaucacuuacaguauacauuuacaacuauagguaaacccauuaagcaaagucacaugaagcucuuuuucuuuccuuugaauaucuacauauaauguugugaauuugaaauuacucuaucagccuuguauauugauaacagcacugagucacaaagaggaaauacuguucuuuaaagacaggauuugagcauuucaaaugcugcagaccuaaagcuuucaacuccaugccacaauauuuaguaugcuguuuuuuuuuuuuuaaaaaaaaaccuuuaaaauaagaggagacaauuacuucagauuucuagaugcuguuuaaauaggcaggaaaacaagauuugcagcuucuuuagucuuauauuuuugccaaaguaaaaggaacaacuaaaauaagagguucugaaggacugcucuaugaugaaauauuaaaggaauuaaauauguauagucucaaaggagcauccaaaaaaaaacgagauugugguucacaaguagauaaaaugacuccaugaagacuuuucuuuuuaaagagcaaggcagagaacuaaucauuugcacuaauugugaaugauaagguaagaaauaauaaauguauccugaaguuacgucagcucagcuuuaauagguguuggggcagugggguggggguguggaauccacaacgguaagacugaccagacagcacacccagcggaaccacgcacccuggaaauuaugucuugagacccagagaagcuuuuccaugucugagucuaagaaauuggaguaggagagcaagaaaacacaaguucaucuacacaccuaauaguucagcaauucugaggaaaaugccaggauuuuuuaaacccaaaaacaagggcaaaaaugaguggauuuugaaaacugugauugguaacuauuaaaaacuuucuuaguuuguuguguaucagcagccuugagaacacagcaagugugguuaaauuggggagggggaagggguagggggugagcaacugcugcccaggugaaguagcaccuguggagguuugaagugauuugcccaugaaacuguuaaagaugccagaacccaaacugcaagagaggggagguugcguguguuuaagacagugaacaaugaaucugguagcccauccuccagugugcuagcuugcaugcucucucucugucucucucuucccuacaucccccauugaauguaauuauaugccaggcaaugggugaagugcuuuuauauacuuugccugauuuaauccucacaagaacaucauugcuacccccauuuuacagauaaggaaccucacccuuggagaguucagguaacuugcccaaauucacaucacucuugaccuacauagaaacacacacacacacacacacacacacacacacacacacacacacacacauauucauaucuacauauagguccacaugcaugguaagcuauguuccuuuuggaucaugauuauuuuuguggcuauccuugguagaguucuaaaaaauuaacucugaucucaucuuucacuuuuaucccccccgucucagggucuagaucagaaaauaucuuggaaauucuucaccaugcaaaccucauaucauuaggagucagauuuuaaugucauuucugucauccacagaguuugaggagaaagccaagguccauuuggcugagaagcuuuuauauugauaauaauauaaaauggcguuuuagucuuuucccaccuccacuaguuuaaaagggcaucuuuaggacuuuccuagauacaagguauuugauucaccugccuucagcauuccuugaaugcuuccucugucccaggcaaggugcuaggcucacugaugacaaacaccaaacagaugagaguaaagaagugucauggcuguugguggacacauguccagggucccaggaacuggugggagggaauauaagaggaagaggggccaacagccccuggugggcucaggaaagacuuccuuccuagcagaggugauuuuugacuugacuuuuggagguuggguagauuuuuaggugguucaaagagcuagaggagggguuuagggaggugacggugggguggggaaauggugcucugggcugaauaagcaucaugaauaagggcgugaguuuaugaaacacaucagugugucaguuccaguacaguuggggcauagguuugagaccagguuggggagugggggagggagugcagcaguucaaaaauacauagacguagauaggucauuggaagcacaagcaaccugaggaaaugugaacuucaacaugcgggaaaauugaucugucaaagccaaacagggaaauaacaaaauuaauauauauauuagaaaaauaagucugucaacaacagcucggugaguuggagggaguagagaugaggaguggggagcuauagcaguugucagacaaggggucaugaggaucuggauuaagcaauggagauggaagaggggauugaggugagggagggggaggagucuccccagcaucuguccuuuaauaguaguagagaagaccagaaacagcggguuuacagagagacaucgugaugucucucugagcuuuggaugcccagaacagaauaggaggugcugguggggaaaacaggaauucuggggagagguuucauguagaaauaaugagcugaacauccuuagaauaucuauuguaguuucagauuguaucuaggguacaaucaaacucuaugcuaguuucagagacuguuuccagugagaagagaccauucucagguucugggauuaucaacauuccagggugagcagaagagggagcaaccaaggagauggagcuaggaaaagaaagaggagagaauaaguaauaagaguaaaggaaaaugcagccgggcaugguggcuaacgccuguaaucccagcacuuugggaggccaaggcagguggaucaccuaaggucaggaguucgagaccagccugaccaacaugguaaaacccugucucuacuaaaaauacaaaaauuagccagacaugguggugggcaccuguaaucccagcuauucaggaggcugaggcaggagaaucacuagaacccaggaggcggagguugcagugagccaagauugugccauugcacuccagccuaggagacaggaugagacucugucucauaaaaagaaaagaaaagaauaaaggaaaaugccagcuuuggaggaaaaccauggcccaaaggccacaaaggggccaugaaaacaaggacugaaaauaugaaaauauuccacuggauuugucuacagagagugccauguaaccuuugccaaaggagcuucaguugaguggcagcagcagaaauggagcagagaguagaaagcgaaugggauguagggaaggagagaaugaaauuuguuggaggagggagggaaacuggugagguagcaggaggagagaaagaccaguguugagagguguuuguguauauauaugugugcauguguguaagauggaagcaaccugagaaaauuaguguuugccauguguauuuuacugaaaauaaaauucaucaguuuccacuucaacccaggucuuccucuuguuuuccccacugcaccaucauucucccaguuuccagacuuggauccauggauugaucuuugcccucauccagucuguugccaagaucucuuuuugauuucuuugguugauaacaauucggcccccaccuuucaauuccuauugacaucauucugguucaaguucucauuaccucucugaagauuucuuacaaagaucucugaaaaaggggguuccugcuaauuguauacaguacuuccagauuagucuccugcaccauaguucugcuguguucuccugggcaucuggaauucaaugcaaggucuuuagcacaguucugcaggauuaagagcuacccuuccuguccucaucuuggaggggggcagauccuucugccucaggugaaauugccucuuaaagaccaaucacaugcuuuaucaucauuuccacaucuccuaugugacuugaauuauaauauauuuuggguuauagcuauuuaaauauauugggugguggggcgggugagaggaagugguggaaccaccccuucccuggcuucagguuuccauguggaacaacauuccuuaguguaaaacucuugaccucuuuuuacacccucauuccuccuccaccauaaaagauugaauuaccuaguuaguagcguuggaagcagaaacugguuguagaaggcagaagcauaaaaugaaccccucaaacuuuccacccuaaucccuggggcugggaauaugaugaguugucaugcucugguuauguuacauggaaaaaaagagauuuuuuuuugcauauguaauuaagguuacuaaucaguuggcuuugacucaugcaacagagagauuuuccugguagcccuaaucuaaucacaggagaccauuacaaacacaguguuuucucaggcuggggcagaagugaagucagcauuguagcuagaagacagagcaggcacuugcaagaacuagagagcagucucuagaugccgagggugaccccugauugacagccagcaaggaaacgagggccacuaugcuacagccccauggaauugcauucugccaacuaccugcaugagcuuggaggugaauuucucccuaaagccuucaaguaagggcucagguuauccaaccccuggauuuuuggccuuaugaagcugugagcagagaaucuaguacagcaccaccagauuuccgaccugcagaacugugggcuaaauuuguuuaaggugcuaagcuuggcaauuugcucguuuuacagcaauaagaaaacaaguacccugggcaugcucuuucccucuccuuauucuuuuggggagacacugcuuggguauuggugagugagucucccuauuucuggagcucaguagcaggaagccacauaccuaagccaugcucuccaaaaguucuaucagugaccaagcugguauuuuuaucuccaucugcuugacuccuuugucaucucacuguugauuguggaucaccggagagcagggguguuuuuuauugagccuccuaacagcccaccagauaauugucuucaucucucuagauucacucucauucccacacaaacgcaccaguggauugugaacaccuugccagcgaggcuguguuuuacucaccuuuaaauucccuaggcagcacugcagaaagugaaugcguaccugagccccugugagucugguuaacuacagauucugccucagcaggucucggaagaagccugagauucuugguuucccauaagcucccaguguugccacugccgcugguucaaggucugcacucagaguuggaggauccaguaucucagauagaacuuuuuauuuuuauuuuuuagacagagucucacucugucacccaggcuggagugcaguggcaugaucuccacucacugcaaccuccaccuccuggguucaagugauucuccugccucagccuccugagaaguugggauuacuggcacgugccaccaugcccagguacuuuuuguauuuuuuguaaagaugggguuucaucauguuguccacgcuggucucgaacuucugaccucaagugaucugcccaccucggccucauaaaguguugagauuacaggugugagcuaccacgccuggugcgauuggacuuuuuaagcuguuguuauggccugaauguuuguaucccuccaaaauucacauugaagcccuaauccucuaugugcugcuaugaguaggauaugugggaggugauuagauuaagaugagguugugaggcugggguccucaugaugggauuaaugcucuuauaagaaaagaccagauugaucucucucucucucuuucucucucucucccucccucccuccaccgaacccaaucgugcugguacccugaucucagacuucccaaccuccagagcugugaggaaauacaugucugcuguuuaagccacccagucugugguauuuuguuauagcagccugagcugaccaagacaaguaugguaauagaagucaccaguacaucuucuaucaggccucacaaggagcugcuuuacauacauuaucccauuuaauucuugagcagugagugguccaucauuacucccuucacuuuacaaaugaggacacuuaagauuuaguaaucagcucacccauucucagcccaugcaguuugccugcagagugcccgguugcagccagcagcuugcaagauggucaaaacauuguauuaccagucaaauuuccuuauuagauccugacaaguugccuuuaaaccauuaggacaggcugaauucagaggcucaagcuucuaacuccagugcuuuggaaggccaaggcuggaugauugcuugagcacaggaguuugagaccagccugggcaacauagcaagaccccaucucuacaaaaaacaaacaaaagcuauguggacauucuuucuuauucuagagcagcacauccaauagaaauauaaugagagucauauacauaauuuaagauuuucuaguagccacauuaaaaaaguaaugggcaaaauaaauuuuaauauguuuuauuuaacccaaucuauugaaaacauugucauuugaacauguaaucaauaugaaaauuauuaaugagcuauuuuacauuuuucuuuuguuucuguacuaugucuucaaaagucuguguguauuuuacauuuauagcgcaucucaauuugguuuagccacauugcaaguggucaauacucauuuguggcuaguggcuaccauauuggacaguacaguucuacaggaaccacucaaaacacaauucacccuggauagcaauuuugcuacuagucugcuagugcuugagugagcuguuuuuaaacugcuguuagugaggaccacuaaauagugcaucuuacuugacucguguuuucccucugagcuguccugaagcaaaguucagaauuuuuauuacagcaugacuugauugacucaaagguggaagaacacacauacucagcagcaauaacugaguugcaaaggccuacuaaccacugacaacaccacuaaugcauuuuuacagccauggauagccacaaguuaaucucacacauuguucauuuccacuuaacauucaccagucaugcaugccucagccuauaaaacagugcuuugguuuccuugagcucggaaacaauauuacaaaagcaucuccugucccuuucuuuuccagcaaaaccaguucccuaugaaacacaccugacguauuuuuaaauauaagcauuauggaucagaaauuggagguucuauuuuuaauaggccaugauuuuaaaauagaauuuccaauugguuaaacgauacucacucucaaauaggaauuccuauaaacagguuuauuuugaaauauagcauauaaauuuuucaaaaagccaucaauguuucaguuugcuggcaaucuaccaguuaaaacacaguaauagaucaauucagugagggagcuacuggucuaauggucuaagcuauggaauccauccucaucagaagaaauaaccaaggagcgggaauguggggagagguucacaacagaaaccacugccccuacuugccuguguugguucuuaaggggcugcugggaaccccugaagguccaagugucucuuuugugcaaagauaacaguuucuggcuggucacggugggucacgccuguaaucccagcacuuugggaggcagaggcggguggaucaugaggucaagaguuugagaccagcccggccaacauggugaaaccccgucucuacugaaaauaaaaaaaguagcugggcgugguggcggcgcgugccuguagucccagcuacucgagaggcuaaggcgggagaaucgcuugaacucggaaggcggagguugcagugagcugagauggcaccacugcacuccaaccugggggacagagccagauccgucucaaaaauaaauaauaauaauaauaauaacaauaccaguuucuaucuguuagucuuacggguugaagacagagguuaaggggccaacguguggacccuggaaagggugugagcccuucuccacauucucuuuggugugggcccuucuccacaugcucuuugguuccgucagcuacagacagagguuauguuuuaagagauagacugagaagucacucuccacaugaaaccagucuucucuucgagugauauccuucagcuaagcauugugagaaaguauccaaguggagcaucugaaaauugcgcuccagggaggggaguuuagggacuuguccauggcuuucaguucccuaauuggcgaaugucacacuaguaagauuuucugguggaugauagaugcagagucuauaaaguugcuaauacuucuggagucugcuuucuuuuguaaucugcuuuauuugaggcauuuuaguuaauauauuuaaagcuauuuccaccacaaugaauaggaaaugugacaugauuuuucuaaguugaguaaaaaagaaaugaaugaauguaugaauugaaagcagggguccuguuccucaugucccacaugcuaucccacagcaaaugcuccuucccaaacagaaucauuuauuuggauucuuuguguuuauaauuuacucuuucacuaggagaauuaugagauagaaaguauuuuuuccuuaagcaacuuuuguguucaaaaauaacagagugauuuuaauugguucuugaagggaggaggguaggggauuaacugcagaccagcuugauaagacgacccuuggugagcugguagagcaguagguaggucuauguuagaccuuaaauguggacaaugguggguacaggacaggcaaaggaaauaccccaaagcuggcugaaacagcaaauuucuacauggacaacuaauucuuggauacuuggaguaaagacaucaauauauauuauaaagacauaaauacauauauauucuauauaaagguauacaugagauucacacacacaaauauauuaucuucaaaugauagcuagguaaucauucacucagauuccaaauucaaaauuuaagauuuagaguuauugaugacuggauuaauucaugcaauuaacaugaaccccaauauauuugagugcaggaguacucacuaucucauaagguagaggaaccuguaggaaguuuguuacuagccaugugagcaaguuaguuacuuaccuugccccagccucagccuccucauccacaaaacaagaggcuuggacaagguggguuuuccagcuccaggaacauuuaugcaaaugccacuuggaauugugggaaaucggcccgggucuggugcuuacccaugucagcauauggcuagagugaacuuggguuucgagugggaaggggccaggaaggaaaaagaggacccagaaucaacuagagauaggacauuuuaaggacuuucccauuucacauagguuuucucuaauuucacauaaguauugccuguuuuaaaaagcagauucaagaagauaugauuuaaaacaaguauacacauaaaaauaacucugagauucugcaucuucuagaaaaucacagacauguugcuaucguauucuauaauuuacauggugauugagaauagacccacaguuacucaguguuauccaaaauaauuuauuauuauaaucacuaaaaauauuacaauucagcucuuugauuaauucuguuuacuccaugcccaccaaauuagugaaguuucacuauguauauuacaaaauaauaguuuaaaaauaauauggauguacaauauaguuuaauuccuauucaauaaacagauaagcuucauuauuauuauuacaacuguuacuaccucaaauuugugacuuuuuuacuaaaauaaaauuuuuccuauuuaugaucccauauagacuauagagaaauuucccacaaacauagcagaauuccuuagaaagggaauauagaagcuuuagcuaaauuuugggugccgaaucaccuauuuguuuugggacauagaaagucuacucaagaauccagaguaagaccuugaucucagucuugcuuacaaggucuugaucugugaaggaagugcugagauaucuacauuugucaauuaaauaauaaauugccaaauaucagccuuagaguauucuauaggcacucggauaagauggcaaauacuuucauauuaauccuguuaucuucaaauuuggaaaacagacuguuauaagaaacaguuggcuaagacuaucaauauccugcuuucuuguggggucaugaaauugccauaguuuacaaaaacuuuaaaauuucauguuguagucugaaauaaaaaauagcuggaaaaagcaacaauagaaguaauaauccuauucucuaauuacguaauuauauuuucuaaauuucaugaaacugcuaagaucuguauuguaaugguuacauauuuucagguuacauuauuacuauuauacaauugauauucaauaaaugauaccuuuuuauggguaauacauugaaauggaauaguaaacauuuuuugcggagacuucucauaaaacaucauugucuaccucucaaacaauaguuaagugagauuuaaacuuuuuuauaugauuguuuuggacuugcuuagaaaaauacuaccauuuaaaacuauauucuaaaagguaaggcaaauuuugcuagaauuuuugaauuaaaaaauggugauauuucuguagaguuaucuuuuugaaagguagagagaaagaguggaaagauuuuuuuaauaaaauuaaacuaaaacaucugaaaauagauaugacuugauagcuaauuuuuaauuuauauuuauacgugcaaugaaaucuauauucagagaucauccaaaaauuauuagaaacauacaaacaacacuugaaaaauguuaucacauauuuuugcagaguagguuguuuugaaaacagccagagcaaagaaacagaugaucaccaaaauauuaccacaaaugagcccaaaaauaaauuauaggucauuucuaguugaaccacugaccaauuagugcacuaaucuuaaguaacuacauagcacacucccauuuuuuucuuuccuaguuaucuuaacaauucaaaugcaugugaagauacccauuuugaggagaauuuaaaauguauuauugguugauacagcacuucuagguaaguucucaaggggggccugcagcaaauauuuacauaaauguggacuuuaagauuguuucagaaguauucuguuuuaggagguucuguaauugucaacuucucgguuuaggaagaaccucacguuuuagagaagaauauucuagaucaagucuuuuuccuuaaugcagaaauaguaaaguuucuaaaauagaaaucauuuuguuuagccuucucuuuaaccaaaaacaccaaauaaugaaguagacuucuaaggaggaaagaagaaaacuuuaccaaauaugccagugggggcuccacuuuuagucugcaaaccucuacaccugggagcugcgcugucaaauugagucagguccugauugagcugaaugauagacacauagugcccagacaccgugcacagugaacucacucuaggagacccgcacgcccccuucucccaauucacccacugcucuggaggucauuauuuaacaccggcaaauugaacgacaacaugaaaugaagugcaagauguagauauuucuucccccucacuaaucucgcucacaagagaauucauucuuuucuuuuugccucaggcauauccaggcuagcaauuuucauuuugcuaccuaaaugauuuccccaucccccaccuuucccaauuagaguggaaauggauuaagacuucagguuaaccccuccguuacugggaaugagaaggaaauaacguuauuauguguaagcuuuauuuucaccguuguguaugaugcucuuuucugaucaugguaaacacagauuuaauuaaucccacucuccccaaaagacauuccuuuagugaagauaugacacugccuuaagguaaagagcaagagaaaaacuucuuuagccagaauguuauucuguuaacuugucaucuuuaaaguguucuagaaugcuuaugaguaaaauuaggaaauuuggauacaaaguaggaaguuauauggaagcauaaaagcacauugguucuucaguuacagagaauggauacaacaaaaguuaauacuuccuugguuuuuacuaagcuugaaauaucuggaucuaaaaaaauuaagugugggauaaauaucuagaaaaugcuggaucaucugaaacuuaucacguagcuuuucccccuacagaaccuaaaaauaaaaacuucucuagaaaaaaagcauccucucuuuacugaucuuuaaaaauuuuaaauguugaagcccugaguauguauaccucacauaacuccucuauagcaaccuauaaaacaagaauccucucuccugguggucuguuuauuuugcuaugaacaaaagggaaggagcuucaguauuucugaaaauaaccugaauuccccuuugagacaaaguuuuggauuuucgaaaguaaaugugguacuuuucuauuuuuuaaacuaauauauaaguguacauacuauuggcuuuguuggucaagaaaacaguuuaucauaccaggaagagacuggguagcagaacagcagccuacgaaugcauuagauuuggguuaugcuggguuuugacagguuuggggguuuaagaaacuggguugguucgucacuaggaauccauuaaguguugcuaguccgugaggacagagaaagcuguggaauucauuccucaaaagcaaaagccuuauuugugcuaauaggguuauaacaacugagcaaauuuuaguggacaaauaguagagguccuuaacauuuacugagcuauucugagcuucagacauuguggcaagggcuuucugugcauuaugucauuuaauccuuuugguaauacuauuaauuuaggaacaauuauccccuaaggcuuaaagaaguuagacaacuugcccaaggccacauagagauggagcagugaaaguaagaauuugacccagucagugcacagaguagacaaucuuugaauuacaugcauuuaaauaaaaaaaggcuguucuucauaguucucauugaauaaguuucauagacaaugacuuucccaaaggacuccuuuugcuucugaagggcagccacucuccaguuaaaggggauuugcaaacaggcccacucuggauugcaguacaaggaaaggaacugcuuuagaaacacagaacccagauagauggauaaauauuucaaugccuuuccagaauaguacuuaagaagcagagcccaucucaguuuggguuugagcccauggccuuaugguuuaaauauaaaaugcauuaaagcucuuuauuuagagagucacgugcccuuuugugggagcagccccaauucucccucugacuuuagugaguguacaaugcaaauagguguuuugauauugucauuaguauucauuauucaugaggacuugaucguguauucaaagucagccaggagggucaugugcccccuucagugaaaaccuugacucuaaggacagcacuuuccugguguacagucuuugggggcucuugacagcaagaaaaccuaaacaggagaaucccacuuagcaucugcccacagguaaggggcacagagaaggagauauagacuucuaauuuagcaaaaagaaguaugcugccaugugaaaaguuucuaaacagugacuucuaaacaauagguugugacccauagauugguuguuaauaauaauaauaacaaaagcaagguaagaagaagaaauagaacagaauaacuggaaaauagagugcuucaucaguaguaagggugaauacugcuuccugaagcucuuuuuuugauugauguaucuccccugagcccuggcauacuauuuacuucuuacuguuucuugcuauucaaaaaguuugcaagccucuagccuaaaaugucuuauuuucuuaguacucaauuuguuacuugacuugguguuuggcucccugugacucucugaaguucuccuuucugugccuccgcuuccaccuuugccaagucuaaaaucaugccauguaaaaguuaucaagaaaaccaauuaaaucauaacugccgaagugccuugucaagcuaaacagucaugagaggugaaggauuauuaugaaauaaaacagagugaagcuguuuugaaggccauccuucuguggaauagcauugggucauuucguucagaggcgaaaagauucuuagcaaacauugggucauuuuguuuagaggugaaaagauucuuagcaaacauuuuguccaauccauuuaguuuauagagggaaaaggaggcucugaaaagugaguggcucuucuaagcucccgaaacaguggcugaucugggacccccugaccugugaauuugugguccacccccaugcucugccacuccuccaagagccguuuugcuacuucuuuaaaaaagggagggucuuaugaaauuguauuuacagaaaauuuacaacucaugcaaagcuaaauggauuucuucccuuucaaagugguuuccugauugcaaucacauaaauuaaacuccagccccaaaaaagucauucgaacagaguaaugauacaucuccaagaagagauacagagaauucuuugaaauucucaagaaauaaugcaaugagaugcaaaaggguaacuauuauuaaucuucuuccugaagugucaaucaggaagguauuuuuaaauuguauuggaaaggaagaagagacaauguuucuucccauuaaugaucugaacugaaaguaagggaggaacuaaaaaaugugcaaaauguccucggggaaaaaaaguaguauaaaacauagucuuggaugauacagcaaggucguugcucaauuuuauguuguaacacuauuuuaacugucaccaagggcugggauagcaaauauugcaucaacucugcaagguguuuccuggguuuuguggacaggggggucgggggaggugcaaucuccauucuugugaaggccagauaaagacuucugcugcaagccacuaucuuuuugugcugaagcuguagauaacacaguuucacacccugcugcccaaguccugcuuucccaauuuguaggucuuuauugcaaaagucuuuuguguuuguuuuaucagacacauuuuaucauccuucuccaaacacccuuugucaaagucagccuuugaacuucuuuugcauauacauagaaugggaccaaugauucaggauauguaacaggcuuaucuuauaauucuaaagaaagaggaacagagccauugaccuuucuucuauauuuucuuggggcuggugugucugugugugugugucuguguguguguaugugugugcuagggguaagauguacaaucucauuaccuuuagaagauaaugcaauagauuauccuauaccaauaauuuaugccuuuuaguuuugcacaaauuaaaccugaaucuuaaaguucaacuugucuaggauuguacuaaaggccgcauugcagguagggcuaauuucggggucugauccguguggcuccccaugcuccugacaguacaccaggaccacucuguguucacucccgugugcaguccccaugcuccugacaguacacccgacccuaagauucuugcuucgcuugccuuugauauggugaucucuggaacugaguaucaaaccuugcuugaggaauuaaaaugcuugcucauaucacuuauaucuuuuaaauguggaaaacagagagaauccacuuggagcacaucagauagguuuauuacuuuguuccucccuugucauuuuuugcaugucucacaucaaacccuccucugcaacagugaaaauauaggaugggauagaugaagaaggugguacuccuuccuucucugggcacagaggcaauuucucagugcagcucacauguggcuacaaacacagaguaucacuuucuuauacagaccaggucacuguuccucaaaaaaaaaaaaaaaaaaaagaugguguucuauuugauaaccugcacuucuccagagugaccucuucagcugagucuggaagacugccuuaggcaagucccccgggucucuggcuacagagggccauccuccaugagagaugagcuuguuucauuguugcaaaguauagccaagcugauacauuuuagcaagacuaaaacuuaaucuuuaggguucuggguccuuucaucaaauuuccucugcucacaccaugaucuccauugucuccuccuccuccuccugcuccuccaguuccucuuuccuuucuucuucuuuaccuccucccuccuugcuuccuuccgccucuuccuccuccuccuucuucuucaacuauuaucuaccaagcugugccugggcugcccccaguguuuugcagugugaggaacuucuacaggccagcuuggccacugaaagaagccagugauuaauguaguuuuaaacaaaucaagauuugcauaaauuggcucugaagucagcuucuacaaaccagcuggaacacucgccauauuccuaguucagugcugucuucccaguggguucucagacuuugcagcucacccuuagccuucuguugcagggaaaccacauccauguggcucccagucucuggcaagccagcaaagggcuccaacuucucuugcuuucuccaccuucuccucacuggcuggagcacucaggacucucccagguccuauuuuucuccuuuugguaauuuccugauagaaacuccagcaaugaagauaauuuucagaacuguuuuuuuuuuuucugguacagaauucauuuuggcuucugggaacuaagaaacaaaugaacugucuuucugaagucaagaacuguauaaugaaagcuaaaugcagaggcaaaagccacugucgguugcccuuuguccucucugucaccagcccuggacaugagggugagacagaaagccucgcucuuccccagugaaacccugcaauuguucugugccagaugaagcccucuucagaugcuggacaggguccaggugcugcccugugaguggaugccagccucaguccucauccaggccaggaccauguccagggcgggcuugcuccugaaucacaugcuuccagucaggacucugaaugcaaaugcugguguuuuguauuuuuugucguuauguuauuguuguucuuuuuuuuuuugaaacaaggucucacucuguugcccaggcuggagugcaguggcucaccgcaggcuccagcuccuggguucaagggcuccucccaccucaaccucccaaguagcuaggacuacagacacacgccaccacaccccacuaauuuuuaaacauuuuuagacaugaggucuccuuauuugccccagcuggcugugaacuucuggcuucaaggugauccuccugccucagccuuccaauuagcucauacugauguuuuauuuaaauaucgcauaauauuucaguaaaaggccugcaaagagggcacagaaagcauuuuuuggaguucacugggggcaggacgagcuaucccauuaggugggaaggggucucuuccugauaugcaucauacagcugcuucuaguggugguacaggacccaggagaagaagaguaggugcuuaacaaauauuugcugaauaaagguugaugaaaaucaaugucgacaauacauuuauugggaucagguaaggaacaaaggugauauuaacaacagcugccaccugcgucuauuaccagacaucucauagauagcaacccugggagggagaucuuacauacaugaggacagaggaaugggagauccaccaaggugccugacagcugcauuugaacccauacucagauagaggaacccucugcagucugcucaggguuggaguuuguggcugggagaaaagaggaacagccucugcagccaacccuccugggcagcgaaugucuccuccccacacugcagugaaccccuggccauccuuccagcucugcccuugccccacuccaguaaagcagccagagagugauacacauuagauugugucucuccuccacccaaacuccuugacggcuuuccagggcacucagaauuccaggcccuggaggaaaccagcccagcccaucaccuagaccugggagcaccugucucccucggcuugcucugccauagccucugucugucucacagacgcgccaagcuuuuucugccucaggaccuuuucaggggcuuuccuucugccuggaccacuuuccugucucuaaacucccccaguuuuccccauggcugcucaaccgucaucuacuaaaguaauggguaaaguaaccccgcucccuaccccugaaccaucacaacuaucaugucacaugcacggguuucuuuucaccauugcauuugucuuauuugauuucuguguuuauguauuuguuguccauccuccaagugacagagggaguggauggagugaaggauaaguuuuguccuguucacugcccagcaucaagaaaagugcuuggaacugaguagauagucaacagacacuucuuaagaaugaaugaaucaaucgaugacaaugaacuguagcugccaccuccuccagccuacguacccugaggcauccuagaucucagagcaaggagaugaugacugccaggcauugaguggugaaaaaauauuuuccuuugcuacuuacucuucuaucacuggguggcaguaaggcuagaagccugggaaaucuccaucacccguccucucuguuuugcgauacucuugggugcccugagggcuuuagagguugcugcggucaacaaccuaagcaaccacuucugaguuucuggcauaguggcaaccacaacuggccaguaggucgaggaggccucugcuuaacauauugcaccgauguuuugguuaugcaaauauaugguuuuucucauuccgauggaaaacauuucuggccaagucaaaacuacagaaacacagcaaggaagacucaucuauauaguccccucagucccauugccccagccugggucccucuuuuuacacccucagaagacuguucccauugccuuccuagucuuugagaugcaggcauuuggaaagcacacaucugaugcauaccugaaacuccggaucagucacguaauuguuuccagauauacaggacaugugugaugacagauaggauaugaacagaugaguagugauuggaucugagcucaacauuccaaaccgaugcaaacuaggguguggggagaagccccuggccuuucacuugggguggggcuggggggccuucaccuggucuaguuuaaucuagaagcaggcauagaaauggcaggagaggccaggcgugauggcucacgccuguaaucccagcacuuugggaggcugaggcagguggaucacuugaggucaggaguuuaaaaccagccuggucaacauagugaaacccugacucuacuaaaaauacaaaaaauuagcugggggugguggugggcaccuguaaucccagcuacuugggagggugaagcaggaagaauugcuugaacccgggagauggagguugcaguaagccaagaucgugcuacuccacuuuagccugggcagcagagggauacuccaucucaaaaagaagaagaaggagaaggagaaggagaagagaaauaauggcaggagaaggagggagcaguggcuuugcguagacuuuucucugggaugaacugggcucaggaaaggaagaaaccuguuggguucugaugcggggcuguucacccacaaaagaauggagaggugcagauggaaguggaucuccugcagagaugguguagagacagaauggaaaccccaggccaggagugucagcuuugggaacagugguugguggcaucugcagccuucugcgucagcuggacaccacacgucuuaagccucgucaccuucucuuuacuuuuuugccccuucaaacucacacuaauuucaguugagacagggcagaaugcauacuuugcaccacccuaugccacaagguuucaaucuggggugggcauggggacccuuuacauuguauucuuuaauaauucacauggcagcaucguagggcuacuuuuaauugcuucuuaaaaguaauuaauugauuuucugacguaucaguuaacaauguauuacacugacacgaaguuguguuuuggcucuugauugaaccgagggcuguauggauuaaauuccacccagaguuuagcuuaggagacucuaaaaauaugccucuauaaaaggaaaggcuuuuuacauggcguguugucuaaaaaucuaaaccauauguccuuuccaggcugucaaugggguaaaauauggguuccaguguguguagcugcucagacuucgaacauucaggaggcauaaaauaaccuacuguuacucaauauggccaacacucuggauuaaagucacucaggcuaugccgagggaauucucucucagucagugugaagcaggagccauuccaucaaaacgugguuugcuaaggacucuuggaaggaggcaaauaugagcuuuguucugagagcggcugucuccuggcaggagcugaguuugucuguagcugaguuugcaagauccauucauugacauuccaugauagaagaauuauacacagggaggauucccaucaacaaugcagacacuauuaauggggacguuaagaccaagauuaguuaaguggcuugcccugggucaugcacugagucaguggagcauuaggaacaaggaccuccugacauuuuggcuucuguagggauuuguguggcaauucugugaugaggaugauauuguaacugccaggaagucaccauguauauuucaacaccuacuguacccacaauaugaaucucuugacagggucauuucacggggggcagcauuucuuccccacuucugggagcuaucacucuggccuuucuccccuucauauggucaguugggcguaugggagaaggaaguggcaacucagggaacucaguucccuccucccucccuccacuuggagcuagugccugcaggaagcacacauucuggucagugucuucauguggcauguuuuacacugguucaacugcgccugagacaggugagagaauucagcauugggaagccuguguggcugcacuucacagccccauucugcaacuuggccuugagcuggcauuuggaucugcaugugucccacuucuuuuugccuguguccuaauugauuuggaacucaagagggcugccauucauugcauguccuucaaucugaguguaaagccaggacaugugaugauggcagaacgagcccacuuaaaccugaugcacagugagcugaggccuugcuucucagcuguguuccuuaccuuggccuggucauucgugcucaguuuccugaauuauagaaugaggauaacgauuccuccuuuacagcaccguuaugaggacuaaaugagauauucaacgagaccgcuuuuagacuuuguuuacccuagcaguugcccaguuaauaggacuugaacuuuuuuuuuaauugcaaaguaccagaagaaagauguagaaaaaguguuuaaaaaccuuaacauauuaugcuauuugauuuuucaauauuuuggaaacaucuuaaauucugaccaaaacuuacaggaggaaaauugaagggaagaauuaaugacuauguggagacaagggagugcacccuuuaugaggaagaagagguguguauaggaagcacuucacagguaaagucaagcucaucacugaucugguccugcugagcugaggacaauacuugacauuccucugguaacuguuuacaugaccauucauucuuccuuguccagccuaaacacaaauaggcaaaaagacucauguucauggaaucugcuuuaauugcagagaaugguuguuuuaugagccucaaaggggaaaagcauuuuaaaagcaugugaagaagcauucuaugcaaauguaaaauauuauuaacaaucacaugacuacuuugaucauguauuuuaacauauuuguuguuucuuggcaaaguggaagguguugucagaccagaggaauaagugcaagagaucaaugauguuugggugacucauuuuauaauuaucuucaaacuuuaaggcuugcaaauuccauuuuuccuaggucaguguuauuuugcugagauagagaacaaaaguuaacauuauacaaauaugaaaaaaguauucucuggggucugaagugcugaauaucaacagccucuucacauuccucguuuuuggaagugaaaagcuuuuacccagagauauagguugucuucuuaacucuuugaaaguacaguaaugagauccaagcagauucaguaauccauauucugaaaguuauuuggguuaagaauagaagaguuuuuuguguguguggggaaggggagagggggaagagucaugaauuauuuaccaugauucuagugauggcagaaagccucaagauuuugcugaagucacugauugauuuucugacacaacaagugaaaggcaacgccaguggcucauugguauugcaugucagacacacgauccccuguuaaaugcagggcugcauuacagcugcuauaaguuuguguuucacgggugggagaaagggauaauuucuguuaccugaucauuaauauacucuaaagaguucuggaagaaagcaacaaacaugaaccccauguucaacgaacauaauaugggcccuucccgugggcaaaguccuguccuggagaauuugagggguaacauuugaugaaggcauggucccucacuguuaauaaaugcacagucuaguggaaguggcagugugauuaccaaauacugagaguucgauguagaaugcaaugaaugagaucacagagguauaaggcaaguguuaugggagcacaggaagggggagaaaugaguuccaucugaaagggcugaggagggaggcucggaggaggagaugaugacuagauugagucuggaaagagugcaggguuuagacaggcaaaaaugggaaaggaauuugagcuagcucacaugacauaagcaaagucaaggaagagggaaaguacaggggaugucacggaauggcacauguuggaugcagcugcgggacauaucagcaugggaagagagggcccaggcagaacagaaggccaggaagggaggccagcccugggucgcggcggcauuuucugagcugccaggucuuucuauguguuaucuaacuuaaugcucacaaaauccuuuugggaaaggcaucaugauugcucuaauuuuauacauaaaauagcagauuuauggagggucaguaauacccaagaacacccagccagcaaguggcagagccaggaccuagauucaggacugaaaauagcaaaggccaugcugugaccccaugcuguuccgacacaguagaaguccuauaacuaagucuauggcuaggguuuggagacuucuuucccaugggcaggugggcaucacagaaggacucugagcagcagagaaaccuaagugaccaugcuucagguagagccugaggaaucagugaaaagaaugaguaggcagagauugaaagcccaucggccaacugggagauagggcacaugucuuugugaaggggcuguggaagccaaggaaagagaaagcagauggagacagggugaaagaggacacucagaacuuuggagccuagacauuggggugaggcuagggcacagaugcagauguccagguguuuagccugggugacugggaugauugcaaaucaucaggcaguuuucaguugaacaaaaagaauuggaauucugcauuagcauucuacauccuacaccuaaaggcgugacugguuauuagacaguaagagaaaugcugaccagaguuuuaauacuacaucaaucagaggcauuucugcuggguaacaaauuuaauaaaaugacaacaucccuugauaucucucucauucuuggcagaaauaucucaaagaagauagacagauggaaagguggucagacacauaaagaaagcaagcgagaaagccuggaacguugagcccucauacaagcauugaaaugaauguggggcuuggucaguaugaaaggcaagucaaucaucaucacuggaagucagaaucaauuuguaagauggcucgucaggacccuaaacgcauaaacagaagaaugagagguuguuauaaaguccuuggcuuggccgggcguaguggcucaugccuauaaucccagcacuuugggagguccagguggauggaucaugaggucaggaguucaauaccagccuggccaacauggugaaacccugucucuacuaaaaauacaaaaauuagguaggcuugguggugggugccuguaguaccagcuacucagggggcuaaggcagauaauugauugaauccgggaggcggagauugcagugagcugagauugagccacugcacuccagccugggugacagggugagacucugucucaaaaaaaaaaaaaaaaaaaaaaguccuuggcuuuuacccaagugaugaugcuguguguuaaggucaaguugaucugauaaaucgcuaugcaauaauccaagcaccccaaucccuugggggugcucaugagaugagagaugcaggggcaugacaauauucucaccuugaaaaccucuuggggagacuucucaacauagguuugugacaauuguccccuggucugaguugaaaaaaauguagcugaucauuaucagcauugccagauuaacacugguacccagugaaauagucauccccccuugcaaggguuauguggaaggaaggaucuauguuuaacagauuauuuuaguuuuaaaauuugcuuaucuuauauauugugcugccauggaugcccuugauuuuauucuuuguuaggaaggaauaucauggcuuugaaauccugaggccuauacuguaaaucuuucacaaauuuaaaaaaguacaugaaauaagauacaugaggccgggcgugguggcucacgccugucauccuagcacuuugggaggccaaggcagguggaucacaaggucaagagaucgagaccauccuggccaacauggggaaacccugucucuauuaaaaauacaaaaauuagcugggcauaguggugugccuguagucccagcuacuggggaggcugaggcaggagaaucgcuugaacccagcagauggagguugcagugagcugagaucaugccacugcacucuagccuggugacagagugagauucugucucaaaaaaauaaaauacaauaaaaggauacaugaaauguaugugugaaaugacaguagaguguauuuugagauauaucauaauguuuaguauaugccagacacuguuguaauauaucaauucauuauaaaugaacacaaaaagggcuuucacuuucgcaucaaugcuaugagguagguauuguuccuauuacacuaauuuuacagaugaagaaacugaggcacacaguuguugauuaacuugccuaagaucacacagcuggaggagcugggauugaaccuagacaauuugguuccugaggcauggucuuaacuagucgaagcuguuucccuugguacucaaacuuaauaagguggauuugcaaguauagucuuugaaaagugaugaccauggagagaagggacuuuugugagggaucccugaucuggugaccagugagaaccaagacaacuacacucauucaagaccacauuuuacguuugagcccuguuacuggagaacagauaagggacccaucccguguuuuugacuucuugaccuacugacuuacuacauaacuauaucgauuuugcauggaagcuccugcucucuguggguuugaccaggcaccauuggccugccuuuugcugcaauaagucugggggcuucacucacuccuuaguggcuuauucucaccacauauuuggcucacaccagcagagccugacucuuccggggaaaaaaugauuuaccaaauuagcauggagauaaaaauacuuucuucuucgauugaguggucuccuuauagaauugaaacaaaauuagauucaggaaguggcaugcauuuugguaacugaugcuugauaauugaguauuauuagauuuagguuuuugcccaaaauaacgauuguaggacauuagaacgaacuauuucagaugaaacuuuuccaaugugaaucaaauugugaaaggaacaagcacauccugaauuagugcuguauuuuugaaacauacuggaguagguuuaagcauuccuuccuuccucacgguaauugagcagauguucuugccaggcucugcguuagguacuuggacuugggcagugaaucagacagcaaaagccucuuccuuucaggagcugaccuuccaggugcagauagaaacacugaaaugaauucuaauugcaugugugguguguggacauagcaaaauaaccaucaucaaggaaaaaaguacucuucauauuuagaaacuuggcuccauacuauuuuaccaauuuugggaaucccaauuauuuuuuucccaaagauacauuuuagcacguaggcacacuuugaggcuuuacucccacucucuuuuguuucuuucacuauuuucuuauuccacaaccaaggucuuucccaaaaccccagccuuuucuccuccugauggcaaauuauggccauuauuagagacggugauugucccauuucugcacaaugaggugaagcaagaaugaaaaugcuuguggauuuugguacuaccuacugggggcagcuuccaacuggaaacacaccaugaaauuuaccaguuucagaccaaauuggauagucacuuaaaaaaucccauguaagcauuuguaccuuuguuucauauuuaagcuguauauuuuacauaccugggaacaccuggaaagaucuuuugguaugacugucuggagaaggucuuaaacuuuuagauuguuaaggaacuuuucaguuccuuacauaaaaccuagaguuaaaaacuugcguucugaggccaucccuauuucucuugugaugugauauguugagaaguuauauauacacauccacaugggcaagccacauacucacuaagaaaguccuuuuguguaaauaccaggagcuaaauaaacauuuuuucauguuuuuucuaguuuuauugugguaacauauauauauaacauaaaauuuaccauuuuaacaauuguauuuuuguuuuuugauuuguuuuugagacugagucucacucuaucacccaggcuagagugcaguggcgugaucuuggcucacugcaacuugugccuuccggguucaagcgauugucuugccucagccuccugaguagcugggauuauaggagccugccaccaugcccagcuaauuuugguauuuuuaguagagucgggguuucaccauguuggccaggcuggucuuaaacaacugaccucaagugauuugccugccugggccucucaaaguguugggauuacaggcaugagccacugaacccaaccauuuuaaagugcauaguuauguggcacuaaauauauucacacuguugugcagccaucaccaccuuccaucuccagaacauuuuugucuucccaaaugaaaacucuuuacacauugaaccagucaacaccaccucccuguuucccccucccccacagccucugguaaucaucauucuucuuucugucucuaucaugugacuacucuaggaaacucaucuaagugaaauuguacaguauuuuuugugucugacuuauuucacucauuauaauguccucaagcuucauccauauuguagcauaagucccuccuuucuaaggcuaaacaauauuccacuguauguacaaaccacauuuuguuuguccauuugugugucaaugggcuuggguugcuuccaccuuuuggcuauugcgacccaugcugcuaugaacaagagugcacaaauauaaacauucuuauucacucuauugacauaaucauuuuuuuuuucuuuugagacagugucucucucuguugcucaggcuggagggcaguggcaccaucugggcucacugcacccucugccuccggguucaagccauucuccuaccucagccucccuaguggcuggaauuacaggugugcaccaccauaccuggcgaauuuuuuuguauuuuuaguggagauggaguuucacuauauuggccaggcuggucucgaacuccuaaccccaagugauccaccugccucggccuccugaagugcugggauuacaggcgugagccaccauaccaggccuacauaauugauuuuuaaaaauugugacagacucaacuaugaucaaucccuuuugaaaaucuguggcaggauaggauaauauuaauuaauugaucuugaauacuuccaacccuccugauagauucaucuaugucuuuaauagacacuugauggccgcccagcauguacugagcagccugcuggaucuggaggauucugcuucaagugucucuaacagaggagacaggacuguaaguggggggcucgaggcuggugcucugugugccacaagcaaggugugugccgguucuagaggagaagacagcaguugugcuuugcccuuccaggauugucaggagggguuugguagcgguggagagaccagaacugaagagaaaugcaugcaauguaccaucccugggcuaggaacuugaucucucuuauuuuauguaauucuuuuaauaguuuuaugagguagguacuuuacugucuuuauaucaaagacaaggaauuaagguuuggugagauuaguuuggccaaggucacauaccuaguaagaagcacaucacuuuauagcucuuaacuacucuguuacauugauguuccaagcagguauuaacaggguaagggagagaaggggugaagagucuuccagaaagagagaaacagugaucuacaucacaugggcugaugaaggagcaugggggaauuuggagaacugcaagauguccuuacaaguagggucaccacaauugccugcuggaguccccccugguggugaggccuggggaagcccccuguucccucaucucuuccucauuguccuucugguaggauagcaccagugacaccuggagaggcuggauauuuucugcucaauuuggguuucugcugcuugggaauuucugacauaaacagauggaaaacaucagaaucauuuuuacugaauaaguaucuaccauugauugagcgcuuauacuaagccagacacuauucuaaguacuucaccuucauuaucauucuaaaucuucacaacaauccuuagagguagguucuaugauuacccuauuuuauagagggagaaaauagauagcaauuggcauggccuugauuagaauaauauguaagcccaaaaaacuacagauggucauuaccaauguccuauuuauguauuagacccuaacagccaacuuucucaccuuagcaugauacaguuaugucuugauuaccucuguuaugguauggcuuauccuuggccguuaggacggguggcuguauagcucagugugccccaaaagaaaaauaaugacuaucaagcacccaggggcugcugauucccuuucaucuugugcaacaguaaagaugaaauaucuauauuuaaauugggcuccuuaagaggugggcugucacugucaguuagcuuugugguuuucauuucuuuccaguucagaauuggauuugugaagaaacugaauagugaugagaccggcccuguucacccugaugacaguuaugcacguuuuuaaguugugacgucaugaaaacuuguggcaccuuucugaacagccagaacuucauuucaaacaaaacucuaauuauaguuguuacuuaaaaaaaguccaaacucuaaaaaccauaaccuaguuguugaccuaguuuauaaagucuaggcauuccacgggaauucaaggugcacaaaggccaaccugaacuuguggcugaccccauaccuucugcucuucuuauauuucccauuucagugaacagcaauucugucaaccaucauucaaaugcaaaagcucaagucuuucuuucccaacacugcaacucuguugauuuuaccaccuccccauccucugguuaugucccucaccuccuccccacugcuggucucuggaguuuacuuaguagaucucuucgauuuggccuugacucccaccuugccaucuuccacgcugcugcugagccaugucucucgcguuaaaaucugaacacauuucccugcuugaaagccuucuauaguccccagugccaggagguccuggccacugggcccacuguccacaucuccugucuucccccucuugaaucuaaugcuguuguuguauugacauuuuuguguuuucauacgugacagggcaguucacaaguuggggccuuuacucacucagugacccaccccccgccauggugguuuugccucuuccccuaugauggcuaacuucucuucacaacagcuuacccaucaauccaacuugggauccugucccuuugcuaggcccaacuuagcuccucuccucauuuccuucaauucauuucaacuaaauuucaguucaucuuugaugaccacuugcuaagugcuaggcucugugcucuguguugggaauauggagaugaauggaacacagucucuuuccuuaagguacaacagguuaauacucaauagcuacaagguguagagguggcacaggguggcuggugacuaauugucuuggaaggcacacaauuccuggagcuagugauaucaggguagaguuuguuaaaggacaguaggaaauugaccuguggcugugguguguuggugaugagaagaggagagacauucgaguuggaauaagcaacaugugcacagucauggugguacaaacgaagaagguguuugggagacuccuaugcgguuuaguaucacugaaaaagucuccuugggcaugagaccaaagaggaacgugggagccauuugaaggaguaucauguuuauuaugcugaagaguucaauuuuaucucuuuccugaaauuuccauuucuucccugucucaaucagcuugggcugcuauaacaaauuacaauagacuggguggcuuaaacuacaaacauuuauuucuuauaguucuggaggcugggaagucuaagauuaagauucagcucuggagggagccugcuuccugguuugcauauggccaugcugucauuguauccucacauuguaugugugagagagaggaggcaagcucucaugucucuuguuauaagggcacuaauucuauucaugaagauuucaucaucaugaccuaauuacuucccaaaggccccaccuccuaauaccaucacaugggguguuagggcuucaacauaugacuuuugggaggauacaaacauugaguccuuaacauccccaaucuguguuucccagugaguucuaugcaggugcaaugaaguccauaaacucuucccaaacuauguuauccuuuagaacaguuguaugaauuuccauagcacugguaguuuggguuacguaucugaaaacauaauuauacaggucuuucauuacucuugaauuggaucaugugaguuuauuuucacuuccucaauguuauggguugaauugugucccuccuaaaagauauguugaaguccuaaucucugguacuugugaaugugaccauuuuugaaauagggucuuugcaauuauaaucaaguuaagaugggucauuauggaggguucuaauccaagaugacugguguucucauaagaagaggaaagccaugggaagacacagacacaaugggagaaagccuugugauaucaaaggcagagacugaagugaugcaguuacaagccaaggagugucaaggauugcuggcaaccaucaaaaacugggaagagguaaggaaggauucuccccuuccuguuucagaggaagcccggcucuuccugaucuuagacuucuggcuucuaaaguuuugaggcaauaaauuucuguuugcuuaagucacccaguuugugguacuuuguuauggcagcccuagggaccaaauacagcuaauuauauuguaagauccuuagagguagaaaaaugaugaaauauuuuagcaugauuacagcauggcucagaaagagguucgagaaauaauugguacguaaauguugaaugggugcaugaaauggagaugggaguucacaauagucagaaggguguagagucaccuguuuuucccaaaggcuaguacuauagagugcuuuccuugugcaucucguugggccauggaaaagcugugcuucucugucacuuaacuuauucuuaucacagucauucaaagcaaaaauaagggcagaacauauacacaauuguuaacagaaguuaucucuaaaugguaauauuuuggguaauuuugauuaaccuuuugcuuuaauuauauuuucuaauaaaaaaauuauguauuccuuuaauaauuaaaaguauguauuuuaaaaauacaaaugugcuuaauaugaaaagacaggcugugcgugguggcucauaccuguaaucccagcauuuugugaggucgaggugggcagacugcuugaccccaaaaguuugagaccagccugggcaacauagugggaccccaucucuacaaaaaaauacaaaaauuagcccaaguggucgcacaugccugucagcuacucaggaggcugagacaggaggaucccuugaacccaguagggcagugagccaugaucaugccccugcacuccaaccugggcaacagagugagacccagucucaaaaaaaaaaaaaaaaaaaaaaaagacagcacauauuuauuauugacuaaaucugucagcauuuugaucuacaacaaacacaaauuguguuuuucuacagcacauauuuauuauugacuaaaucugucagcauuuugaucuacaacaaacacaaauuguguuuuucuaaagcucuuugggguuucuuauaaagcaggcuuuuuaaccaauguuuugaacauaucagguuaagguaugugaaauagucucuccaggugggauuuaacauaaugcaauaagaacugaagauuuaauagaggauuucuuuucuaagcacaggaagaauggugaaagcauuuagcuuucaccauuggccagacagauaaaacagacauucccuaaagacaucagcaccuuagagagaaaaucaaaacuacucaacagaaaagugugaggcaaggaagagcugcagauagugucuacaaaggguggcucagcaguucuggagugguuucucucacugcauuuccuuuccccagaggucccuuuggcuaaagcacuguccaaaggucaguugcuggaaugagucguuuagugcugaggaaccaguugccugcccaaagaguugcuccgccagcaguaggaaaaaaaagaaagugugaauucaaguauuucagaaaguuugacucccacuuuauaagagcagggggaaaauucauaaagaaagugaggccauuaaagagcuggaguuuacaggauugugaagcaggaaaagaagucagucuugggaaguaccauuaacaaauuuaguaacaggcugggcuucagccuccucuucccuugccacacuccacguaacacagaaugcacaagacaccaagccacaugugugauuucucuggacucgcacguguagggcaagcugauguucauuugugaauuggauuucucauuugcggacucuuaucuaugaugcaacuaguuucccagacauuaugcuuugucuuggacagauguuggugagugccaugcaagugcccugggucaaaaacgguuucucuucuccucugcgccuuggguggaugcagggggcuacucauuucuccugagccuuuuccuuugacuauagaugacuuaccuguauauucagacucugaauucaauaagguucccuugccucgaauuugccauuuacuuuggacauggauggaagcuugcaagcgcagagcaccauacaaugaauauuuuagagcacauuaaugguacuguuaguauagacagagggccugccacauaguaggcucgugaaggcuguugucugaaaagagcuugcuuuggggacacaaaucaaacuguauauuugguugauaagauucagagaugugaauccauccacagcuaauggauggaccagcgaguuagcucuggcaaugucuucucuagaacagugguucucaaaauauacugcacguuauaauugccuggagaguuuuaaaaaauuguaaugcacaggcuauuuaucauaccaaauuaaaucagaauccuugagggguaggacccagucuuugguguuuaaaaaaaguucuccaaguaacuucaauaagcggccagaauuagucaucacuauggagugacaacauccauaaauagccacuagucuuaugugauaauuuaaauuuaagcuaauaucacuuacaauuaguuucuuaguugcaauagccaaauuucaagugcucaguagccacauguggcuaguggccaccacacuggagaguguagaguuauggaacguuuacaucauuguggaaauuucuguugcacuacuuaagagucuagagcucuagguuuauacugaguucuucaagcugaaugaauacugaauggccauacuaccaaaaagaauuugaaguaaaauauucuugccauagauucuuuaucuugauacccaucucuauaagggccaaguuacgaggccaggugcgguggcucacaccuguaauacaagcacuuugggaggccgagguggauggaucacuuuaagucaggagaucgagaccagccuggccaacguggugaaaccccgccucuacuaaaaauacaaaaaguagcugggcaugguggugcaugccuguaaggaggcugaggcaggagaaucgcuuguaaccagagguggagguugcagugagccaagaucgcgccacugcacuccagccugggcgacagagugcgacuccaucuuaaaaaaaaaaaaaaggccaaguuacaacuagaaggcugauuuagauuuuuuggccaaaguuauauguuucuugagauaaagaucugaugcacaacucaaaacaguaguguuuuuuguuaagcccacagcuguggucaguguccaugguuaucccauaaugacuacuuccaccucauugccaagcucauuaaaaaagaacagucuccacacaaugcaguguuaaguuucggggcucagaaaaucccugagaguauugcaagcuuauuucuacagauuuuuuuuggggggggggguagauuucacuuuguguacaaauccacuuuagagcucccccuucucucuuaaauucucgaaccuguagaaagcaucuaggcauguccucuuuaucucaacucuguacaucagccugaagcaacuugucaccagaaaaauggaagaugagaagcagauuaccuuucaaauucaguaaugcaaauuauuagaugcaguccuucccuggaaaaucauauacacguuaggguucucaacaggcugucugacuuaaucacaguguauuuauuuagggauuugguuauaaaacacuucuauagcaacacuguagaauggaccacuguaaggaaaaacacaaaagcuggggccagcaguuuaucaccuggaaauagcauggcuuugauaauuugacucauuaugaacucacagaaauagaucuauucucagaaauacauuuuuaggggcggugggugagggacaacagagaaagaguacauccagggaggacgcugaucucucugcucuuuaucuaagagagauucucauauguuugacuuuuuauagauuuugccauugaguuucaugauugccaagaugcccagaucaauaccuugagggaauaccuuuuggcugaacaacaugacacuggagacuggcacugguuuugaauaaaauaccagugaggaaaauuuuuaaaauacucaauauauaauucaucugagaauaacaagugacaugaacaaaaauuggcuuuuuaagagaugaggcuaagaaccagcuuacagccucucaaaagaccuuaguugaauauucuuuacccaagucacuucugcugucacugucuauccuuuuuaacacacacauacaacuccuuauguuacagugagcucuucagagcuccugaagcugccauccagguauuccuugaacuguugucaucccggaaaauucugaaacuuuccuaguauuuaaguauucauauauccccuuuuaaguauuagucccuauaguagaugcaaaagaauaagauacaacucuuuauuuuguaaggacaaaugaaugacauauguuucaagaauaaauucuuucucucucuccauauauauacauaucucaugaaaauauaucucauaaagauauauauuuaaaaauaaauauauauauuugaauuuaaauuaaugucauuuaauauuaauuucuuagcugcaaaaaccaaauuucaaaaaauacauacauauacauauauauuauauauacauauauacauguauauauauuauauauacauauuauauauguauauuauacguguguguguauguauauauauauauauauauauaaauaaauaaauaaaauuuuacaacuaacauuagccauugaauaguaugaaccuagacucugguucuuuuaucugaugacaugacuagaggagggauggccaaauaagguuuaucuggggucccaacucugauugauuagaacuggcugaaggaaggacucugagaccacaacugagcacagcaagaaugagugcugugaucaauuauugaugucugcaacaggcaagaggggacaugugcucaaugggcacauguggcuaguggccgccauauuaggcaguguaaaauuauggacuauuuacauaaucguggaaauuucuguugcaccacuuagaguccagaguucuagauuucauauugaguucuucaauuggaaugaauacugaauggcuacacugccacacacacacacucucucucucucucucacacacacacacacacacacacacuccacccaauuccuuucagagauaaaauuuugagauuugagaaaagacaaggaagaaaacugcaagugaaccauauauagaaguaguuucucaauuguaaggucacccauuucuuccuagacuuuuuuugaagaagaugacaguuccucauccuaaccuuccaaacuuucuugguugaaucugccaggcaacucacauccaauauccuaagagaucacaagcagucacaaugguagcagacagagcuggcuagaauuggcaagagaggccccaucacugccacccacuucucauuugggccggaaucagauggguuuuguugucuaguagaaggauuaucuaauuuaccucugaguuucucuaugugauucuuggagcccagcauucugaugaacgcauaaaaggaauuuugacuuggguugugcuaauccuccuuacacaucugugcugccuagaggugauucacuucuuuagaaucccuccaauaauauuauuauuuuucuaagcgucuggaagguagugucuuuguuugcuaggguugucugcauuugaaaacaaguuaaucaacaugcauuauauauauauacacauuuauauauauauauacauguguauauauauguguauauauaauauauacauguauauaauauauacacguguauauauuauauauaaagcauauauaaauguauacaauauauuauauauaauguauauauuauauuauauauguauauaauguauauguauuaugcacauguauauguauuacauuauauauacacguauauguauuauauuuuauauguauauaacgugauauaugcgccuaaauagacugugguucuuuuaucugaugagaugacuagaggagggauggccaaauaagguuuaucuggggucccaacucugauugauuggaauuggcugaaggaaggacacugagaccacaacugagcacagcaagaaugagugcugugaucaauuauugaugucugcaacaggcaagaggggaagauguggcuggcuaucugcauaccagauaguccccaucuuaauaaagaaugaagcuuguggaggggacagugggagauagggcugcguagagugguuggauuuguguucaaagcgcccugagaagucuguacugaauuccuuaggcaguggggaguggaagagucuugagcauuauagcaauaugacaacaucugaacuuuuaggaagcaaacuuggccauauguaagauggacugaagugggggaggauaaccaauaaacuaggagcuuaaauaagaaaagguaaggacagugcagaugugggaacauuagaacugccuuggagcaaaugauaaccaugagauucccauuuuggaugauugagaggguguuuuaauuuauaaugaagguaauuaauuuauagagaguuguauucuuuuuaucuguuuucauguagagugcuuauuacaguauagauguuauaaacauguuuauugaguaauauaugauaauaaauuaaugaaugaaugaaagaguaagugaaaguuaggaggaggagcugguuuugaggaaaagaggacaaguuauauuuuauacauucuaaguuucagguguuggcagggcccucuguagagauguccccaguucagacauagcuuuccaguccucuucaaaccuaccauuauaccacugcuggguuguggguucuccccucuaaacgacuacuuccugcauaucacuuuccauauagcugauuuaugauuuucuuuuagaaaaccaugccggugaucuuuaccuauguaaaacaguuacaauuuauugaggaguccauuaugugauaucauuugugauacaauguaucauugaaucuuuauggcucccuaauauuggggacaauauuauaccccuucuacugagguuacuaacucaaguaguagaguugagauucaaauccaaguugccuuccuucuaaauuuuaccccuguuuguuuccccacacugucucucacuacuaagugauacauucuagaaaaugcucaugccaugcuucugaucucauguuaaccaacggugccuaguggaaccucauuacccccggcauuucccauacuccucucccauuuacccauuucucucauccaugauuuucugaccaauuagccagucuguccuacauuauacccaucucucuucuuauugcaugugcauccucuuuuaugcauucacuucuacuccuauuucucacuuuaguacguacauguacgugugcauaaugaucacaugcuuuugaagugguauuaagagaguuugcacaaaaauugugggacagauauggguauaaugugguguguguucacccaaagcuguuggcuuuaaucaggauugcaaagcuauacacacaggacauaacaguuuaucuuggaaaauuagugguugggaacaucucgaugguggacuuguuucaaacuaaacaccucuuccucaaccuucagugcccuucugcagagcuguuagugcaugaguacugugagaugcguccuuguuacaugcuacaaguagccccucagguagaagccaguguuuccaaaugucuacauaacuaggucaaauuacauccagagcuaggcuguguugcucugauguguuuacacuuauuuuccauugaaucuaaguuucuaauguuuuaggucacuaacaaugaauccaacaucugacauuuuaugaguggugggauguuaucaauccuucagcaaguuuugauguuuuuuuuaugacuucuggcaagcuggagucauuaggauuuauuaccagaaaagggaacaaauacuguuguuuuacuguguucgacguauaguagcugaaaguagaguauuuucaagaccuauguuccuuuugaaauaaaaaguuccuaggucuugccuuggucuuuggguuggcugggcaugcaguacacugcacugaacucacuggugugauggaccccguucacgcaccacuccagaccuuccuggcucagugccugggaguuugucuugcuucugggucuggguggccuuggaaauggggcaaaggauacugucauaaagccacagcugcugcuauugccaucacagaccaaagaauucccaugugugaugcucacugacaagaggagucagcuguaccuaugugcuacuuggccagaacuuagagaugcuuggauuucccaguggcuaccuggggguuccagguaacaacuugcaagugcagggggaauuaauacuguauugggugaacuuuugaucaaugagaggcaguggauagggagaauccagcagauaaguugcuugccuuuguucuaagacacagcagauucguacagcuuuucuguguauguccugagagagcaaaggcuuagcuaaguuucucaugagcugugacuagcucugugccuuuucuuuugcuuucacuuuuacuuccuugggacuguacacccuguugccccaccccaaaaagcauauaagcuuuugagucaaguuuuuuuuuaauuuuuuuuuaaucaucuuaggcuaagacacuuuuugucccuucuguuagauuugaacucuuggaggacugaggccaugucauuuucauguuucucuugauugcaucuagauauuuauugaaaccauguuugcugaaugacaaugucuggcuuaccacccaaaggaaguucaacaaaggggagcagaaucccucaauucaggguggcuuugacauucaugucacacccaaccugccacacaaauauugguccagcucgcugugucuuggcaggugauggaagcuuggccuuggaggcaccaaggagcuaagaggacuccaugauaugaacacaaaggucgauucacaugcuggugcuuuagggggcauuaaaaccauuccagagaagcaggaauaaagaauauaggagcaucuuuguggacacugggucugcaggucuagcaguaacagaggagggcauaauggauucaugaggucaaagcugggauggaccuugacuguaaugaaaagaggccaugagggugugaaucagggaaagaggaugaaggcaggggugggaguuguguugaacaauuggcagaugauccaggaggcuucauagguugaagacuuucagcuacucauuaggaaacagcaggcauauuccuucauuuuuccccuuuuucauuuuuuagacuuccccauauucauuuucccucucucucccuuacugcuauuauuuuuucauguuuuugauucugucuuuauucuacauuugaugauucaaaaugugacaucuuuacauuuaaugaauucuuaacccagugguauauguuuugaagagugaaauuaauaaagaggcuuagagagcaaauagaaauacacuucuauaaugaaaauaaucugucacucaugcguuagcugauucuaguugauguguucuuugggagccugaagacaaccgagaaauggguccuacagcugugagcucuccuuccacugccaugauuuccuucacggagucauagcauugcugauuccuaacugggaugugguuggacuuaaaccuugguuuaaauccugacucugauauccaaacauccuaagagucaagugccugguuucuuaguuucugauuuuuuacacagauaauaccuucacaaacacauacgguauauggaaguugaagaaagaaaugaaauaauguuuaaauaugacuuugaacauauucaacaaaacucucggguucaggaauuuuaguauugugguaagaauaugauugcugugaaugacaauaauaguugagcuagcccuucagugaacaaguugagacacuuuuuuuuuuuguaaccugguuaacauaggguuucucaaccucagaacucuugacauuuugggcuggaugaaucauugcuguggagagcuaugcuguguauuguaggauguuuuggcucaucccuaaccccuaccuauuagaugccauuagccuccccuacuccugaugucacauccaaaaaugucuccugacauugccaaaugucccuuccuggguaaaaucuuucccaggugagaaccacugggauacagcauguccacuagagcuauaguuuuccuccuuauauuaacguguugacuaaaacuuaaaaagcaaacauaauagauaccuccaaacagcaaaugggcuaaugcaguugguauacacaacaguacaucugccaauguuuauacauagcacacggcuguacucagcugcagccagugacaaacagaauucggaguuuacuuucaguccacacuaagaggugacuaacauggcgggauaaaaagccaggagaccccccuucccagaagccccccuuugaaucacaacacauaugugaguaaugacugugaauugaauuuaugacucaagugcuguuugucugcauacaucaaauaaaauuugagacuuaaagacacaagcugccauguucguuuccccccucauauucauuugugauaacuacuuagaauucagccccccucuuuuuuaaaaaaaaauagcacucugucauuuccagaaaauguuuuaaauuaguacaaaacuuggcuaaauuuagcuuuuauagaagaaagaauaaaacauaauuaacuguuuaaagaagaaaacagaaaccacaugaaggaaugagacuugcuggcgagaaaucuaacaguagugcuugguagcuaacccaucuccuguguaacagauguucacgaauuuaaauggaaacaggaugggcguccccauagaaggcauuugugauaaaaagcugcuaacuguguaaauguacgaggcugcuacagguguggcaucucaucuaauugcccagggaugggacugcaagaacacucgaaugcacaaagcaaaagaaagucucagcauggcaagaaauaucgacagauagaacgcuuagcaggauccuggccgggagaccccaugggugcagucugcuugcuguaauugccggcuggaguggaaaagaaaagacucuguuuuaaagcucucgaagcauucgucucugguuuuagcagaacauauaacaucuucuguaauuucuauguaaauacuugacaguugaaaagaauucuuuuuuuuucuuccuauccagacuauaauuuauggugguuuagugggaaaagggguuaauuugauuuaaaaacugaaaaugauucucuauuuggcuuuuuaaaaaguauuuauuuaaaaaacucugcacagaacagacagaggggagacaaaggauucuauuguaugacugaccuaggcgugccaugucucuuugcucccuacacagacagaggccuggccugaagcacgcaagauuaugcacacauggguccaaucuuugucaccugucaccuaauaaagccucacugaaucaaagacuagguuaucauuuauucugcuggacugacuuaugcaacauucucuguuuaaugucaucuuuucuuaauacucaauuauuauuauuauuguuauuguuacuguaauauuuaaaaacacagauggaccugggaacaugccauuguaacauuguggccaucagccaaaaaaaaaaaaaaaaaagguacaauaaucuauuguugagcuggaacuccuccagugacucauaggcucuggggauaaugucucugaaaucaugccuauaaguuaaucgaugaaguuuucuuuuauuccucaguauauacauuuuaucuccuuuguaagauacaacuuaauaauaaauuaaauaacuaucaagcauauugcaagauuaccuuauuaacagucacuuuuuaugugaagucgcucuaaauauucaaggaauaguuucuuuccauuggaaaaaauuucugagaaauuggaucagaaaguuuuuugaggcucaaugugggguucugggcucaucuuuuauaccugcuucuaugagguggugcaguuucccaugaaaaaaaaaaaaaccagaaagaaaagauacaauacccuguugccugggugcaggaagaaagagaacauccccgcugacccagugauccuaguuuucuccugccuuuccggagauuuucaacagaaaaugccaggcaagguugagcuuucuuuuucuaaaauuguuuucucuuugacucauggauuuaaugguaacacaaaagguccccuucucuagaagaaauuggaaguuaaauuuaucaucucuucuuuuacauauuuuccccaacaugccaaaucuuaguucauugagggcuucgauaaugcaggcaguccugcauuucagauaugcauagugccgugccauuuagugacauguauggguucugcaguuuacauuuugauuaauaggagcaauuaauaaaucaugaguuacauaauauccacacagugaaaagccucaaaguuaccaugaagugauugagauauuaaaugccuauauguauugaauaugauuuuuuugaaguagucucaugccaguuaucuucccaggagaaguaaaauuguucugcuuaucuucuuucacugagucauccccaucaaaacaacaaguaagugacuccuccucagaacuuaauauuuaacuaaacucuuucaguuacuaauuaagggauaaauuagguuccuauuagaaugaaaaaucggaauggcuuuauucucucuuaaccuuagauacauucucucagucuaauaucuugcucagggucuaaugcagacaaguuuuauuuuauaguucucucauuuucuuucugcucugcaauccuccuccuccuccucuuacaccuccuccuucuccuccuucuucuuccuccucccucucuuccuucuccuccucuuccuccuucuuuuauucuuggaaauuaaugcuuugcuauauguggagaucuuccugaccugccaaaugacacaucgucugaaaaugaugaacacacauuguuuaaaaaugaggcuggaaacuuggcccuucauuaaaaccucuguaacagauaacauucuguuucuucucaguauuuuguugugcuugauauaaucauuuauuacaaucccuauuauguuuuugcuugcacauagaguagcagaaggaauaaccuucugauaguaacuuuucaucagauaggcuccugagaauaaucugaugguaaaaugugaucuugguuuuguuaccuaugugucaaaguguugagaucaagggacuuuauucuuccacuggcaaaacucauaguuacaacauuuuucuagauucggcucaaacagcggcaaauuucuuauuuuaaauguucccuucacaaaacuuuuauagaugaaauguauaaauaaaucagaugacuaguucaugaacauacucugccaguaucugauacuuuguaaaaacaaguaaaugguugcuguaucuaauagaugccuucuacauuagagaaucguaauggaucaaauguuagauuuuccacaaaaaauuauccucuggaacaaaacaguucaagaaauagaaugugauacuuugcuaggcucaacagauacacuuuuuuauucuaacagcugccucugcagacaacagcaucagaugaacaaauauuauuuucauagcagaaauggucaugucugcugggcugccaauugacgaugcagucauuuugccucuguguagcuuuaucuacuacuaaaauagacuuugauucuuccauuggagaagaauauaaugaucaugugugauauguaggaaaguuacacguucauagcagaaaacacguaagagagaguuugcccaggcaaauccggguccaccugccauaucagaaugagagaagaaagaggggcccucuagucucagucuugagcaccuuaaauacacacuagcacuuaggccccagggagguuuggaacauaagcaccaaaaauccccccacugcaacaggggcuaacuagagaggaccuaaaaaaaccuuuccauccagggaguugaaacauaucugugaaaacaauagcuuguagaagcuguuguuuuagggaagauguguuagggaagaucccaaccagcgucuauaagagugguuuggaaaguucuggaacauuucaaaugcugugaucuuuguaucacuuuguuuccagguuuuuuuauuuuuauuuuuucuuccucccagacaagaccuuucagguuagcccaacgauugcgcaacauguaaccaagcaugccucuccccuuccuauuuucuuuuguuuuuaauuuaaagggaaaucaacagccgccacccauuucaugauugcaaugaugaggcuggagcauuucagccucauaacuuuucuggauucuuuuccguguccaaacagauuuuuguaaaaaaaucauguuaguuuuuucugguacacaguaaauuccgaugguuuuuuugcugugcaugccucaugggugguaugaguugagaaaaaaaugccagaaaguggcuacugagaaucuuguggaauggaagcugucaaugggauggggaaacauuaaugcuuuaugaggaaaauuaaugauggcaguuuccacaugagccccagccuagacuucuuggacccuaaguaaagaguuccaugugaucucccaagugguacacagccauucguucuuuaaugucccaguuaaaaguguuuuauguuaaucaucaaaaucuagaauuucucaagcgaaguucuaaacacacagaaaauaauaaauggcacccagcaggaauaauuuuccucaugguuuuuaacaucaguucucugauagcgcaaugcucauguucuuacauguaugagugcaggugaauacacauauauacauauacauucucuaacccagagaugaauuaaaaaggagaauuuucauccuaugugcuuuaugcccuaagucagaguugagggaagaaacaagaucagcuacauugaguuuuauucuaggagcaaaaggcuuguaaacucuucagaagucucuccccuaaccaguuccacuuagccuugaacugugcugcuccccacaugagguaagaagacgcuucaucuagaacuuucagaaguggugcaggaauuuagacacacuuagggaauagcaggcaucuccuccauugaucucagaaaccuuugguuuguguuuuuggcuuuuucaaaaauauauuugcucccuucaaguuggacugaaauaaacucaggucuagguugccuucucaauggcagcaaugagccaguacuauuaaaauaucagcacagagaacuagaaaugucggaucuugucacugccauagaagaauuguggcuaccacuucuaugcagaguauggaauggucuuuccucagguuccuguaugcuaaagguccggacagaauuacucugucccuuucucuagccucagucaucugaccagugugugaacaacaagaauauccucugauaagccuucguccacgauugugacaacccuguguucccucuaauguccaggagucccucuggcucccuuuagccucugugccuccagggugccugugguaggagcagagggagcuagugacucccugcugaugcuaaccguauucuaaaccacuaguauagucucccuccuuuccuccuggaauuucucucuuccugcagcaacuccuggaacuccuccugaauacaauccaccugcuguuuuguaagaauagcucucuguucuuucauguggguucggauuuuugcccaauucaacacauccugagcagggcaucuaacuucacuacacagagagccuggcugugagacacaaagaccuacacaaacaugggaccaaagaaacauacuuugcuuugugggucuuaacauaaucuaccaaucggucuuucaaaauucuugucuucucauguaugacauguuaagacucuuacuaaagaacucacuuaaaugucagcccauauacucuacaaaaaaauguuuuaucucuauucaccuccauucuuuuugaaggugauuuuacuaaagccagauaacugaaauauuaauguauagaaucuaauuucuuaaugguauggaaggcugaaaauaguuuuauuguuugauguugagcuauagaugaugauuucuuuuucuuuuauuuuuuuccuuuuuuuuuuuuuugaagguuggaagauucuuuaaugagagacauaugcagcaaguuaaagcuuguaagcuuacuucaucucaguaaugcagaaaacuccuuaaacuguugauuuucuuuuggagggcacucugaacuaugcaaaauaucaucugauuccucaaggaaaacuaggaaacaaugaagaaaaaguaccuucaaacuuuaugaaugucucggccacccccugcugcauccaucaaauaccagauugaauuagugagauucaaauaccagagauuuuaugguaaugggauauuuagaaaucauuccccgagguuccgccuauguuggagugagccugugugcucacagugauagaauuuggggcuagaucccaguguugguucaauuauuaggcuaggugaucuuccacagcuuauuuuaaauugcaguuuuccaagauuuauaagacugcauuuuuggacuuucucuaaugcacucaagcaaaaaaaaaaaaaucauuugccuguacacugaugacuauaccugguaaggcuauauaaauguguacaaauuuguaccaauacuuuaacuuuauugguucacuugcagguuucauagucacuugaccgucauucaccauuuaccuccagaugccuuucuucccucugcucugagcucagguacaaguguccauuauugcucuaagagcuagucuugacugggcuuaauugauauuuccauuagucugaugaauacaaauggcauuaaauaccaggaucagacacaaagugaauaugagugauccuuugcagccaccugggaagggugaguggggauuuuuaaggcauaguggugaggacaauuagcagggcuaauguacccuuuccaugguugagaugacaccagaugccccucucuugcuggcauucagugcacaaugaagucugcauugaucuagauggcaaaccacauugguuucagagccaggaggcuccacucagcauggcacaacuuuguguuaugagaggaaaagagugaggcagcaagugagcuuagagccuugggucagguugaaggaaaguuucccucuuucuccccggaccagaugcacauaucaacugugaacccugaagucaagucaagcuccuaggacugccucccuguguugggcugagggcagcgaguacgccuuggcagcuuuuaacccgugucccuucugccugcauuggcacgcggucaaucucugagcaguugggggauauggaaagcauaaaggggaaggauccacagggacaaucaaucaugucaucaagaucagcuucugaaggaaacaagcacaaaugcuucagugaaaacaaacuaauuucauucugacuguucuacuguucgggguuuuaugacuguguuuuucacccuguguggaaaaauacaaagaacugcccaggaacugaaaaacagaaaagaaucugucuugaggaacauuucccccuuuaacuucuuugcugucuuuaccagauguacccauccaggcuccaacaugaaccacacaauggaccuuaggcccauuccagcacacaauaacucaacaaaggaugcuuaaaacauuaaaaggaucuuuacuauccucuuggcaaaguacuucacaugaauugccaguuuuccaguuguuacaccaaagaaagauaaggggaucaacggaucaaaauccaucuuacuucauacaaaagacagaaguuguuauagaaagccaauauggcuuggggagggaacauggagucagucccgguguggggucaaugauuuuaccaggugauauuccuucaguuguuuauguugauguuuuuucacccccuaaagagacucagagauaaauaaaauucagucuuugggguugcucuaaagcacucaaguaaaaauuaccugauuauuggcaacuggauuuugcaaaauuguggggagaaaauuuggaacccucgcaaauccuccuacacaaauguugagcuaaauauuuucacuuuaugcucgccugacagagauaguaguggugaaaguuacagagagauuugccgauauagagcauuugcuuauaucacacccuuucucuuuuccccaaaucuuuuccuuuuuaauagcguaggaagaaaaaaaaggaguuuaaggaaauaauuucuugugcuuacuauagcccucaagacuuuuuuuuacuuuuuaaagaugaggucuugcucugucacccaggcuggagugcaguggugugaucacagcucacuguaggcucaaacuccugggcucaagugauccuccugccucagccucucaaguaccugggacuacaaaugcaugccaccaggccuuacuaauuauuuuugucuuuuguaaagguggggucucacuauguuggccaggcuugucucgaacuccuggacucaagcaguccuccagcuggccuccuaaugugcugggauuacaggcaugagccacugugccuguccccaacaauuuucuuauucuuugaguuucucacucguacuaaacaaaacuagagaauuccccugaauuacacaggaaucuggguaaaguuguauagauucagaccaugugauacuucuucagccauucuucugagaauuuggcaaggagacuauaaguuuugauugguuaauauuuguguggguacgaaugccagcacugaaauaugugguuaaauauuguauugcuuugggugguuggccucaugugagugcuuccucuagcacaaaugucauuuggcaaacuugguucucacaguucaaaugaaaucuauggaggaagaggagagccugucgucuccucuuaggacagauggcacaugcugcagugugaauggcagaauuggggaggccuaggucuggguuuuuguggcuagagaauauacuaaccaucagaaucauguuguggccauuaauaggauuaucuuauuuucaguaauuacuaacuauacuauaugagagacagauaguauaauaacuaaugacuaacuauaugaaagacaguuuaauguuaauaccuccacucugaaugaauugcuuguuuaacagauggcuucugacuuauugggaaguuguuagaacaucaaagcacaguuuaugaggccuggcaaauuauguaucugaguuuagccuuuuguuuccaauguuaccuucuaaaugaucuguuucauaacuaagauuaauaugagcacaguuaaauaaguuauuucauggagaacaggcaugccaauauagauauuaucaagauguauaauuugccaaaaauauuuguugaguaucugugaugugccagccauacagugguaaacauuuauugaucacuuacagauaugaacuauaguaugcacacaucuacaguuucagauggacuauaguaucauaguuacauaaaauacagccaaaggcauccuagaauuuuucuuuuucaaaaauaaaacaauucuacaaucucacaaacauauucggguccauuucucugugcuuacaaacaugcucaggcuugcccaaugaguggaacccaccauccuuugaccuuggccuugcagccuaguuucuuugagaguacauuuuccccuaccaacuccuccgccacauaccccacaaaaagcagccucauuuuccaccuccaaauucucacuaucuuccacuccucagccccaggaaccugcuuuuuacucccacugcucuccugaaauugcuuucucaaaugucaaaguaccaccaguugauucaauucuucccucccagacuucucugcaacacccuugaaaaugcccuccuugaaaagcucucuauccuugguauguucuccacacuguggcaacucgagacuuuucuucaccucucugacaguuccuuucaucuucuuuguucuugcucccuaaaguaagauucuuuaaggcuuucuuugcucucuguguacaaccuucuuguagaauuggguauuuccugggcuuugacuauuguaucuaugaaugugaacuaucgaagcucuuucuccagaucuggcuucucuucagacuccagucccaugucuucauuugcuaccuggaagccucaccucaugaugaguuugggaacucaacauaucccaaagcaaacucauugacugcuucucaccaaggaucuucucuuccugguuuuccagguuuggaugcguucuccuguucuccuagaggguucucccucuuaauuaguugcccaauucuguccauucuaccuucacuauaacaagugacugucccacuuuuaguuaguccugccaccuccucucuucagcucuucaugaauucccucucugaacugcucucccucaugccagucucuuuccacucuguuccgugccucacacguuuugcagaugaaccuugccaaagaaaugauaucacugugacauuucugucuucacaaaugccuuauucuauccugacccuccaaauuaauguuuuuaaccuuuucuccugcucuuucucaagcauguagccauggucccacaaauaccaugggcuuggggggagguucagaucacauagcacauuccccucucuguccccuuguauaugccccuagagcuguguggacucuccuccuucacacuucugcacuugccauccuucaaggcccaguucuguugacauagucuccaggaagacuuccucuuuuggugauguuugagaaguuacaauaaggugcuguacuuuuccauagcucggcuugauucaugugcuauauaaaaaaaaagacuguagagggucucauagcaauacagcaacaggugguugaugaaucaauuuaggaaguggcugcugggggcagagcuuuauuuaucaaaggguacagcuuugcaagcugaguguacaagagcuuccugggucagggcugucuggugaccuacagacauggaugggguggcagucauaagugaguuugggcugugacauuuuggcuuucucuagguuuucucauuuaucacaaagggacugguaauuccuaugugacucuacauguaggcaucacaugucgcugagcuccagagaaaaggcaagcucguccaccuucagacucaugcacuugcaucccacuagguccucccuugggucuguaaugagcuacuucuccucaccuuaguuaagcaguuucauucuuuacagaccaccucaaaggccaauucuaccauggucuuucuucaacccauagucauaacacucucucccucuucuggucacacauggcacucuaucugugccucaagugguucaaugacuguucucccuggcuuugcaugugucaucuuaccaaauggauuauaagauguuugagucuggagacuaaauuuuauuuauuauuauaaugcacaauauagcccuguguucauagcuggaauuuaauacauguuaguugaauaaacauugaaggaugaaguuucagauuuuuuuggcuaccauuacucucagcuauguugauguaaugaaacacgugugccauauaaacauguaucuauuuaccaaucugcugcucaaauugaugacuuuuuacaaggcuucuagguggggcagcuuuuagaauaaagaugaacacccacacgcacacucuuacaugagugacugaacaaucucacauuuuauuauuuauagaaauacaugugaauaugcuacaacuuaauuuauuuccugcaagcagaaauccuuaucauuauaaggaagccccugucuuuuguuuuuguccauuuuuuccccugauguguucauaaacaugucccauggauggcaggaaugcacagcuauuucacuggugguauaaauaguuuucacagaagcccugucuaucaugguaaauggcacaaaagacuuuuuuccuccacagaagccuuuauuuuucucccuguauuucccucagagguccgccacagucugaagggacuucacagcugugcugucuacgaacccacuccuaacuuccaaacuuucgccaaaguguuuccucugagguccuuauagaagcgcuucuggacaacgugggauguugcuaacauuuggaaagugacugucaugcugcgaggaaguauuugcaggccucugaguucaguccuccgaggacauuucaccuucuuugcucucguccaagccuuagaccccagcacccagucagcuccccuccuguggguuuuccgggcugcuguuucaucucucuccccauuacccucaucauccccacucccaccccgacauaaauucaaaagaaaucuuuuuuuuuuuuuggggggggguuucacuuuugaaaugaaggcucauauuucagcucuagauuuagaauagguaaauauuuuuuaaaaaaucauuucuucauauaaauuaaaaagccaaacaucaauaagccaaacaucaauagcaacggcaacaccucuccaacaacagcugcagaaauugccaacgugcaccuaaccugaccucacggggccaugccgggggccuuguggaagaggaucaguccaucucugccccaccucaagcaagagugacuugcauuucauuccucuguauucauucucucgggguuuucagccacaaaaguacuuuauaaaaguucuguauaggaacaggcucugagaggagaauuucucagaagagguccaaggugcuuugcuuaaauuacucaagguucaggcucucagggacagggccauggcucacaggcauuugcucuggggcugugagaaugugggaugagaaugaggugguaucauuuguggaugugauggucuacccuucccuaauuuccuaauuugggaaugacugauugacaaggauggggcuaccuggagagcuaggacaguacagagcagaccacuuacagcccaucuccagggugccuaaacaaggggaugugcagaauuucuuucuuuuuuuuccuuuuucuuuugagauggaguuucacucuugucacccaggcuagagugcaguggcgcggucucagcucauugcaaccuccgccucccgggcucaagcaauucuccugcuucagccuccugaguagcugggauuacaggagcccgccacugugcccagcuacuuuuuguguguguguguauuuuaaguagagacaggguuucaccaucuuggccaggcuggucuugaacuccugaccucguaaucugcccaccucggccucccaaagugcugggauuacaggcgugagccacugugcccggccgggaugugcagaauuucuugccuggagauguucauuuauuuccuucccuaccccauccccccaaacagcuacacugccuggagauuuggaagaaagagaugaacagaugugugugauguuuuaguuacauuugaccuaaaagugggggaaaugagcuaaaugacacaccaaaguccuuuucacuaaacaaccaguaucaguagagcaaguuguuuaaauauugccauuagcccacuucugaggcuuacuggagaguuuuacuaauggcaagauucaaaaacaguaaccucugucuuauugaauagacgcuccccagcugcugaacugugaaguuaauuucuggaaagugaauuguguuugucauuuuuaaaaauacaauuuucuguaauaaaagcagagaugcaaccuucagcagagaaacauuccaauguggcuggguugaaugcuuuguuuggcugaggaaugguuaaagugauguuugaggauguaaccuaccaguggaaugaggcaagagaacuuugcuuacuacauuggccuccccuagguguacuuguuaauuaagaguaaaaccacgaagguagcuccaaccccaaucgcuguggaugccacacccgcgccagcgagggcaggcugauagaggcugugcuaagauugccguccugucacagcguggagugggagugggaagggggccuccuacucucaucguuagccaacgcacaacauauguucacuagucauauccuuucugucaagcaaggaacuaggcccugggaguacaaggaugaauaauacacgaggcccuucuucaaggaauuuauagauccuucagguaaaccaugugaugucccuccgaacugacuggcauaaagcggaugauggggcuuugacaucuugugcugagaauaacagaaucacggcugaacugacaucauaggaucauagaauuuuauaacaugaagcagccuuagagaucguucaccaaauugaguuaaaauuaaaugauuguuauaguuccuuauaaacugccaaaugcuaaacaaacaugauuauuauuugguggaagccccucagguuuuggaaggagagagacugauacaaaguuaagucauugcaacaggucuucuagcuacaguguuauagguauagcuacauuguuacacagcuacauuguuuaacauucauaacccgcaucuuauuuuguuguuuaguacacauaaguaauauuuuauuuuucaaauuauauuauaaauaacagaaauuaugagaaagaaacuguauugaggaaauaugggaaaguaauuuuguacugcagaucuagaguauaaugaacaaaaagagccuauaagcaaaaagauucaagcucuuaacaaggaaaugccuuguacauaacugcacauauaggcugggcucaguggcucaugccuguaauaccagcacuuugggaggccgaggcagguggaucacuugaggucaggaguucaagaccagcccggccaacacggcaaaaccccaucucuacuaaauacaaaaauuagcugcgcaugguggcgggugccuguagucucagcuauucaggaggcugagguaggagaaucacuugaaaccagagguggagguugcagugaucugagaucuugccacugcacuccagccugggaaacagcuagacuuugucucagaaaaaaauugcacacauaguuaggugaugacuuaguuacauuucagagaggauaugugguaggcagaguaccuguggauggccccccaagauuucccaccauaagacccacagguguccaucucugugcuaacuuccagcgugguuuaggggaggcacugacacucugcagaaucccagaaaauauaauuaaaguucuguuuauaaauccuuuauugacauuuagugaacgauugcagugcuacugauguagugcucuuuaauagcucauuaugaaguuuguuagaagagacauuagcagcaauuugucaauagccucuggaagucaagugacaagguaugcguguuuuacagugcugccgaguguuagacauauccuugcagguggggaaacuucauccacuuaucugcccaagggauaguucacauggugacucagauguuuugaagccacaccauaauguguucuaaaagucggcgagagguggaaugacagcaaucccaccaaaguggccccugucacucaaacuugagaagcugcauggaauuccuuuugugucauucuaaaaaacuauaauucuuuugaauaggauaauuucuuuuaaaaauauuauggaagcucuuuaguuuaauuagaucccauuugucaauuuuggcuuuuguugccauugcuuuugguguuuuagacaugaaucuuugcccaugccuauguccugaaugggagaaaauuuuugcaaucuauucaucugacaaagggcuaauauccagaaucugugaagaacuuaaacaaauuuacaagaaaaaaacaaacaacaccaucaaaaagugggcaaaggauaugaacagacacuucccaaaagaaauuuaugcagccaacagacauaugaaaaaaugcucaucaucacuggucauuagagaaaugcaaaucaaaaccacaaugagauaccaucucacaccaguuagaauggugaucauuaaaaagucaggaaacaacagaugcuggagaggauguggagaaauaggaaagcuuuuacacuguuggugggaauguaaauuaguuaaaccauuguggaagacaguguggcgauuucucaaggaucuagaacuagaaauaccauuugacccagcaaucccauuacugggcauauacccaaaggauuauaaaucauucuacuauaaagacacaugcacacguauguuucuugcggcauuauucacaacagcaaagacuuggaaccaacccaaauguccaucaauaauagacuggauaaagaaaauguggcacauacacaccauggaauacuaugcagucauaaaaaggaugaguucauguccuuugcagggacauggaugaagcuggaaaucaccauucucagcaaacuaucacaaggacagaaaaccaaacacuacauguucucacucauaagugugaguugaacaaggagaacacauggacauagggagaggaacaucauccaccggggccugucgggggaugggggucuaggggaugaauagcaacccauuaggagaaauaccuaauuuagguaauggguugaugggugcagcaaaccaccauggcacguguauaccuauguaacaaaacugcacauucugcacauguacccuagaacuuaaaauauaauaauaauaaaaaagaaaauauauacauggcuauuaaaauuggaaaaaaaauaguauggaauuggccugucauuauacggggguaccugagguggcaauuuggcaccacuugguacuuuuuauucauacgugauaaugucuggcauggaauggggucaauauauaugcuuugaaggagugaauuuauauuuaaguuugcaauagcuuuaugauucuacagcucucuuauuuaauuauuucauuuaaucaucucuucaacaccucucuagaagguaaaaaauaauguucucauuuuacagaaaaagaaauugauauuugggacguuuaauauaaccaagaugcauaggucugugcagcugcucuuucuucucacuuucaggucauaauuacuguuugcugggaacauacuggguacugguguuaggcaggucuuuuguuucucauuaacuaccuccucacaccaggagguauguaggucuuuuuaucuucagaugaagucucagugagguuauguaauuugagcugaaucacacaggcuaugucugaucaagcuggcaucuaaucgcaaggcuugcuacucaagaggauguggccuuccugccaucacccagcugcccuuccaacugaaguauaaggcuauugcuauuuccauuuuuaaaaaucugacaggcacaaagcacaaaggcacaaagacuuaagggauggcuacaguuaugauaguucagucaagaagucucuguuuuggggacuuuuuuuuuuuuuaaaucuacguuuuacagcauuauuaugcgucuacgugaacuuaauuuaaugcaacaagcguugacaagugccuguuuugugcaaauucugugugauacccaauguccauuuccuauucuuccuuucaaaaaguggccauaaacagaacccugauuuuguugaggauaacagugugcuuagguaagagaugucauuucccaucauuucauguagcuuggcacagucgugugaauaacuucugcaugcaacccccagggaagcuuucuaaagggccuuuuccuucccuuuccuucugacuggaauguggacaugauguccagagcucaggcagccauccugggccacaaaacaucauugugaauggaugccaaguguuggggaugauggagaagaaagauauaaggagucuagguuuuugaugacauaguggagcugcccagucagccuugggcuacuuacaacuggaauuaccauaagaaagaaauaaacuuuuauuuuguuuaaaugacuacuuucuucugaucucuaaaugcaacuucuaacuuauggaguuacaggaaagcuggaaaagauauauuuauuagucuuuaggaaagacaaauccacaacucacuacaguauggucugaaugugacuugauccaaugaucuaaugaaaacauaaacucaguggggagcauuccagagagagaagaaauuaauucugcuaagaagaagguaucaagaaaagcuuguuguaccuuggauggaggaagauaagaaguggaacagaaaacucaguaagcaaaagaaagccuggacuccaagaaguugagcuuaagugauggcaaguugguugcaaaaaaauggcuuugauauuuccaaaaugauuuucuuuaaguuuucagcaaagcauugacuagucauagacuuuuagaccuuguucuguggacccagaucuaaaccaaacugcaaguuugugucacuugagauauuaucuaccagcacauuuaagucucuuucuuuaaacauaucacuucaguggugauaucuuaagcuacagaaagagucaucuuccuuuacacauuuggcuauaauugaguagagaugacuuuuauaagauucaguccuacagucauaggccuggguuaaaaagcugucuuugacugaagugggaggagaaaggagaaaaggagaggggaaauaguuauuugggaucccuucugggauaucccuucugacuccuuguggcaggagugauugucugauuguuucauugcaggggucaggcuggagcagagccucaaaggcaggaggguaaagaauuagggcuccaaccccaggggcuaacgaugcuagggaacuucaggagcuuaugacauaucccugacuucucccucugguguucaacaaauauccauguaauccuaaccuuuccuuggccucucuuacaguuagggcaggaccaacuaauuagauugugguuaaugggauguaagugggaauaagcuaaccucuuccagguugagaacuuaaagguguccuauauuauaaucccacccacccucucuccccucacuguagugacauuauaucuugaauuacagaugccauagcuacaaggugggagcagccugggacccugaaucacugcguggaagagauucucgcagaggagaaguuuucaaagcaucugucuuugugugagcaggaaauaagcguuggugguaugaagacauugaaacaugggaauauuugugauggcagcuggcauuaauuacucugauuuugacauuacuucuuggcaaggaaaauaagugagagguggugcaccuuugaugagaagcaugggauucggaguuggaaaauacagccuucagcuugauuccugggugaguuugggcaaguuucuuaacuucuucagccccagauuuuuaucuauaaaaaugagaauaauggcugugccuccuuccuagggcaguuuuuuauuuuucaaaguaugguugcacagaaaaccugcaucagaaauacccacaggacuauuacacugcaaaucacugugugcccaucuggaagcuaccgaauccagaucuuugugggugggaggaagucuauuuuuuuuuuuuaaaguuauccaggggacucuuacacuuacuaaaguuggaggaugauuguucuaagcaguugugaggauugcaugagacaauacgaacaaagacuuuaggacuauaucuggcccaugguaagugcuccauauauggaagcaauuauuuuuaucauuagagcacacugugguguagaauaacuuggucagaaaagcuaggcaaguccaugaaggggaaaaagggagauggcauuacucuuucucaggauuauaacucugaacucaaagggagccaagagggcaggcacacugaauguaacccgauuugacuuaaacggaagacugaggcaaaucauugauguguugaguauucagcaacagaauaacaaccugaaaacagaugaaggagaagguugcuguccuaacagcaaaaucccuuaagacucccaggcuuuccgaaggugaauuuuuaagcauugauggaaaugcguuaaugagcauauaaaauugugguugaauggugaccaccaugccugaagcucuguugaaaaauuauugacagcuauauugcuuauuccuguagugguuaggaaaugaaaugccuuucucuaaucaaguaauugcauuaaggagcuacugggaacauuugguugcuuuuccggaauaggcaagaagucaacugcacuucaaccagguuaacugucaagaggaguuuggcucaaauuucuuuuaguucaacuaacaucuuuuuuuuccucaugcauaugcaagcaaaaguauaaaaauaaauucagcuaauagccaaaacaaaacagcacauuuguaguaaauccugccuguuucugaaauaaaauucagcaaaagauguguuuuuguuuuuucuguuuaagggagagaugguggagauguggguuuuggcacaaaccuuaaacccuaaaaugagcugcaacacagguggagugagauggauuuccagugacuaaggcagacagcgucaugcccagcuuuaacugugugaagauucauugugaauuuugccauagcccaagcagaaagaagauacauuuucugguuacaauaguuuugguuggcagaauuuaccugaaaauucacucaaaaaagucucucauuugaaagaugaacugguagagaauugugaacauacagaacaaggauauaaguagacagaacacagucauuuuuuuguugaaguuguuacugugaaauuucaagcuccuugggucuucgaaaggccacuuuuaugucugcagcuccauagagauacaaccacugaaauaaaaaacacagugacugggccauuuuguuuacacagugccacauucuuggccagucuuguuugucaccaaauggccugaugaaugcuguuuugaugucacgcccuagauaccacuuuguguuuuugugcucuugggcaugaaugggugacuagcucacucaugggcuguggcucuaaggccccugguuacugagcaaaguugaucugaauugcuagaacauuugagcccauuugccccauccugcucguucuccuccucuuccucuuuuucucucccauauauacagugauaugcagggcauaccacuacaucauagaucucaguccucaaagcuuacaaaauuacuuccauuugugagguaaacuaacucuuguuccucagucuugaauuuacccaccaggcuugcugcaaagaaugagcuuaaaaauaaccugaugauuuccacguggcagggccacggguuacagagcacagccugugccccuaggacaggcacccacauuguucuuuuuggaaggaguggaucugaugccagggaaaggugacacaagaaagaagcuggccacgaagccucugagcuuugugaccugaugcucaccugacgcauggccaggcugucuccucucugccaaauagggagagaaacucugacuuggccgacaucguggguguguuagguaauauuugccaacugcuuugaagaugaaaagcguuauggggcacuaaaugugauaauuaucaauuauaaaaccucacuacucccuggaacacuaggggcgaaugagcaggaaauauaaauguuugugacaggaagccaggagccaggauggcucgugaaaugugaaaaguucaacacacagugcccuuaccuggggcaagccaggaacucauuugucuuuggaagguaaaugcuuccuugagcuaacgagguggcccccugagagacuaccuuauuaaguacuccuggaauucugggcaaggggugccuguguaccucuccagugccaccugggugccaugaaaaaaaugucccacuuggaguuuggccugggcuuuucccucauccuuucucuauuauccgaggauaacagggugauagacugaagaccucugggccguucagauauucguacauucuagacacacaucaugaugauauucacacaucauaaucauugagcuuuugcaaggaucccggaaugaggcacacaccuccucuggccauuugauuguguuuauaaacugaaguguucuugucuuggaaaucuuuagccuuuucagggucaucuggaaucccgaggcugaugucauguccggcuaucggcacauguaguguaggcaguuuacucuauggcuucaucugagggguauggggcaggaugucugucccaguagccaacccuuuugcccgucaggccaccaaugggaauuucucuugccagugguuuguuuguacaagucucccaacaaaugcauccuuguaaaggauggcgguaaaauaauaacuccuucuaguucaucuuuuuugaaagacagacaaauuugggggcacucagaagaauuacaauuauuuaccuccugugagauaaagggcugucuaacaggcugauguguggccaggacaaaacagagcagaaacagugcccauuacugagcaaguagacaacacgggacuccaagucuagacacugccagcgcccagcugugugcuuauggcgaaccccuuccccuccccuacagaggcucagugaacauucguaaaaugaaaccagcccagcuaggcaaaugauuuuaaguccuuccuugcucuaaagacucaaacaaauuuacaagaaaaaaacaaacaaccccaucaaaaagugggcaaaggauaugaacagacacuucucaaaagaagacauuuaugcagccaaaagacacaugaaaaaaugcucaucaucacuggccaucagagaaaugcaaaucaaaaccacagugagauaccaucucacaccaguuagaauggcgaucauucaaaagucaggaaacaacagaugcuggagaggauguggagaaauaggaacacuuuuacacuguuggugggacuguaaacuaguucaaccauuguugaagucaguguggugauuccucagggaucuagaacuagaaauaccauuugacccagccaucccuuuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaggaugaguucauguccuuuguagggacauggaugaaacuggaaaucaucauucucaguaaacuaucgcaaagacaaaaaaccaaacaccgcauguucucacucauagaugggaauugaacaaugagaacacauggacacaggaaggggaacaucacacucuggggacuguugugggguggggggaguggggagggauagcauuaggagauauaccuaaugcuaaaugacgaguuaaugggugcagcacaccagccuggcacauguauacauauguaacuaaccugcacauugugcacauguacccuaaaacuuaaaguauaauaauaaaaaaagacauauccaaaaaaaaaaagacucaauguuuuuugagcuacaggucuccagugguauuguuaggggaacaaagaagugcacugugacuuuccugggagaagcuaccagcugcgugacccugggcaagguacgcaagcucucugucccucaguuccuucaccucaaaauggggauaacaauguaucuaccucauaggauucugaggauuacacaagcuaauacuaaggcauggagaacagugccuagcacaucauaaaugcaguguggauguuggugaauaaauagaaagaaaauaaacuacagauuccuuuggcaguuagagagagacacagaguuaaggcccugaagugcauuaaaaauaagaccagaagagagaagauaagaagaccugaacguacuaaagaagcaaauauuuagaaaaaguuaaggagcuggaagcaucucauccggguugggaugagugguggugggugguucauuucuuuaggaaccugaguaccugagggagaaagcucagcugggaacuggaguuagaaggaaaaaguaucaagagcacugagugccuccagcugguccuaaagcugauaagccuagucuucuggggagaggcugaucccugcugggaacccaucaguacugaggaagaacagugaggacuagagaaggagcaauugugcagggugggcaaccuaguaacagggucaagggggcuaccuggaugaggaggggagcaccagggguguaggacugggcuggcaggugagguuauguucagagggcuccagugggaaaucuggcauguggaggucggcuugcacagggggucagcgagcagagacacagaagagcagaacucaguaacacaggcagggguccagcaccagaucggggcaucggucacaagagagaagcuuggggcaaaaucugggaauuuccaggaacacagcuguucugugugugguagagacucaaccauguguucaccaaauccauuuccuguucuuccuggguccaugacuacagaaauguccugggcucccugcugccccggcucccgauagguggaagcuggcuugugacugagucugaccaguggacuaugaacagaaguggggagcaucccaggcuuggucccaaaggcuccccugcaagauccuccacucuuacccuuuccugcugacugggugcagaccaacaugacacguuugggagauggaagagccauggauggaagaagcuugggucacugaaucugauuuggaacaccuauuuuggaacauacugcaauaacuacuuagauuucuggauuuuguuguuacaucugucaguguuauaaauguaaaccaguaagcugaggcuuucauggauagaaucaaucaaagguuaaggucaaagacauucugagacuugcccagccuuaagaugaagcaauagagggcccuuuggugcuugguggcugcaaccguggcugaguucuaggaggcaguuuauuuuuuguugcuuguguauaauuuuuaccccaagaaucccuuauggugcuggcugugaccgaugaacaaacucuuaguguuuaaugugugugucuguaaacacagggagaagggaaagcugccugaagauuggacaaagagccuuguaaaugucuuggggugaaugacaaugggaagauuaggaggagucugcuggggagcugccugcaaagguccccucuuauucaggaauuguaucaucagcugaguccuuuggaauuagcagacaguugugaagauaaaauagucuuguagcauaagaagccguagguagucugggagcuauaaaagcuccucauuagugacaagauuuuaacaaaaccaaauaaacuuuaagaaacaaggacauucauggcugggcgugguggcucacgccuguaaucccagcacuuugggaggcugagauggauggaucaugaggucaggaaaucgagaccauccuggccaacauggugaaaccccgucucuacuaaaacacaaaaaauuagccggacgugguggcauaugccuguagucccagcuacucaggaggcugaagcaggggaggcggauguuacagugagcugagauugcgccacugcacuccagccuggugacagagcaagacucuaucucaaaauaauaauaauaauaaugauaauaauaauaauaauaacaauaacagaaacaaggacauucauacguuuucuaaauauuuugacucacuacaugagagagugacaaauugugauaucugaagaaaagucuggguaaaauuuccacaacagacuuugcaauuuagugauucugaucaucugaacuucaguuccuuguagcuugugaagagccuaucacuuucuuuaacaauguauuagcaggacagaggaaagugacuuuaaggcaagcaguagcagcucguauauuuuacuaauaacgacaccuggccguaagucaggcgguuacagucccuaggugagcaacaauuuuagucaugacacacagacaauauucuuugccaaauaaauuuuccauaagaagagggaggaccaggcauauuugguguugaaggauugauuccuauuuuucaguaaauuaugucucugaauuagugugcuucugucaguaugcauucugguacauucaacaguucuuauuguuuuuaguggaauuuuuuuuucuuuuuccuuuugugagacagagucucacucugucaccgaggcuggagugcaguggcauaaucacaacucacuguagccucaaucuccugggcucaagugauccucccauuucagccuccugaguagcugggacuacaggugcaugccaccuugccugauuaauuuuugaaaaaaaauuuuuuguagagacuugcuauguugcccaggcugguuucaaacuccugggcuuaagugauccuccugccuuggccucccaaaguguugagauuauaagcaugugccacugugcccagcuguaaguuguauuuaaauucuuuuuuuuccauuuauagauuguuuugauguuugagaaguucauugcacuguuugcucccacuaaauauuuuuaaacauuuaggaagaagaggcuguguuucgccugaggcaaaggacugagaacuccacaacuaagaguuuguuuagaacucaaaacaggauguucuguuugaccaaaagaaaguuucuuucucugcuuuucauucuccuguuaacucuucccuuuugcuagcauauaaaagauaauaucaccaaacagccaguaaaggaacgacuuauaaaaauuuguaguaaucuggcaagauuuuucccuucuauuuuguuaaaucuuaagauugcucaaccauugaugugauuguuguuuguguguuuuuucuuuaccacgccacccuggcauuuugaggcugugcuugggugaaaaaguuaagccaaaagaucucggcuauacaguccaaauccagauuuaugcaccacgcaaguuuccacucccucguucacagacauacgcauucgcguugcaaucauuuugcaaagggugauucagagauggggaacauggcguuucuucugagaagcaaaugaguagguugacccacagugcucacuuuccugccucaccguugucacuguccugacaaccuuggugaguuuggcuaugggaauaaaaucugaauauguauucuugaacuuugccaccacaucacaggccugcccuauuaucaucuaagagagcccccagcaaacggagggaaggaggaaacacccuugcccaacaucagcacuuuguucucaaugaguuuuaaaagcuccgaaggcgguucuaaggagcagucaaggcugagaacucuguuaacagagcacagguuagacugcaguccuccugggacagggcugggacucugguguuuguaucuuuaagcgcucagcccagcaggcagcacagaagaaacgcccacgaagaaccuagggugcgaaggagcacacucuuugguuuccaaagaccaguccuggcuucccugaacccugaaccacugcucuguguuuauggccaacugggacgaaggugcuggguccacguggaagaugacacuccuccccccggcacaucugcagagaggcuguccaggacaguaguggccuuuuaaagcuccugcagagaggaguccuuguaagaccagguugcugcuacgugaggaugaaaaagcccagaacugagagucgucucucguccuaguuuggccacugacugagcagcucaguauuggucacugaaccucaauguuuucaaauaugaugugagcugguugcacucagagguucaacauccauccuucuauuugcccagcaaccaugggagaaggagaagaaaagaccugaaauaagggaacuuugacagccaaggguggccuuugauucucccucccuugaucuguaaguuguucaagcuauaguccacccccaagaaguaucacaacugggcagguccggaggcgagacaagauguggauuuugacggugaaucaauggggcauuauucagcacagcugucucuaccccgacgcugaaacagggagauccagagcacaguuaaugugagagcagauuccuccagaagggaggcuuucgagagacccacugggccugacugucagguacaaggaacccugagccuggcacaagcaagcagcacaccugaucucuguauauucuaagagccugcaugccucaauuucaaauagauaaaguuuaucauguagauggaagauugggauggcauucauucauucauucauucauuccagguuuuaccccuguacucacagaacugaugagggagaggaaguaucagccacugcgauaagggucuagcccaguugggggauacgugcugaccacuggaggaacagagaacaaccaacaaacucaaccaagugaccuggaacaagugaugccaacagcagcaccauggaagcugaacucaagaaguucagaugggacgggcacgguggcucacgccuguaauuccagcacuaugggaggccgaggugagcagauuacuaggucaggagaucgagaccauccuggcuaacauggugaaaccccaucucuacuaaaaauacaaaaaauuagccaggcaugguggcacacgccuguagucccagcuacucgggaggcugaggcaggagaaccgcuugaacccgggaggcagagguugcagugagccgagauugcaccacugcacuccagccugagcgacagagcgagacuccaucucaaaaaaaaaaaaaaaagaaaagaaaagaaguucagaugacaaaggaagguugugugcuuuuuggcaugaaaggacauuuugguacuaaucuagaauuacagacacgcccuaugccuucauguugaagaaguacaaaguugagggaggcagaggugaggaaucagccuuguagguggugaugucucagagaggagcaaagaguaaggaaaaguaguaugaugguuucugauccagugucugccacaaaccagcuuugugaccaggugaauuauguccucugggccucagcuuccucaccugcgcauugaaugcaaaauaccuaugaucucuucugacuugcccugagggcaugauggcuggcuagacaagcaccaacacccacaaugcucucagcacacacguacacacaggcucacacucacacgcaugcacacuuaugcuugcaccuaugugcuuguacacaugcauguacucauucacacacgcacccuaccacacacaagcacacucacauacgugcacacaccaauguaggcagggaugugaauacacacacaugcucacacacagccuuccaugcacaugcuacauccacacauacaugcucaugcacacgcacauacacuccuuuccaugcacuuucacacaagugcacagucccccacaacaugcacacucucacauaugcacacauacucauaugcucccgcacgugcacacacacagccucacacacaugccaacacacugccaugcacauccacacaucuacacacacagaucugagugcccuauaauccacacuuuauuuccaaauuuucagaaagcaguaacagaccagucaggaaaggaaaauaaaaaucaucuggagcguuuuuaugcaauccugaugaucucgcagccucggguuuagucucuuuuuccacugcguagggccagauacuuccguuuuuacauagguaccucuuuuagggagacaaagcauuaagagcaaugagccaagagaagaauuugaaacaaaagaaaaaaacacgaaaaagaaaaaaagagaaaaaaagcuuuucccauucauggcaaaaaaauaaaaaggauguuuggaguguucaugcaggauauuuguauaaagaacugcauguccuuguuuacuuucuguggagccccauuuccucccuagaauuccugguggucauacucaccaguuaugggacucucgagaugaaaaucugugacacagagcacacacacacacacccaggcaggggaguccugugaagcuggaugcucugaaaucuagggcauuuccgaaucaaguaucuaccuccuugugccuugccauucucugaccuggccccagagcugcaaagagaagcugaggaggacauugcuaagggucacaccuggugacaccuguguggccugugguuaacaguuugggaaaguaagcauccucacugcugcaugccaggacagggauggcuaugugccagccacaucccagggcggucucgauggagcaguccccuccugugggucucugauguccccaggagaaaggcacauuggugaggucucacauucaguuacauagugcucuugcauuucuuaccccacuucaucugcacacuucuauacauuagauagagcccuguuuuacagaucagaaaacugaggcugagagugguuaauuugcccaagaucacaaggcaagaaaguaguggagcuuaaauuuggauuuucauuaucuaaguccaaacguuguucuuuaccuugcaucaugaauaauaauuaaaauaauaauaaaugauaagcaaacauuuuucaaggguuuacuaagugccucacgccacuuuaagugcauucuauggaucaauuuauuuaaccuuacaaugcuaugagguggauacuuuuauuauccccaguuagcagauguggaaaucaagcuccaaaugguuaagccacuugccuaaagccacauggccaaugaagggagaagaagaugcuuugguuuacugcccugcuguccagaggaaggcgugagguagcccccaacccacacccccucauugacugcuuucaauguacaacaccauaaguaucucacucugucauggacauucagagaaggcuucaccccaccaaucaaugacaacuuacuuuuuccccaaggaucagauaauugaucugauuaugcguuugcugcaaauggaaauuaacaucauuugcccuucuauuuauuuuugcuuuucccacugaaaaugcuauuaugguuauauacgccauaaaagaauuguaguaauguuguaucuacauuaauuuccacccaagaguuuucgauuuucacuuuuuauggugauggaggcuacaaacgagagaacugcaguggcuguaaaucguucucuucaugaaaaugugccagaugaggugaaggaaggagagcgcagggguccuaagaguaagggcauauuuaaaaaauaaaaagguuauucaugcaauuauccaauuucuucaguaaguggaaaaaaaucuuagggauguaaugaaaacacauucacaaacguguuuuuaagaauaguauuuucccaggccgggcgcggcggccaaggcgaguggaucaugaagucaggagaucgagaccagccuggccaacauagugaaacccuaucucuacuaaaaauacaaaaaauuagccaggcaugguggcaggcgccuguaaucacagcuacuugggaggcugagggaggagaaucgcuugaaacugggagguggagguugcagugagccaaaaucgcaucauugcacuccagcccaggcgacagugugagacucggucucaaaaaaaaaaaaaaaaaaaaaaaaaaaaaaaaagaagaauagcguuuucccauugagcuuucgucuggacugauggaaucauggauggaccccucaccaggccaccgagacucaacugugccacgucagugucacgggggaggcugaacuucgccauccagcccugaacacaggaucucaguguugucucaaaucagcccuuuugcaggcaugcacagggugucuaagagucugguguuaaguugaaaaggucuaauguaguguuuuaaagagaaaaggauucuccagccccauaguggugagaagugacacagagucacauuacauaaaaugacgaggccugaggugauugugacagugagggugacucauuaaucccaacacugggauccucugagcucucccuagcagggucucaaauguuugagugaaagacugcagcuagaagacugacaaaaccacacugaacucacuagggcaacugccuuuauuuccaaggcagcuuccaucgaagggaguggcaauucauauaaucaccaauugcugaaagacaucuuuuccacgucagauugaaaccaguuuugcagccuccuuaauguaggugcuguggcugaggcaacuagagaaacaguggacgccucccuggccccacuucccagugccuuaaagucugagaaaaacacugauugacauuuccaggcugcuguauuucccucaccagccccaaacgcccgauccagcuuccugcaacuguggcaagggcgugaauguccccaggaggcagguugcagaguuguuuagauccaggacugcaucccaguuuguccaucugugugucuaugucugagugggcgaguugcuucucagcucuccgcaggacucugguguugcuuguugcuuuggccuggggcugauuccuccaaagcaaugugucucuucgcagagucucuuagagcugcaaggcaguaugggaucaucagagaggaugcuaggaagcuucagaaauggagguccugguagaaaggguccuuuggcguggccucugaagaguccaaaugugggacaagacccuccgaaagcgguggccuggggagccacagguggggcagccagcacggaagaggguggcuuugcuaccauugggaaaacuuauccuccacauccucaugaggcaaacaccuuuccuaccuuaccgcuccucaguggccucccuguugccuucuuauucaagacuaagacccucuagaauguucuuuauccugaguccagcugauugucuauacuaauaucaguacgggguguagaugaggacaaccagugugccuggcugccaggcacccccuccccaaaccccaggaguuucuggaacauuccaacucugcuugaggguauccaugcagcaucuacuacugugagcagguggucugaucuguggaaaacuucuaugauucaccugaggguaacugcccuuugugauuugaaagaaugaugcuaacagaaaguguugucauuucugaacuuuucugaacucugcagcgagugccaaauucauguauuuuaggagaccuacgugguucuacauguagcuaaaacaauucaguaaccccgccggcaauucugcaauaguucuuggagugaugaaaucaagaaggaagaguucugccuccccauuuagaaacuguugagcagaaagguauaagucaggcuuuuccuauuacaggucuccuucagugugaagaggaaguucaguuuucauuuaucucuugcgcccuuugaaguacaggccucugucugcuuaauggcccaaaccggggcgacuacgaugaauuccuuuuacaucaaacacaacccugucugaaaaggcaguaauauuucucaacauguaaaccugccacgacuuugguguuugcaagcugaagaugguuacccagugugguugcuaauggagcaaaaaugcgcauagagcagggagcagguggaggugacuggggacccucugacagguugucuagccacaaacccaucucuucuaauccauucuacucacagggcaggcugucuccugcaggggccaacagagaaaaaaaaaacacagaaaauggggaugggagaaagagaggacaagaaaggaagaaaagaugaaacguggagaaauagcaaaaggaaaugaaaagaacuuuauugcucaguuucuucugccugacccaauuaucagauuuugcauuuaaguuuaagacaguagaucaaacagcgagaggcacuuuguacuucugccaggagaccauaugauaucucucagugacucuccugcaugccaggaacacggacccaugccucuuagcugggucugcauauggugcaaugcauaaaaaaaaaacagcaaaauucauaaaugacugcacucgugggugauguccaggauuuacagcgcuuuaucaguuaaagcaaaaaaaaaacaaaggccaggcagaaucuaauuauaacuuuccacaaauaagucaaaaguggaaugagaacugaaagaaagacaaaagacuggugucacgcuuacuuugcaaaauugaucaucuugaggauuguuuuaugugggauacagaacauuuuacaagguauggaucauaucuguucuggggauuuugacauuucuugcagugaccaugugcagccuccauagaugugaagggcuggauggcagacguucaugucuuccuucuccaagcuauggcuugccuccagagauaauuacuuuaugaacacacuuguuaugcauugagauaauuuaugugggcuacgguauuuaacacuuuuucaugccuucagauaagacuuugugcagcuaaaugaaauagaugcuuuagaaaggucucuuuucacuucccagaaucauggcaacaucaggaaaaggaaccuuucacuucaaggcuggggguaugucaggagacgugguggagagauauucuacucaucacagcaguuaguuuuggaagcaccacagaugacuccaacaccauuaaggguggcgaaaucagguuggcaauagcagcacuuacuuuuccaaauuaaaucaguucauaugcuuugcagauuguucaaauucagcccuuuuccugggagaagacagauguggcagaagaacaggggcacugcuguuuuauucugauccuggauggcugggguuuuaagauuggccuuugcccucaaaagucaccuucagccuucagaaaaauccuucaguguuuuuucagcccuccacuucccuucacccuuuacauuuuaccucacugggcuccuacguuggucagaggucguguuccacuuuggugcacucuuaaugugugcauauuauucuuuacaucugcaaacucauuuaauccccacacuaaccuugugaggcaggcaccaugguuguguucuuguauggacuaugauggacccacugcacacugaugaaaaccauggccuuauguagcaagagguuaacaguuggucaaucugggugaagaguauacagccauucuuuguauuacucucgcaacuuuccuguacguucaaauuauuucaaaauuaaaagaaaaaaaaaggucuccagagcuagauaaguuuggauugcaguaauggcucaacuacuuacuagcuguuuguaaacuaaggguuuuauaucuaucgcccauuugauccucauaaacuuauaagguuauguugguauauaguuuauguagguauuauacauuuauuucagcuguguccaugaggaaacugaggcucagggaggucgaagaauguguccaaaaugccugggauuauguauacuaugcugugcuuaucuacaguuugaauugacuuauuaguauuaggcuccuagagcuaugaagaaauacaguguuagaucaguucuuuuuuaucaaagaagauuuuaugaggacacacaguagcugccaaugaagacucugaucuuaaaagauauagcauguaacuuaaaauuucuuaacuucccuuaauugauuucuaaauaauagauugauaaggagaauccugggaaaggccaaacauugagaauuuuguuaauauuaauucuuccuuauaaucacucuaaagaaugauaauucuuuugcuuuaucuuaagaagguacuuuacuaucuggaucauuuuuaucaccuuccagauacauuuaaaauuuuuaucagccauccauccauccauccauccauccauccauccauccauccaaccaccaucuaucuuauccacccacccuuccaucauuuauuauguauggcguacauacuaugaacaaagucuuugucaaagaaggaaaggugcauaucuagccuucacugaagugaaggagggaauacaggccuaacuacaccagaagguagggcacagguucccaugugagggcaagagauagggagguaaacuccggcagcucagaggggacagaaaggcuucuuuggagcccaugaauugcaacaaucaaaccucaagcaccacauauuuuacagaacaagcauaacaacauguugugugguucaccagugccuaauaaaggauuucuguggccuacccugaugaagcaguggauugcacugaugucuucacugaggaaugaucucaggcaugauuuuaaugacccuuugcaggguuauaacugaucucuuagagaccauaauuuuaaaaauauaguuuagaacacuuucuccugaacacauuaacaggccaacuuucaaguuuacauggcauuuuuauauccacuacccaaaucuuucuguaguucauuccauuuauauggcaccuggauaagcucauuuuuaccagaaaaacuggaaauuucacugccuguccugcucugacuuucagaugacuccuaaaauauugaacuaaggagcccaacauugaccacugggggccuugaauucauacuuuucaucuagggaaauguccauuugguuucugccuucauaucaauauucuauggcaaaacauuuuccaauucuaugguaauuaaauaaauagaaguuuuacuagguuccaugacaaauaaccucuggaaguaaaaauuauuuauaucucuggccucauguguccacuugcucauuaucuacucaaagaaauguacaauauacauugcccuauacagcaaacaaaugaaaauaaccaaaagcaaacuccuguuccuaaaaaguauggauaaaugcaauuuuugcuuugugcuuugucaaaugaaucauauguuaccaucacuaaagacauuugcuauuugauagaauucuguugugaaucuuaucauaaaauaaaacauuucucuugauugaucuucuguauaagcaagguguugaaauguuagguuuagagagacaagacuuucuacuuaaaugaccaagugguuugggacuuugcauugauuaacucuacaaagaaugagauugguggugugcagccuuccauacagcaggcaucauuuggcaggcaucuucuuuuauaauaaucccauuguccaguugcaugcaacuggacccacggguuggagagagccugaugcucccuuugacuuuucucccucaacaucuugcucugggugagaucauuaaucuauuauuuuuacauuagugacucccaaauucaugucuccagcccagaacuauuuccuuggaauucuagacugacauuucuggagaaccuugagagcucuuguuguguacuucauggaauccucaaaaccaauauaucccaaacuaaucacuugaauggauuccccagcucacuagagauaggcaguaaggcucuuucucccuccaucugucucuuagagacuaucucauaguuuucaguccugcaugcuuauauggacaaagggaggaggcagauguaggaaucuuuuauucaggccccucacaucucuaaaagauagucccacuuuggugccugugauguuauauuguagugguugguguauuugauugucucccuugcuacauaguuaucaugccaaggacaaauuuuugucugugaauggagaagaacgagggaagcucaaaucccugcaacguacuggcuuccugaccuggauuggacaagucacauaaucuuuccaggacuaauccagugucaucaugugugggaaauuuuuguaugugaauuuuaugauacuauacauauauaagugauuuuuaagaggccauuuauuuucucuuacaguuuuccaaacuuugcauguauugauauaauaaauguuuuaucacugauccaauccauucuucaugcauucaucauuacaauccuccuauaaaucugcuuguaaaucccaaguacuaguuuaauuuaccaagagaacaacacaaaccucccuccaugucauagaaaacucaguuuggagacacuuuauauuaaaccuuauucccaaaugucaucaccacccagggcaaauggcucaucugacacuguuagcuucuaaggaacauuuuaauccuuucuacuauugccagcauagcacaugaaugacaccaaauccacuacaagucuccagggagaaaugcaucgcugauaugauggcuuuaucuacauuuacacauugaggggaaaauugagcuuguuuucauacuuccacaagugcacucuucuagcccacuuugccuuuauuaucucaauauuucugaugaaucggaauuuuggccuggauuauccaaagaauuguuucagaucucuuugccuccacacguagauggagcuuuaggcuaugcuccucccaccccuucauaaauucauggcuuuucaaaaauuuucuucucuguuuucguaaaagccaagugcaaagagagaaacuaacugauuguacuucuucuugauaugccugauaguuuucugucaucuuaaucaucacacgagcaagacuacucaacacccaggccuucugagauccgaacaauaaguaaccaccagucaccuccacacaggcuggccaggggugcucauggggcagaguccauauuagcugaagacuugccuguccucugccagggaacucuacggaaacgagggcaagcuuugcaugaaaccccauuugcaaaccgaaaccgugaaaaaaaaaaaaaggugguucagugugguuuuuacucaaaaccaggugaagcuuugugguucagccaaguuuugacuugaagccggagagagcucacuguguuuggcuggaccuuguuuuacauuucauguuccauuugguucuguuucccaaaccugaaacugaggguucagaugaggggcacaaaaugaauaaaaugaaguugacaugaaaugugguguagaugaagacagcaccagcuuugugaugccaacuccugcuccugcucucugccggcacuccuucuagaaacggccuuccccacacuaaguaguucccugggacuuuucuuuaaggaacagaaugauuaacacuauacaaaaauagcaaaggcuauuuugcucuuguuuauuuuaacagauccauuaacaaaucuguuuuugugagucagccauugagacuuuugaggaaaacauuuuaaguaacagacugugacguuauaauggcaugaauuuauuuaauauguuuuaaauaucuacuaugugcuagaaauuuuaacuuauuaaguucucaccguauuuuauagauguggaaacuaggcucagagugauuggauaaauugcccauaugcuaaaagagaaggcaagcaaguguaauacuaggcagagccagcuagauguggaaacuaggcucagagugauuggauaaauugcccauaugcuaaaagagaaggcaagcaaguguaauacuaggcagagccagcuaguaagugguggaggaaaagacuucccccuggaucuuuucccuagcuauuuucauuagaccucaauaccuacaaaucagaccgaaguucugcccuccgggauauuaugaagauacauauuuggcuucauaaagaagcucugcucugcuucuauggauuuaaccaacuguggaucucucuacguauagaucuguauauauggaugguugucuguauugaacaugcgcagacuuuuuuccugucauucuucccuaaacaauacaguauaacaacuauuugcauagcauuuacauuauguuagguauuauaaguaaucuaggguugauuuaaaguauacaggaggaugugcacauguuauaugcaaauacuacaccauuuuagaaaagagacuugagcaucugaagauguuguuauuccagagggguccugaaaccaauacccccauggauacuggggggugacuguacuuaaaacaauagugugugguggaaagugcuaaacuuccuaaaaguuguccaaauggugagcuguguggguuuagaagaggggagagaaggcuucuagcuagggaaggagggguggagaggguagcaauugcaaaaaucuuuguaaaaacagugacauuugugacacagaagagcaguuggguguguagcucuuggggggcggaaauaguuuuggaggggagacaggguggcugaaaacagagaagagagaggauuauuuguugaagugaagaguuuauaaaggagaguuaaggaaaguaauuuuggaaagauggauugagacuaaauuauggaaggucuugguuucacggccaguugaguuguguuuuaucugcagaagaaagcuaucaaauauuuuugagucaguauucacaaaaucaggacaaaauguaggugaaagccagaguuuaacucugaaaauuacuugugucuuauuggaaauuuggagggagauugaaaaaaauacaucaauuggucuuuccaaaaaaaaaaaaaaauuacagaagaaaagcuaaucauuuucacacuguucaagcucaaugagaucuaguugagauuacagauuaauacaaagcucuugcuuacauuuugaaguuaguauuuauuagcacauaucuugcaagaguauaucaucaacugccuuucccaaauugaaaaauuuccucaaauauaugggcuccuuuuuucaugaucacuauccuuccaggagaaaaauaaaauuaaauuuaaauucucccuaaugagggaaguaaaacacuaaggaauaaguuuuauccaguaggauugagcuuuggagguccacaagucauuauaauuguaagacuuuuucuaucccugaauacuaauuuucaucccccugggugcaauauugcucccauugggacugcaugguguaggcccaagcuugcuuugccaugacauuuugacgaacaccguggaagcucucugaugucuggugaagucugcgucacagaagggaggacggauacaaucuccuagccaaauagguugacaauugauaggcuaugugaaagauuugauucaaaaaucaaacagagaaccuagagaacuacuggggaagacaauauugcuagagcaccaugaucaguuacauguugguuauuauacgucccuuaggcuaccaguguuuccuguaaaauaaucugccuuuauuuuuugcuacgcauucugcuaggugauaucgguagaaaaguuaaaaaaaaaaaugcuagagguggaucucacaaaacauagcagugugagggugagcaucaacauaguaugccucugaagucuugaauuuacucuugcuauccaaauuaccucacucaaacggggaaauguuccuuccauuaaguaauagcugugaaaauauuuaucuucaccaauucaauggauauucuuuggagaaaucucugucuaauuuaauaaauuagagugguugagcauauaauguuguguuuuguuguugcugccguuuuacugacuauggcuauugugugaauuucuguuuaaucaaucaaaauuauccauuuugucuuuaaaaagaaaagaaaaauuugaaaaauaagaguagucuacacgguguugaauuccccacuguacccaaagaucgauggcucauccuucugaagaagggaauuuugagccaauauaauaauaauuggugaacugcuauuaucuuucaaugaucuuccauuuagaggaaaaaacuuacugcuuuuacaagcucuggaaaacuaccccaggaggguuaucuugguucacugagcuugggcuauggauuuagguaccaagcaguuugacaaucuuauacaauuuuucuuuggucaagucacuccaagacuccuaucagccaaaacuauaauuugaugguucaucauuuuuaaccuauuacuaccugcuuuugcggagagagggguaggauuucaaucccaaaacauacuuuaaacugucauuacaacauauacacauggaaguggggacagucagguauuugauccagacuggauuaugugugacuucacacauacuuuuagaaguuacuucuacaaagauauuuggagcuuggaaacacacuggaaugacuuggcuguaaaccugaauggagaaugucgcuggagaggccaaaaagcugucuccaucuuucuuccaacauccuucuagugugaccuauugcuauguaaggaagguaacuguuauuccaucuacuucauaguuuucaucauggauucaugaggcaauguguaaaauguccaaugucuuuagaguaaacagcauuuuuuuuuuuuuugagacggagucucucucugucgcccaggcuggauugcgguggcagugaucuuggcucacugcaagccccgccucccagguucaccauucuccugcuucagccauucuccugccucagccuccagggcagcugggacuacagucacgugccaccaugcccggcuaauuuuuuguaguuuuuaguagagacgggguuucaccguguuagccaggauggucucgaucuccugaccucaugauccgcccgccucggccucccagagugcugggauuacaggcaugagccaccgcgccccgcccauaaacaguauuuuuugaccaaugagaaaucuguaaaaaauucugccaugaugacuuacuuucuauugauaaguaugagggugcucauucuacguuaguuuucuacagaacucaaaaauaagugguccuuguggaauaaaugaauggaaauguuguuuuacaaauaaaaaauaaacuuuccuuucauuuuuacuguccucaggaaugugacaaaaagcauaauuuugauguguuauuauuuguaguuucccagaaggaaaaauauacugucaaaguuagggaucuauuuuuaccaguauaacaagaugucacugggagaccauuacuuuauuggaaaguuuuuguuuuuuuaaaacuugucuacugcagcuucacauauuucauaguuguguguuuccugguuaaaaagcacgaaacuuuucaacauuugcugcucauuuugugagccagaucaaggcaaggaaauuccaauauuuaugaacaacuguagaggguaauugaaggauagucugcuguuucugccaguucuacugauaaacugugggcuguuguauuguuuaaaccucugucugcuggaaggcuucuuuuucugauacugaagcauguuuuccuaagccaccuggaugcaaagaggagauuuucaggugaccuuggggucucucccuugccagacuucucagacaaaacacacacacagauacacacacacacacacacacacacacacacacacacacacacagcaucuuuguccauccugggccagguagguucuuaugagacagaccauuaucccuugaguuugagagaguaaagaucucucguaauuuccaucucgccugcaacucugagcccugaaggcuccagucaagcacagcugacugggaacugucaagucuggaggaugcugcauauauucccaugccuggguucuggaauagcaucugugacccacagcccccggaauaagagaaagagucuuuuuggauuugauuuuguucauagauauaugcuccaagauaugccucaagcguuauaugcuauacauccucauaagucuuucuuauaagucauagucuuuauaaccaaugcuuuuuuuuuuuguuugcauagguuggcaacucaaaggucaguaccaaggauucucuauaacugccauugaacaauauuacaauauuuauuaaaaaaaucuuuccauagguauuuuaucaggugcucuacaagagaacuacauaggcacauaugugguuuggagggacuuacagucucauucaggaagaccuugacaaacaaaugcuaacauaaaaaccaccagacugcuauuuagccauucugucugggaugacuauauuaauuauuuuaugacagcguuucuuuccuucugaaugguuguuaccagcgagguaccuuuugcucaauguuugcuuaaagacaugucuauauauuaucuggcaagucuauuucacgucuguuuuaaagucaugucgguuuuaagugcauuagauagcacucugaugauguucacaguaguauaaaaacaucagcuuugaaauguugggcuccauuuucauuaacaaguuuuuuucuccccuuggucccaaagcaaccuaacagagaacagaggguaggaccaagagugaggagugcugggucugccagguggagggugcuggguucgucucagugggcuccagagccaggucgccugccccagaacacagcucugccccugcuagcgcauggccgaaagcgagcuacuugcuguaaaaugggauuaaacaacacgaauccugcagguugguggaaggauuaaaugagucaauauacauaaagcgcuuauguauaaguaccuggcuugacagcaaaggcuauauaaagaucugcuauuauuacuuuggucuuggcuuugucacugaagagcaggcuguggagccccacugagucucagucucuucauauaaacaguggacgaaguucucuggaaccauuagccuugucguuuucuuucuaaauaaggcaucuugcaaguacccagggaaaaaucacaccaaggaagagaccacacaauuuauucaccaacgcaggccagugggcauaagccaggccaguaugggucaccccacauuuaucagguccuacguagccuggggaugggguauucugccugugaagauaggaggagcugggucuuguuucaaauuaugagggugguauuuaaauagcacccauguuuggcuucacacuuuucccgaaaucucucuuuauucccgucucauaggcagaaucaggaccaacaucacugaacaaagagacacgaauuaaaaaucaguuguuuggauuuucauuucugcugaguguucucuuuuaaaaugaccucugcuaucccgagggaaacaguuuuccccauuacugacggaaagugaagucuccucagaaggaggauuucccuuccagaaauucaaaaccagaaaaacuaucaagacacugugauugugugccagugaacagccguuuccaaagauuugaauggaauaauuuguuuuucaugguuuguagguagcagauaaaacuuacauggaaaaauggacaagaagaaauggaaaauaagacacagaaccuggaaucaucagcuuaaaaagcaauuugcuuuauuucagcugugcccagaaauagcuugagguuaccaagugaguauuucuacuggaagcaucagcuacaauuaggucaccaacuuagagaagacguaggcggaaauuuaaacaccaagucuaucauuauaaagguacuuuaucagcaaaacugucagcuauggaugguugacuuaaaauuauuaagaggcuaaaauaucaaaggagaagacaagucuguggaagggucccuccuaagaucaacaacagcugagggucuaaacaugaggaagcggcuuuaauagcauugcuuguggaguucguuuugaaguccuuaacuuccacgccaaucugaugugagaaaaauagaugcuucccuuuggaguccuuguuccaaccauggaaaccugggacacacacuuaauucugcuggugacagaaugacaaaucuguuauuguuuaggauaagugaggcauggcaauacucuucugaauuucggugaaaauuagaugugaaaaucuguaaugguacuauucaagcuuccccuuaaacaagaaacauugagcaaauaaaaauauggagucccuggaccuauucuagaagccuggugccaaggaauagauuuugcauggaucagcuuaagcucacccaggaauggauuuaacuuucuccuggaaaauuuauuugaaaguccaaaaaaaagaguauucauuauuuauggauuuaguaaugacuagauuuuacaaauauuuggauccacaugagccauggaauucagaauaauauuauuuccugccauauugguaacugauuuuucaaagaagauuuuacuugauaguuaauuuaauccauuuugcuugauuauucaaauguuccaaaacacccagugguggccuauuuuuuuuugucucuuuucacuauaauaauauggcuugauguuucacaauggcuguaucuguuuccuuagcuacaaaaugguucugagaccggucuuucuguaucuguaggucauugccaucagugcagcaaggagccccccucaacaaaucucucuucuuuauauggggcugaugcuuggccaaaagccugcaagggugagucucagaacagcugcuaaaaaugcagcuggauagugagacagaagugcucaaugccaguucgcugggcacauucguuaguacaugccaaugcuggaggagccguacagacagaaggcacuucauuucauccgcaggucacuaaaugccuuuguccauuuccugccuuuccuuuaucacauggauauuagcgcuuaucuacucaagucauuauaacuauaaaucgcuaccaucuuucuuaccaaggauuuagucuuuugugccacauacaagguguagagaauucuucuagggauagacuucuaaguccaagcuacccagggaacuaccauuuacaucauucauuaaguaaaauaaagauuguuguugaugaagggguagcucuuacuagggucccaggguuaguccaaggcucaauuaugaagucaaaaggggugugugugugugugugugugacggaaagaaagagaaagaaagggaaggaggagagaguuuggauugggaaaguuaccauccacucuccucuuagcauaccuaguugucaauuuucuguuuauguuuuauauagccucauuaaugauugcgauacuauuacuauguuuacuuuuuuuauuuuuauuuuuugagauggagucucacucugucacccaggcuggaguguaguggcgcgaucuuggcuuauugcaaucuccgccacccggguucaagugauucuccugccuuagccuccugaguagcugggauuacaggcgcgugccacaacacccagcuaauuuuuguauuuuuaguagagacgggguuucaccauguuggucaggcuggucuugaccuccugaccuugggauccgccugccuuggccucccaaagugcugggauuacaggugugaaccacugcauguggccuaucuuuacuuuugaaauaggaaaugaacucagaaguuaaaccaucuuucaaggucuuauaaccguuaggugguagaaccaagauuugaagccuaguuggucuguugccaaaguccacuauauuaagcuguuucccaagugaaucuuuaggaacauuccaggcaccuaguucuucauccuuuuugguucuuucucucauccaugaugucugguagguuacaaagagagaaggcauuaaauguguuguuaaccagcaagcgcaugagguagaaauuuuggaggauuaaggcuuuauugaacccaccaaaucauacuccaggcaucugucuuguuuuucacuguagcuucuaggaagguuaagcauuagaaacucgaauggugaugugaaucauaggaagcgcuaagcuaaacuacugaaugagucauucuuuccagagacaauggcccuuauuucucucaaacucuuaacagacuuacaaaugaggguagaagaaaagcuacuuaaauuuacuaccccuacuaauaacaccaaaauaaauuuauuacucuacuacagagcuuucacuuuuucauaaguuguuaucaacauuuugauuuuuggguuaucagaacaucuaacagcauguucuaaaugucaaauaaaagguaauuacaugaaaugauaaugauauacaaucucuuuacugucuuaucuaagacaaucucuuuugugugcugggaguacaacaaacuugauucuuggcuaccuggggcagggguuuagauuacuaagaauccuagaacuacacacagucugccauaaaacuuaucuguggaggagaccauugcaauagcuauaacucuuugguguguuguggggggaaaaugguuugagacucacuauuucagaggaagugguggcaaaaggaagaggagaaugaaguugguagcuugcagaaauagcagaguggaguagcuaaaacuuagcuagugguuugguguggggguggagcagggucaucaccauuaacucugaaguuuagcccugcugacucaggggccaauggugcugcugccagaaauaggggagcuggaaaaucugagaagaugauuaauucagcuggggacauauuugccucaagguuccucagaggggcauccccaguggauguguucagaagucaauugaaaauaaggccagcacccagaaaugggcugagcuggaggguuagaguugccagucaugggucuaugguguucaagacaagaguggccagauucacaaagggaacaagguggaccagagagagaagagagccugggacagggucuaggauguauuuggaguaagagagaaggaagaguagcuagagaaaaaaauguggaaaaagcagugauaauaagauaacagaagaaaucaucacagugugaaaaagcaaggccaaggauggauaauuuguucuuggaggaugaaguggccuagacuauaagccccagaguagcaaaucaguuagcaaaguggccaaucucaguaugucauugugcaccagaaggucccauaugagggcagaaaaaaaacuauagaacuauacacagucuuccauauaacuuaucugugggggaggccacugcaauagcuacggcucuuuggugcgcuguggaggaaaaaugguuugagauucacuauuucagaggaagugguggcaaaaggaagaagagaaagaaguugguggcuugcagaaauagcagaaucaaaaagaagaguauuuuaagacaagagaaaugcccagccaguggagagagaccaggaguggagaggagagaagugcaggaaggaaaagaagggaaugaaggguugauggaacaguucuagaggaagcuggagggcuugagugcagaagcacaguuauguggcacaugucugcaaaguaguugggcaaauacaauguccaucagagagaggucacaugaagaugcagauagaccccgucaugugaaggaaggaagugaucagguacuuuccauagaacucauuucucuucucaggaauacaggggugacaggaucuucccagaggacaggcugcaugguaugggggucagggcuggcagcccaggccagguuuggaauagccccaaaauauauagcaugguaggagguugugcauggauauauugaguauucagugcacagguuaggaugaaaaaauugugucaaaguaguuaugugauuccaauaauacuuagaagacuuagaacaagagcagagaaaguaaguggucauccugaguuaauaaaugaagguaaagaacuuagcacuccauugaaagguacaguaauuuaauauugauauuagauugauggguccuucauuucccuauggucucaucauaguuucuugcaauagggaugacagagcagggaguaauaggcugccagcaggaccucaauggagugacccagucuuggguucaggcccaucggggcagaacuagguuugucaaagggugcuugcugacuggcuuggagagcagagguagccagaggugucuggggucaccaugaagacggcaaguacaaucuguaggaguggaauaggcagggaaggaguagaagcuguggauggaagaacauuccagaaugugagaucuuggagaugacacgauuuuuucucugaaagcucucagcccauggugagcauuaaaacacucucagggcaaccacacaccaaucccuauacugaccccuacuccaaauguuuaggguggagcccuuuggggauaccauauggggguuucuuuaauauuccucaguggacuuggcuuccuuucucacagacagacagggacuguuaugaaugggguacacaccuauuuuauucacucauauuuuauuauccuauauuauauuauuauagucauuucacugccaccaacauuuccuucuccaacgaugugguaugcgguguaacaaaugguuuuagagaaagugucugguggucuaucaacaacucugaccagacuuuuuuuuuuuuuuuuuuuuuuugagacagggucucacucugucacccaggcuggaguacaauagcacgaucauggucgcugcagccucaaccuccuaggcucaagagauacuccuugucucagccuccaaaguagcugguacuacaggcaugcaccacuacacugggcuaauuuuuguauuuuuuguagagauggguuuugccauguugcccaggcugaucucgaacuccugggcucaagggaucccgccucagccucccaaaaugcugggauuucagguaugaaccauugcacccagcccagacuguuuuggcugaucauuuaugucccuagauacuguccacuguuucaccuuccagucugccuugcauuaacuuucaaugcucuuuccaucaaaucacacuggguccuaugucaaaggcuggcacuguuuguuuccucaaaccugaaaguugaaaggucaagauucaacaucaugcaccaagaguuuagucuguggaggaggucucaaaauugaggauggaauaacuaacuccacaagaugggggcagggagcaggagauauguggcauuuagcaaaaaagccaugguucccuaugugucucccaaauauccacaucuaccuagaaccucagguugucacgcuuuuuggaaauaagguuuguguaaaugugauuuguuaagaugaggucauacuagauuagguuggcugcuaaauucaaugaucagcauccuuauaagaagaggagaagacacacagggguacacagagagaugccaugcgaagacagaggcagaaacuggaguaaugcaaagaugacucaagggaugucaaggguugcugggagucaccagaugcugggggaagcaaggaaggauccucuccuggagccuucagagggagcacagaaaugccagcgccuugaucuuggaauucuagccucuagggcuguaagagaauacauuucuguuguuuuaaaccacacaguuuguggcaauuuguuauggcagccacaggaaacuaacacaguccccuaaccucaaccacugagcuucacugacuagcugggaaguuucucccaggaggccauguugucccugaagccagucccaaugggaccgacaugauugacaggccagggaagccucaccccacaaggcugcaugcccagguaaguguguuucuugcaccgcccuugccaugacaauggcuuguucugacuuacggcuuuguuacuuugaacuucaaucaauggcugaaagaggaacguuguuuugacuaggcucgggguuucuaaacuccccacugugugguuuccaggucagacagucaggcuuuguucugugaaucauugcugaaagauucaauuaaaucucgcuucguccgccuuguggccaggguuucagugacuuagcaagaacaggagcauguagccaguugcugaggaaagccagacauuugaggggagcgggcugcugacacgaggcagggagcacagagaucuucggggcuccagacagcggugaagaaugaaguccccaggcgcccagcuucuuggcugagaaggcagcuguugauuccugacauacuaauuuaggacccgaaagagaaagugagggggcuuuguaaaaucacuuaaaggaggcugaaugucaagggggagaugagccauguguuagcaccacuguccuuuucacgcaggcaugagaaagaaucacaaaugugagucugguugagaucuuuaugguuaggaggccuccuuugaagucugacaucgcuaaaaaaauucucauaaaaccaaagagggggaaaaaaagagcauuuuauccuagcuaggagagcaccaaaguauguggaaaggagaaaaggcuacagcccucugcagaaacaggaauucggcagaaccccaagucacucagaaaagagaaaaugaaagacaagauuucuugaagugccuggaaaaugcuagcuucgugugcagacuugcucuagaggggacagucuugugugaugccagagauccaggcugaugaacaacucccauccccagggcacagguggccugaaaucacggagauucuuagaaccucaguuugguuucuuauuuauagaaugagacaauucaugccaccucucuuuucucuugcaggauuuuguggggcucagaggaguugcuguuugugaauucacucuguaaauuucuagcauccuauaauuguagacaagucaguaugcgccccuccucaaggcugggcuuaggaucccaagacaucccuauugccugcaccacaucgggugccagcuaagguagaggaggggugccaaggaagaucagagaagcccagcuccuggugccccuggggucaguacgguccuucuucccuuguaucugcaaaggacuuguggacacagccgggggaaacaugguugcuaagagacuggcauugcugcacuuucgaggacaccaggcguguagucucaucuuucaucaacauuccuggggcugcuccuuucauacaugagcccagaaggaccagggcggugcagaucccagggaaggggauggcagggcucagcugcccagccugcuguccugcuguggcucugugcugcagcaucaucuaguacuuucaaaaacugugcugugggcacucgccucggcuccuguacaacuguccuucccaucuccaucugccaaacucauucuuaccccuaggaccugcugagaugcugccucuaccaugaagccaucccugagaacaguagcuuguuauuucuacugcugcuuccagcuuugauuggcucuucccuacucauccccucaccugacauccggacagugugugcaacaacuuauuaugauuauuauugggauggucuccuccggcacccauaauccuguccugagugagcacccugcacaugagguuguuugagaacacuggcugaaccugucaacaguugguggauucugauccaguagcugauagugggcaggagaauagggguguggcuuuccaggcucugaggcccccacauccucaaagggaacugagaugaucccaauaggugcagguucaggcaaaguggagagauccagaacaugugccuuuggcuggcccagaucucucucucucucucucucuuuuuuuuuuuuuagauggaguuucacucuguugcccaggcuggagugcaauggcaugaucucagcucacugcaaccuucaccuuccacguucaagcgauucuccugccucaaucuccugaguagcugagauuacaggcgcccgccgccacacccagcuaauuuuuguauuuuuaguagagacgggguuucuccauauuggccaggcuggucuugaacuccuggccucaggugaucugacugucucugccucccaaagugcugggauuacaagugugagccacggcgcccggccccagaucucuuuauacugaucuuugccauucucuacucugcuugggguagcuucuuaguucguacuacagcuuaaaugacugauaguuuuaccuuucuaggagagcugacuucucagagguuaccuaagcuugaagucaaaggcaugaggcugugcuaggaggugugggggaggaaguuacuuuuggaagccagggucuuucccaggcuucugaaaucauccccuugggcaacugccuggcaugaugugucccugauuaaagcaguuucucuccuccuagucuacuugggaagcucugaggaugauucuuucucuuuugauacaucaaauccacccaaagcagcuucugaaaaaacuaugaaaaacuggccacaggaguguuuguucugguagaauuuaaaugucuuugugcugcaaaagcugaaaugucuaguaagauuucugaccaaagccuuucagcucacuauaagcauuggcacgaaggguaaaccacagggauccagcucuuacaaugcuucauucccuucugcaggcccuagagacucccugggcuuugccugccacaucuguacacuggggagaagguggauuaccucuuacgcuccaaguagcaagucauuuaaccucacuccucauggguuggggacgggagcaugcucacaggguggaaggaggaugaaacggaugcacaguaaaugugagcuguuuucacaauuacaagucucaccucccacucugagcuucuaugacucuaucguucauuuuucugcacagggacugacucaaggcucuaagguucuaucucugugcugcugcacugagcugcucccuccugaaugucucugccugucaguuucauucagagaccccugaccaccaguaaucaucagauauuucaugcagcugggugaggcaucagauccgacaaaauaggaagauucuuuuuaaaaccagaaucucuaaaaugaguuuguuugugaugcaaguagggucuggauccuacaaaccacggaagacuugcagacaaggcaguuucuucuggaagcuuccccagggaagagcaggaacccccagaauggcagagcugcacgugugccgcugugugacauuccuggugcuaaaaagaaacagugauggaucuuugccauaguggggaaaaaugagccagugcaauaggccuagucauaaaagguggaucagagggaggguuuuaguugaaagcuuuugagagguugagcuucauuauccugcugcuguuauaugaugaaccacagagacgugcacccauaccacuggggcucuuccauuaacggauauaauguugggauaugaggaauaauuuuuuuuuuuugagacggaguuucacucugccuccuggguucaagugauucuccugccucagccucccgaguagcugggauuacaggcacccaccaccacgccuggcuaauuuuuguauuuuuaguagagacaggguuuaccauguuggccaggcuggucuugaacuccuggccucaggugauccacccgccucggccuuccaaagugcugggauuauaggagugagccaccgugcccggcuggggaauaaauuuuugcuauacauuuugcauaaaagcagacaaaugcucaguaacuuuuucauagaaacaucuguaacucuguucaugaggagaaugccacaggucacucacuuauuugcacaaagagccguacaguucaagggaacgcugugucauucuguccaaccaggggguuagagaaucacugaucacuaaagccaggagcaaugcuggaagccugucuccacugcugcgcuggcgaagaccggggcccagccucugugguuccaccuugccugccucucuugcuauaucccagcugcuucagguuuucugaacaugccaggccccuaccugccccuagaucccuggacaugccuuuaccuccucccgaaauucccucgguccucucuucccuuggcuagauaccccuuguuaaagagaauauucacaucugccauggcucccucagccuggguaggcgcccugcccugugcauucugguuggcccuaugagucuguucccuucugugucacccccaguggggcccuugaugacauggcuguccaugcaguuuaccucuacauagcagcuacgggcacuuggcugacuuuaucugaccaaacugcauagcuaucacuaugugcccggcagcauuccuagcagggauuacgaugaugaugaugaugaugaugaugaugauggugaugaugacuguuauuucuguuuuacagguggaaaagcagaggcacaaagcggugaugugacuugccugaagucacacggcuacaaagugguagauaggggaacggcucccacgucuguauggucugaacuggguuguguaguguuccccaaaguucauguccacauagaaccucagaaugugaccuuauuuggauauagcguuuuugaagaaguaacugguuaagacgaggucauccuggauuagggugggcucugaaucuaaugacugauguccuuauaagaagaaaaaacggacagacagagggaagaccucauaugaugcuggaggcagagacugggcugauguagcccagaagcuaaggagugcuggcaacugcuguaagguagaaagaggcaaggaaggauuucccccuagagccugcacagggagcaagggccugccaacaccuugauuuuggacuucuggcguccaaagcugugaaaauaauuucuguuguuuucagccacccaguuuguaguaauguguuauggcaagcaugggaaaguaacgcacccccucucaggagagugaagcgggcggugucuccaggggccuggacauuucugccccuucccaggacaggguacagagccagcaggccugcuucccuggaaguucugcccggugguggauguagugggggacucccagauggcgcacacauugcacaggcaggccagcauguuccucucccaagauggcauuuugggagguacacagugcuggagcacgagccaggagccuggggcacauucccggcagccagacuuuggaaagcaggaggcagccaccuggggcuucaaucucccuuuuuagaaaaugaaucccugaagugaacaugagucagguacuguucugggcacugaggauggauuaggcagugagauuggucccagucucugucuccauggaauuaacauccuaggggugaccagccaugaaucucccaaucauuaaacaaguggugauuucagagagugauaagagguauaaagaaaaacuccccucucaaaagauuaugacguuucuuucacaagauuaaacauuacaaauauaaaaaaaaaaaaaagaaaaaaaaaaacaacccaagaaaugggauggcgaugcccuuuggccauguucacugcugcauauccacacaaacgccuucguggcagcccaggcagugcccagcaagcucagacucagccaguccucgagcuggccuggcagggcuuugcaaugcagcuaccuuguggccagaggggcccauccaaguccaguuucuccaugucagggcuagcaaugaggaggaugacugugcaggcagcccgcccaggccucagcagggaggggagcggagacucccuccgggugguucucuaggcagagcugccagcaggguggacgguucccugaaaggaccacucucuugcccugccaggaagggcaucuggggccuuugggaagcacucguggaaggugcugggugcuucaccucguaucuggcggacgccaucaccucugcucuacuucuagggugacugcuuugaggaagacguggcaauuucagaagcuuuuuaaacuucccagagcagaaggccaaguuucccaaucuaaucuauaugccuuagcgaugucacuccuggacagggauaauuuuaaaugcaagcauacugauguagcuauaggaugggguaagguaagauguaggguagaaaccauuaucuuaaaaaaagagcaacuucagagaaaaaagcaguucuaggggcaaacaaaacuguaccagaggggcuccuaggaaccucagggacuuuccauuugauuugccuuuucagguaaaacaccauuaauaggagccagaauagagucagaggacaaugucuguuuguuugucccuacacacacacacacacacacacacacacauacauacaggcacacacagacacacacacaggcacagacacacacaggcacacacacagacacacacacacaggcacacacaggcacacacacagacacacacacagacacacacaggcacacacacacagacacacagagacacacacacagacacacacacaggcgcacacacacacagacacacacaggcacacacacacagacacacagagacacacacacagacacacacaggcgcacacacacagacacacacacacagacacacacacagacacacacacacacauacacagacacacacacagacacacacacacacggguaugugacugaggaaugugacaugaaugaccuggcauaaaugcaauguucuaauuuauuccacaucauucacugagauucuccacucacuaauuuuccuaaaagcagauuuuuucauauccuuugaagucaagcaagugguuuuggggaaaggguuguucccuccgggccggcuggcaacauacggaauugucucaaaagccccguuagcaacagaggaaaggucagcccccucuuagugaauggagaaggagaaaguaaagguugugaugauaaacauagagcaaguuuugacaaccauuggaucauuuaacaguaccagaacaucuagacggaaccacauuuuuuuuuaccauugcuauucauauauuuuuuaagaaaauuaaaaaaaaaacuuccaagacauuuucuaaacugggaaggaggauaaaauauuuacccaugguguaaacuauguaaaaugcaauaauguguaagaccugguauuugacagcauaacagggugaccauagucaauaauaauuuaauuguacauuuuaaaauaacuaaaaguauaauuggauuguuuauaacacaaagaauaaaugcugagaggauggauaccccauuuuccaugacgugauuauuguauauugcaugccuauaucaaaacaucucauguaccccauacaugagauguguauagguacaaugugugcauaggagugcaguggugugaucacagcuccacagcugugcaccugcuaugcguauacaccuacuaugcaccuaaaugccuagguaccuacauuuacggguacuacguacccguaaaaauugaaaauuaaaaagaaaaauaaauaaacgaaaugaucuauuaucuucuucuacugaugaggacauaaugaaggguuugguauguuagacucauacacauauaugcagacuuuugugguuguaguuaaauuggucaauagauauagacugaccuaagaaaagaggaauuaacuuccagccuaauacugacugggcacuucuguucccguacacccucagagacuucagccaacuucugaagcaguuaauuggcuuuccuggcuggaaccgcaacgccauugcaggcaagugucuuggagcuccagacaggcccgugaacaggguggcaagaagucuaggagaacaugaaucagccccgcauggacacccguggcauuuaagcccgaaaggaaacuugacugguagccgaagucagcaauggaugccaagcaggcugugccauguugggggacugagggguggggaccggcuccugagcauggcugguggccacggaggccccaccuugugaggccacuauguccccuuuggcccuacacaucagacuccacccuucccagcagacucucugacccuuucagcucugaccacaaaggguggaacuuaaugagcugggaacccaauuucucacugguuuugguaaauuaaaagcgauaaaaugaguaauccauuaaagucaucauuuuuccuaacugaaaaaaaaaaguaugacaacucuguugagacuugaccucuuugaaauaaaggcuguuacuuucugggagcuuuuuuuuuuuuuuuuuuuuuuugagacaaggucuugcucugucacccaggcuggagugcaguggugugaucacagcucacugcagccuugacuuccugggcauaggugacccuccugccucagccucucaaguagcugugacuacaggugugcgcuaccaugcucagcuaauuuuuguauuuuuuguagagacaggguuucgccauguugcccaagcuguucucgaacuccugaacucaagccauucacccgccuuggccucccaaagugcugggauuauaggcgugaaccaccaugccuggcaucuggcagguauucugagauuuaaaucuuuagauacugcaguuuacucauuguccuuuguugucauggaguuuauagaaaaggcuauuuaggaacuaaugcugucuuaauuauuuucucugucucuccucugccucuucgaauguacauguguagguguauguguguguauauguacguguuucuuuuuauacuuggcuuuuuguagccaucauuuuuuaucuuuuagaaugcccccaccacacauucagcauagauuugcuuuucagaauuuugaacauugagaauucuuugaauauuuucuaauaccugaacauuuaccuuuauaugucugcagccuguggacagguguguagaauagcagacugucagacuugggaggaccaugaggcuauugacuuggaccuuccaucucaucaagcaggaauucucccaaggaaccaccgcccugaccuaucccaggggucaggccugccuaaaccaggcuugaguuuuguauauauugcucagcucaguuguagagcucaggugugauaacucugccuaagaggggaugaggaggagggcuaaauggagggaaaagugguacaggagagaaaauagagagaaagggacauuauaagggugggacuggggucagaggcugggaacugggggcugggggagaucuaucagaagagagcaggcugcagggacguccuccuggguuccugcugugucaugcgucugaccuuuugugucucuuucucaaacccuguugaugugucagcccacgagaugcuggggguguggagaggacgaagaccagggcagaaucuuuggccuaaaaagcagaguuccuggaacagugucgacauuuuaaaaauauuagcuagcuugaagaggaaugcugaacucucucucucucuauuguucucuccuacuuaauuucauaacugaucuccucuuauugaaacuguaaguggaaaaaaagaugguuucacagagauccucauuaaagaaaguguugccguaaguaaucuaguaauguaggcguucugcagcacaacauuccuccugagcuuaucacuuuacacugugaggccaagauguuaaaaaaaaauacacacauacacagcaaaccccuacucccaaacauaagaguuuagaucuugagcaauaagacauagauacuaucacaauauuuugcaaaucucagaaacauugccacauuuuccauaggguuaacaucugagaugaaaaacuaauucagaacuuaugauuccuuuuaaaaaaauucccuuagccaaacugaagaaauuuacucgggagaagaaaaugacuuaacuuguaguuuccacaaugagaaacauauucucauggcuuucagccacuuucuaucauuaugugaugggcuuaaauugcauucacugacagugaauuaaaagcaugaaugaaaucuuuaaaugaacaacugaaauaaaaucaugauuuaaacauccuagcacuuaaaaguaaaagaaacuuuugcauggcuguagacauaaugaucaauacugaguuuuaaucccaaaccugacagcccauauuuuucaaacugagugccucaaauucacaauaaaaaaaaauaggccucuuauugcugcagugagauagggcaguguaaugccuaugagugugucucuuccuguguuguaucuggccuugaguccacagaaucccccaacaucaaaggaagcaguaggagaugguguguggaacaccagauagccggaggaaaggggaaacucuuccuuugccaagagggauugcuaaaauuagaugguaaaguagucuuggcacuggaagucgucuugcugacgaucagcuucaauagaugauagaacuguugcuuauuuggagacuuucaaagagaggggcuuacaccccaggcaggaacgucuuaccaggcugaagagcucuuucuguguggagaugcuuuccuaggucuaucuuaaauucuucaugcugauauucaaccccacuuccucuugcuuuggagcuuagugcagaaggggccuugccaggcacuauucuuuuccugcaaacuucccaagaugauuuucauaacucaagaccaucauccuucucuccccaacacccccaaucugggcgcuucauuuuggccuuuucugugcauuuggggugcauguggaaagaagguucugcaagaugggguggaaggaccaggacugggcucucacuugggcugagcguauggucaccuggcacauccagggccaucucuacucuccucccccaucucccuugccucugccuugcccuggugacauuaucuagacaucuaccacucaaauguaugacuuggguaagcauugcaucuucuauguuucucuuuuaaacuuugagaccaucaggaaaggguugagccugucaauauuaauaucuuugcugcccucguuuccucucaagaaaauauuuagggaagcaagaagggcugggagaggggaugaagaggaaaagcagggggcuuaggaaaaggggaccugagcaggggccacagagaucagccccauuuuccugagaacgucccuguggcuuccucagagggaccacacaacguccagagaccaccgugugacuuucagagauaacagcgacaguuccuggcaacauuugcucccucccccaccuccauccuucauccuccuccucagagaauuuuauuuggcuuugggcaacaugaaagucaacuccacagagugcagagggagucagagagcccaguccucaucucaucuggucagcuucuuuuuucuuuuuuucuuuuuccuuuuuuuugagauggagucuugcucugucacccaggcuguaguguaguggcccagucucggcucacugcaagcuccgccucccagguucacgccauucuccugccucagccucccgaguagcugggacuacaggcacccgccaccaugccuggcuaauuuuuuguauuuuuaguagagaugggguuucaccgaguuagccaggauggucucagucuccugaccucgugauccgcccgccuugcccucccaaagugcugggauuacaggcgugagccaccgugcccggccucuuuuuucuuaagaccaaaacaaaccacaaacgcucucacccuacuaaauauccacccaugaaguacaguugggaaaucugugcuccaaagcaaaaccauucucuuugaaggagccagccuagacugcucuaucccaccaaugagagaguuaauagacuugaugggagacaggcacauggcaauaaggaggucuguucuuaggugaaauaggugaguugugcuggccaucagcacuggaagcccugaauucaggccuuugggugagcagggcagcacacacaacugggcagaguggcccuuuaucucaugccagcuggacccagagccggagcuuggaggcuggggugaucaggcuguucuuggcagagguuccugaaaugaaaugacucugguggugaugggaggccguggcuccaggccugccccagcauaacacguuguuagcauauguuaacaggcugccuuuucuccaaagaucacaaaaugcauuccauuuagugucuguuuuggaaguguugcuaucuguguuuuauaggugacaaaaccaagauacaucaaggucauggagcccccacagcugagggugagugaguuaggggcugaccugggagaccugcgcuuccugauucucaggcuguugcucaacagcugaccccugaucuuuccaaacuccuuccagaaugguccuuuuggccugcagaucucagggucugguaggaguuaaaaggaacacguguguucugaacucccuggaagagaguauugaaaacacacacacaaucuaguguucgacauguggggaccgagaugaaaggggacagcuguuucagugcuggguuuugugaccacacgugguuaggccuucagcccacggaaagcacauggaaaaugaguggaagaccuggcucccucucuucucucccguuaggcacaagacgguguaaauccuggucuuccuccuuuuaaaagugugacuauugcgucagacuaagcuuucuaaggaacucgccacugguaucauucaacagaaaggaaccugcuagauuaaagcuaagugaaauuuuccaaaugauuucagcuggcucuaccuagugguuaagcuucaucuuuaucgggcugaacgagaugagcuuucacccaagauguuggagccacgcuuauaauauuugacuuuuacacaaacaguuauuugauugcaauccaaacaaaagcaaaugauguccaaaguuagaacuauggauacaaggcacugaaacaucuuaaaacucaaggcugaaagguaucuaaggaauuuuugucucaaggaagagguguuauaauucccaaaaaggaaacugugucuacugauuuuuuuaaaucuagagggaagacgaucauauaauuuucuuucuuucuuuuuuuuuuuuuuuuuuuuuugagacagagucuugcucugucacccaggcuggaaugcaguggcgcaaucucggcucacugcaaacuccgccucccggguucacgccauucuccugccucagccuccugaguagcugggacuacaggcacccaccaccacaccugacuaauuuuuuguauuuuuaguaaacacgggguuucaccguguuagccaggauggucucgauuuccugaccucgugaucugcccaccucggccucccaaagugcugggauuacaggcgugagccaccgcacccagccucauauaauuuucaucaggcacuaaagcuuaacaaucaacuggcaaacaaauguuuaccauacacgacuguaugcaaaguuccggaagggcaggcagauagcuauuuuauucauguucccauaguugagugcuucauguucuuuggacuuguauaaguaacauuaacuacucuuaauacugggaaauucuuuguuaucucucucaaccgucucucacaucauugccuuuugguauggccuccuaaucugaguucuguuccagggaaaaugggaauggaagucacucucaaugacagcccugcacacgcagggaacaccugguuacuaguuugucccugagccacuucuucuggugccaggcugagcuaaggauaaggcagcagaaagcaaaaggcaaccucgaaugucucuagauccagacuuuuggucuuucccuccaaaugucuuccucccauaguccucuauggcaauugcaguuuccagauuucuuacgcugaagaacaugugauacuuccaugccuguuuucuuuugcucguucccuccaucuaccagucaucgacuaaugcugguuuuaccuccaaaacagucacucucuuuaccgucucuauaauuuuuuuuacuuccauuugcaauaguuucuuauuuguauuuuuuaaaaguuuuuuuaauagccuuauugagauauaauucacauaucauauaguucaccuauuucaaauguacaauucaauaaguuuuuggccuauuauuuuuuuugaguuaugguuuuauauauauauauauauauauauauacgcauauauaacauacaguuugacauuuuaagaauuuuuaacuauaguucuauggcacuaauuacauucacaauguuggcaauaauaauuacuauucauuuuucccaaaacuuuuuaauugcccaaauaaagacuaaauaugcauuaggaguagaagaaaacuucaacacgauaaagcucauauauagaaacccacaacuaacauaauaccgaaugauaaacuacugaaagcuuuuccccuaagaucaggaacaagacaaggauguucacucuugccacuucuauucaacacaguacuggaaauucuagccggagcaauuaagaaaacaacauauaaaagacacccaaauuggaaaguaaggagucaaauuaucucuuuacagaugccaugauauuauauguagaaaacucuaaagaauccugaaauaaaaaucuguucgauauaauaagugaauucugcaagcuuguagaauauauagaaacacaaagagcaguuguguuucuacauacuugcaaugaccaauucaaaaagguaacugaaaacaauuucauucaaaauaacauugaaaagaacaaaauauguacaaguaaauuuuaaacaaggaggcaaaagacucauauacugaaaaccacaaaauauuacucaaagaaauuaaagaacaaaauaaaugaaaaggcaccucauguucauggauuggaagaccugcuguuaagauaacuauacuacccaaagcaaacuaaagauucaguguaaucccccaucaaaaucccaauauuauuauuauuauuauuacuauuuuuacagaaauaauaagacccauccugaaaugcuaacuggcuuuuugcacuugcuguuucuccuuccuggugugcuccugagucagacauuagcauggcucccagugucaccuccuucaggugaguaugccacaugacacucaucaccuucucagcgugccccuccuucaccagcuuugcacccccagcugccccuuauuugucuuaugcuuuuccauugcccuuaguaucauuuucccacacagcacauuuuauuuauuuauuuauuuauuuauuuauuuauuuauuuauuuauuauuuauuuauuuauuuagagaugguaucucgcucugucacccaggcuggagugcauuggcgugaucuuggcucacugcaaccuccaccucccaggcucaagcaaugcuccugccucagccucccgaguagcugggacuacaggcacacgccaccaugcccagcuaauuuuuguauuuuuaguagagacgggguuucaccauauuggccaggcuggucuugaacuccuaaucucaggugauccaucugccuugcccucccaaacugcugggauuacaggcgugagccacugugcccggccuacuuauuuauuuuuauaauuuccccuuuaaauacaaauuucacgaggucaggaaguuuuauguuuguucacugcuguauuuccagcaucuaaaacaugucaggcacauagcaggcauucaagauaaauauuuaucaaaugcaagcaugaguguaaaauguaugagaaaaaccaauacauccacauuuauuauuuuuguaaugagacaagaccaacaagugauuacuaaugggauuuucgccucacauuuuccuuaacagaauuuaaaauuguggcaaaacaugguggugcaagaacaauacaacuucauuacacacccaaagaaguggugaguucaucuauuuccucccacucgaaaagcaaauucauuuugggcuguuuucacaucaucaacucuccuuccaauguacugcuccuugaaucagaauacauuugaaaucauuucccagucugaaaaagucaucaguguaucuuaauccaucuuaaucuguaauggcaaaggaccccaugugaguggagaugcaguuauggcuaagugugggaugccaagaacuugacuuuggcugggugagagcaagucucaauagcaagggagcaaguagacagcugguaggaaaaucauggguucgccugcaugugaguaacaaggacgaacgguaaugggagacucccacaagugggaaacaguacauguagacaugacuacaugccaaacaaauguacaauugcacauacuuaacuuaugauuuuuacuuugaugauaaugagugaacaagaaggagaaaagcugucuuuuuuuuuuuaaaaaaaaagaugacucaaccaugucuuauauuaaauagauauugggaacauuugccugaauuacaucacugaccucaugaagccaugaaaucucccacagaacaccacaaagccacagcuuuaucuccaagcucaacacuuuguaauggcaccucuucaaggcuuaguuccuguauuuccauucucaggggcagaugcuucccuuaggaagagaagcccacugucucucugagaggagaaacugaugcuucuuacccugagacugaaagggcugcagugccuaaaaugagcacugugauccaaccuggagaaacuguaucuuuaacacacucacaaagaaaaaaauaaaaaagaaaaccauauucuuuagauuuauuucguucaaauacacucuuuagcuagagcacaggcauuuaccuuccaauucuacuuaucuauugauccaacauauuuacauauuuucaaaauaauccacacacauucuauaaucccacccauauaagauuucuuuaaagugguaaaccuuuuccaccaccauuuacuguugagaaaauaaagggaugagaaagcauuagcuguguucuagacaugguccagucaaagaagggagaacuuggaaauacagaacugugguuauucaucgugacucugccagccauugacuacuuguguacacuuggaccaagagacugguuugauaccagucacauccaugauggugacauuccaugggaugacaaagugccugugguugugccagaacuuucuuguaucaaauaauucuagaaaacaagaggcccagaagcuagaaccaagacaccacuuuuguaugaauuaacaagaccucaauugcuuggccauaguggcucccaucauggcuucugaguuguagaccuuagcauuauggcacaucucaagggacuaugaaaaaucagcuccccaucuguguuccauagaacagcacgacaauuucaggaccuagcugagggcgugucuugaguaaagucacagauaaagcuuacacuagaaccugggaacuuugauccuguuuuuaucaccccguccauuguugaaguaaucauuuaauuuucccaaaugguccauggacuguuugaagcaggaccuuaccugauucuaccccacuucuaaugcuucuguaccugaagauuuuauuaaaugacaagggaucauguauuuggggaaacagagacauucaacuuucgggcucacaagagaggcagcuuuaaguucagaccuucccuuguugucugcuugcuggagaagugucugucuugugaucccagcuuacaauuggcccuggaccacaaaccaggccuacaagaacauggauguggugcccauguuucaaauucaucucacucucuuaucagcaggggacuuugauuuggcuuuuccuaagacaugguuaaaauucuuauuaucagcuucaauuucugugccacaguuuuaagacuaaccaccucugcuuuucucuauccacagcauaaaccacaaaaacugcugucaccacugaauuguugaaagagaaggcauagguagauuuuauugauguauucagagaucuccagaaaucauguuuuuuuuuuuauuagaguugaauuucuucuucauaccaauaugcuuacccaaugugauggagugaugaggaaacgggagagaugaagacagagauacagacagagaugagagaggcugcauuuuacucaguaaagacccccacugaccccacaauuugucuacaguccuauaaacaccauuaggauucuguaugacucauuguauaugcaaggaaauagccucuucuguccucuaaagcaccacaauuaaauuccacacuugagucaaauuggagucagaucagaccaauggccccaccccauaccccacgaauaauuuaauuaauaauuuaguuaaucuauacuaagaaccuucauauuacagcuucucuauuuuuaagccuaggaacuaucaguuuuccagacauacuauaugacuuaaaagacaggcuccacaguuccauccucaucccuggcaccuaaucauaaaggacauucaugauccuagcuaucccuuagcuuccuucuuacagcucagacucugcuggaccgacccugauauaccugcucagcacucgccagcuaguugccuucccucaugcuauaaaugcuguacauggaggaagaacauggcuuuuggcugcagcuggaagucuccuccccuccaucucuuaucuuuuaaguacccuuugaauuucaugccagugucaggugaguaugggguggcacuauuaugugauuuuccugccacauuugcaggugugccucauggccuugacacauuuaaugucacuuucuuucaacugggauguguggcgaccaguacguccacuccagcuggaaugccugggauuguguuuuuauggaugacgucuucacagcugggaagcaucucuccagggucucugacagugaguaaguugcucacaucauuguuggcaggcucaucccaauuuuaagucauucucuaagacaaggcagacaaaaagucucaucuauuaaggucaccaggccuuugagugcugaggagcuaaacuaaagcguugcauccaggugcuggauuguggaguuguuguaugcauugucuuugagagaaaggcuacagugaaggagauggaggcacccacacguggaagauuggagauuuaaacaugaaacagccucaauguuuuucuugaaaaucugcuuugccuccauaaaagccucaaggaggcaaacugaacuaaauguacuuuucaggaaacacaaugagaaggacaucaucugguuaacacaauaaagccacacuacucucucucccccucucucucuuucaagccuuccagagcacccuuccucuagcagacauagaagaaaacuacccacauggcucagagguuaagggccugggaacgagccucaggcagacauggauaggaguuccauucugcugguugacuuugggaaaguuaggcaaccucucuggaucagaagaggagagcaauaauaccaguauccugguuguuacauaggaagugcugggcacagcaccgcgcacauaaggggugcucaguacaugcuggucaauauuaucguuauuaauauuuccuuugucugaguggugaaugaggagcauggagaaguggugucaccacaucuuuugauccuggggcucaguggugcuuuagagugggugaaggcugagccugaaucaaggccugcccagagccuuucucuaccaggcaaaacgugcuggaaagauagaagagaggagcuccugauucacccaggacaguccccauuuacuguacuugccaccuccuuuuccacucugggaaguacccaguuaaggaggacaaaugacacugucacccucucuaggagguaccuuagguggcuucuacagcugcacugcuugguauuggugccaccagccccaugugggcaagaagcauguggcugagacagcucgaaaguguaaccugcacaccagaucucaaagacucgggaaagagaaagaguguaagcuauggcauuaauaauuuuuauauagaaugcauauugaaauguaacauuuggcuauaguggguuaaaaauauuaguaaauuaaucucacguguuucuuuucacuuacuugauuguggcuacagaacguucaucugcgggcuuguguucuauucugcggggcagggcuguccuggagguugagccccaugggcaguggacauguagcugugcucuggacagacgcuguggcugccaccacauuuucucucaggcuuugggggaaaugcucucccccagccccaccccagaacugugccuuaaugcccuggcccgguugggucuccaucccugcaucccugcaguuagcccugcucucuaggugacccgccguccuuuggaugugcuaaagccaccacauucaauauauucagacaugugccaccacuuccccuucccuggcuccacccuuugucucccugcaguguuucuccuccaggauagcagcccuuuuggguaccagaguccagaccuucaugucaccucuugcuggccucuacuccuugcucuucagaagcaagucaucugccaacccccuugguggccucucuccuaccucuucuccacucucacugccaccacccucguucaggcccuuuauuuugugauauuuacuguuucaacauccuccaagcugaucagcuuacuuaucuuccuauuacccccaaacgccgaugagauccuuuuauaauccagaacuauuucauguuccagcuuuaaaauaugucccugauccucccugguacccaagcucuucagccuggcauucacagcccuuuagaacucagccccauuuuauggauccagguuuauucccuguuauuuccauugccuccucccaucuaccccacggccaccaccccugggccaugcuauuuuucacaaacacaugcuguaccuuuuuagcucucagugucugauccauggugcuccuuggcaccaauguccucuucacucccucaucugcuuuggggaguuccaucuaaccugagggcucaguuaaaaccugcauucuccaaaaacuuucccugccccuccccccaacagaauugguucaucuuccuacaaccaauggcaauuucaugguggugccauguacacauucgaguuggccucauauuaggggaauguaugugagcauuuccauucucaucuagaggaggacuucuuuaguauuuggugguuauuucuucacauucugauccucccuccuccauagcaacuagcaucaacuuccagccaccauuuggaagguguucaauacgugagggugacuugaggcaaagacaagggucaaccuaacacgucuuuggaaggaucgaugcucaggcuugucucagcuuugggcugggagaauuccuugaggacugaugaggauggggcagaccacaguagcauuuaaagagaaaaagggaaaaguuagguugugcacaucugcauaggcagacuuucuaauuuuguuacuucaguauauuugcugaaugugcacugcaagaauauuuaaagaucaaaguucuauagcagugagcccagaacaugcucaagcaugguuaauucugccacuuucacccucuucuccuucaucaccgauauggcagauaccuagugguggacucggugcuucuaaccauacugauuauggaaugaucauuacagacuuugaauaagguaggcuucuggaagaagauaaaauuacacuucuauuagaacgucaaguaggaccuugcaugaaaagagccauugauccaaagggaagaaagguaaagagaagaaaagaaaagaaaaacagcaacaacaaaaaacggagcccaccgacuguaauggagagguugaugcuuggcuuuaggagagcaggucguguguguguugaauuacaggcaauuaucaguggucucccuguuggcccugaagaauuuagaacugcgucaaaaggaaaucuggucuaucaggagggagguccugcugcaucuuuuaacccugugccaacuccacugcacuugaaacuuuccaugauguauccuauucuuaaaaucucacaaauguuguugguaaaacaacuguuagcauuugaugcgaggauaaaacucucugcuagaucacguguucuuuuaggggcccaaauugggauugugaaaauguuauaugauuuuaaagacugaaauaaauccugcccgaugucuucucugcuuucuagcaguuuauccacaaggaaggaaccaacacuucugcacaaaccccaccgagugaguguuguucaccaauauaaucuugaggcacuacaagcccaugaaguuugggcggauucuccaaagaauaauuacacuccggucaaugcaauuuuaguguuaauuacacauuauuauauuccugggauaagacacacuuauaugagcaucucagccaccuaagcaugcaucacugaaaaacggagaucaaggugguucaaaggcuucauggagccaggccugcuagaggacaaugggcacuucucccauuuaugcacugugaccuggacuggucagaguuggcccugcucauuccucuugccagcccuuaagggacaacagggacacaccaugcuucugauuuagauggaaugaaggugacugaguaaaaaauauggaaacuaaauacuuaaagggugacucuaauuuuuuuucaggaggguuuaaaauuuugacuaaccaaacauggagcuugggccuaauacuucaacauuuuugugcuuuaguuuucuuauauguaaaagaugagcagaugaccauaugccacuugcaagcauuaagguccuaucaguugaugcugaagcuguguuagacaaaucacacgcugguauaacuaggcuggaugaaagucuauccugaguguucacacagaacugcauagaaaguugauauugguaaugagggccuagguuagaacuguucagagaaagcacgacgucugugacagcugaauauuguguggcaauauuaaguuggguucuguuucaucucuggcuauaaggcauacaaaaccauauugcauauuuugguuucaagguguuuuuuuuuccucccuaaauuuauaccaauagcaaggcauuauuacuccauaagcuccaaaaacauuauuuuuaaaaacauauccaauauagauuugggguaguaacaacaacugcuaggaauuuaauccaucaauuacacuccuuuuuuuaaaaaaaaaucuggucuucugccuuaauguuuaaauaugcagagguucaaagcaccugacaauuaggugcucugugccuucuuaccagacacuucacauuaagacauguccuuuguugacgagaauguuuuugccuggcugucuguugcauuucucucucucuuccuagcuucugugaugcuacuugguagagagugauguuuaauaauaguuuguuaaaugaaucaacagguaaacauaaaauauggucagucacacuaccgugaguacacacacacgcacacacacacacacacacacacacacucauucacaaaguccuacacaggaaacuaccccaggccauucccauuuagaaaaaaaugugcaacucgcugccagcacucauguaauuuuacauaaacacacucguugaggcugaagaaaaucucucugauuuucaaugugaaaauaaaaucuaaaaacuguuuuuggaguuauuuccaaacagaacuaucauuagaaucaucugaaacaucagaaucaucuauucuggaaaaaucggauucaucaaaugcaucuuuagccaacaacuguucgagaaugaugugaacaucacagguaggaaugcuauguuuucuagaauucacauuuucagugacugagaauuacuauauuuuguaagugaagauaccacuaccaaaaucaaaaugcuauaaauagaaugauaucuuuuguuuccagagucgauuugcuaguagguuggugcagaaauaauuccgguuuuugccauuaaaagugaugugaauaacaaugaaagugagauauuucauggcaaaguuaacuggggauaaauggugcaccugcaagcacugcuggugaguauucuugggacaaacagggaaaggguuaaguaguucaggaauagugaagaugcuucaccuucucaggccuuuuccugaucccaagcccaugacacacaugacaauugauccaggcaacuuuccuaccgagacuccuucucaagccccagcuccggggcagugagacagccacuacuaauucauaagaguugucacuugggauaaaguaaagguuccaucccuggaauagacauggcucuuugcugucaacucauauguuaaugucuggggaucagguggaucccuccguggguugaaacagaaaagaacuuaaaacaacuuggcauuauccauaggaaaccgaggaggguaagcaauaaaucuacauuaauaaaaaaaugccaggagggguuucagcgcccuccauggccacugccuguggacaagagcucugcugacugucaaguggaauugaucccauccauguuucaucacuucaacagcgaguggaagcagaagagcauuuaucaucaugaaacagacaagaauucuugcuaauuaccauuuuguuuuaaaguauaguaagauuuagggcacccucgcuaccccaacuagcuucuuuccuugacuuuuaugugggcaguguuguuauaauuucucuguucaaauaaagucuguagaaagccacaaaaagagaucuggacccuaaagcuuaacggauucuggaaagcagcuggcuuguaacaugagucauuccagccaaagcuuucucuuuuguauguuuuucucugaccuaaagaguggguuauuggaugucuucuggcaggugcuacaggauuaagaagguagcuggucagaaacaaacuuugaauuagggggauuuuuuaaaaaauaguugacuaaaguaaauaugaucguuagcuuaauccuccauaucuaacgugagauucaaauuuaauaggcaaguuuaaaaaucggcuggcaugugcaucuauuauuuguguaugugucuggaugccuugcuccaagaguacagguuaguuguccgugaugaaauuuccaagaccuuccuguuuaucaggcccagcaguccaaaagcccaaauacccacaugaccuccuuuucuaggauuaugagagaaaaacaaguagaauauuaauaaauuacagugggaaauuauucuuuuguuaaagucacuuuuacaaaguuuguaggggauuccagacuauuucucacaucuauaauucugagccaugauaaauuaauagauuuuuguauaacucucagauauuucugaagaugcuucagguuucugaaucauuaaggcaagaucgacuugaaugguauccacuuuuagagguggcgacucucucuuaaugaacaaaauacuuggauuaauaaaaauuagugacccacagguuugacaucuauauggacauaugacauaggacauauguccacaucuauauggacauaugacaaaaucucugagcaugacuuuggacaauaauuuaaccuugaagagauucauuuacacaucuauacauugagaugaaugauuacacuugcugucacagcaugguaaagagaaaggaaaguguucucggugaaaacccuuuagauacucuaaaguagaguagaaaucaggcgucagaaaacuuuuaugguaaaaugucagacaauaaauauuuuaggcuuugugcauaagguuuuuaucaaaacuacucaacucugucacagcaagaaagcagccaucgauaauacauaaaugaacgggcaugacuguauuccaauaaggcauuauuuacaaaaucaggcucaggccagauuuggcccacggacuucaguuugcugagcccugauuuaaacacuaguucuugcgaugacugaacaacgugaacguccauguuaucgcauguauacaaacauacuaucccaauaugaauacacacaucuacaucauuuaccuucuuuaaaaauguccugccuuuuguaagccauugguaccuguaaguaaauaacauuauauugggggucuauagauuuaguugaauuuucacccuugccuugcagcaaagaaaaaaagucugaggcaacacauuugacaguuggcccuugcauauuauaaaaucuaaucuaaaugagaccaacacauaagcaccuuuauacauauaaaucuaguuuauaacugaauaucaacugaguuuauucauuauuugcuuuucacagcucugcagacaggaagaaauggcuaccagaauaacagcaacucugagaaguuauuacgagaggugaagguuauugcaaaguugaguuuauuaaagacccucauccccaaauuggagagaaguuacaaugaaaaaaaauaauaaaacaaaguggagauaauguccagugaugauaagaguggaggcaaaauagccaccgucaugcacugugggguggaauauaaguuggcacagccuuuccagaaagggcaauguguccguaccaaaacucuuaaaaauccuuguagccuuugaaacagaugucuauuucuaggaacuuauccuaaggcaguaaucagaaaugcacccaaagauuauguucagagauguucauugcaacauuauuauacugaaacauuagaaacaaucuaaauuaucaacaauuuaaggccauuuaaguaaacuacuguguuauagaaauucaugcaaaaauuaaggugauauuuuagaagaauuuuuaaugaauaaaauauauucauucauaacauuuuaaaagagacaaaaguaguuuacaaagcagcacuuugaguaugaugccaaauaaaaauacauuuuaacauuauggaaaaaaggacaucaaaugauaacaggagaccuggaauaauuacuaggauuaugggucauguuaacuucuuuaaacaugucugauguuuuaagguugcuccaaugaacuuuugaaauaagacaaaaguacacauaauuuuaaaaauuaauaucuuaguuaucuuaguuaaccagaaucagcuguacuuuaauuaauuggauuuuuuaaggaaauggacaauuucagcugguaucuaaggguccaguuuucauguugcgugccauacauaaucagucuaauauuucaaucuccugcagcaacugaauuaaacaaugaaacauccugccuagguguauaguuguucaggugaggaguaguggcauagacacacuugauuaggaaucuggugacuuuccuucuaguccaggaucgauacuuagucaucucuagccuugggcacauuucauaacgcaugagucucaguuuccacauauacggaaaggagauaaacauccgggcucagcuuaucuccaaagaguuccugggaaggucaagcaugauauggcuuucuccuuaucagugguucugaaaacccagaaccauaacauguuaagccaggggagccaguagaaaccacugccccauaguuuuuacaaugugugcuuuugguaacagcaacccauguuagcaaaucggagcuuccuccaugggcacugccagggcguccucagagcucugcuuuccagccacagacggggcugagcccucucugccgaggcagccguuuacucuugugugccauggagcccucagcucccuguaaacauccaucacagcacucacugcugcacuauugcgacuucucuguucgucucccuuggcagcacauggugaugcucugaucagagccuggucuucccucccuggguuucccacaaggucuggauagcagagcauaugcugcacagcccacacagcuguccugguaggaacugaggaaacaaggaagggagugcacucaacucuugacagauuuggagaagagggagagaaaacagcugauggagaagaggcagcaacguggagugaauaagcgcggagaugcugaagucaaacugcccagguucauucaccagcucugccuuuuccuggcugugagauccugggcacguuccuaaaucccuuugcauuucaacuuccacaccugugacguggggaucauaauccuaccuaacucagaggguugcugugaggguuaaacuugguaauauaugggaagugcuuagaauagacaccacauaauaauuaauaauucuucuucuuguuguugcuaggggaagccaaggcaggauauuuagguguuagcuuucuuccccuuguuuuugguaugagaagcucuugagcauauuuaggagacaagagaauguuuaccaugggauaauggguuuggaaggaugaaggcugcuuuaucacagaaggugcuuuaugguaaaagaaacucguccuacucgccaauaaugagauacaaugaugccagugguggaagaggugguggcugaggugcgaacaucaaacacagccacucauaacaaguacuagaaaacucaucucaggcuuugaucaugcgaaagucaauggccuacuaggcauacuuagugaucacauaggaaggaggaagcaaaggagcaucuguugagugcuuacuguguuccaggcccuggacuagaagagaacuugacuugcaucaucucccacuaacuucacaagaacucuauggaguaagcguugucccuguuuuacagacaacaaaacugagauucagagagguggacaggucacucaaggucaagagcuaguuaaugacagggcagagaguuaagccucagucuuuaugacuccaguguacaaguuguccugcaccacacucugcagcccaguagcaauuacagaaauuaucaaauguguauugggugaccuuuguugugaguuucauuucauuaugauaguauacuugauacauguuauuuuaggcuucagaacuacucaaguagccuggucaccuaauaacagcuuuggaaaacgcugaagaguccaucaaugggaaagagaccaaauggggaugcugggcauaauggaaacaaugcuuguuuugcaguuuugccuaagacaggccuuggauaugguuagcuauauuuccacugcuguuucucugcaacccaacaugccauugucuucagugcucucugcuucccuugcgcguggggugugacugcaaggugaaguggcugaucuagaacaaagguugcaggacauacacagcuucuuguagacagcuucucuccuaaagagcacuggugagucaguuguuuggggcuugaguaaagcuuucuauuaaaauaaaguuacagugggaauaaggcuuauggaauagcccaggcccauuggaguuuguuuugcccaccauacgccagcugcagaaguaauuggagaucuggguccuaagaugagggacugcauauuggaggaggaagaagcagcauccucucccuuucuuaaacucaggcaaauuauaaaauagguacaguucaauucccucauccugcuccuucuucugccugaggggacagaacagccuuaaucuguccugacccaugguccaggggcuaguguagucauuugauaccccauuucuggggccugaaggguccagguauaaagggaccaagacaggaaugcuggggaccucuuagcacuugccccaggcccccuuccauccagggcuguuucauguccuucccauccaagaggcucuacauuagccuacugaagagccuguuguaucagaauccguagaaucucugggacuugcagugugugcacauuguguguguguguguguguguguagcugauacagaguagccaaggccuagggguggguggcaggcagagaagcucauaaagugcagaguaagggcccaaagagcaguaaugggaagggggugaggguuuaaauggaaaagaggcaaaaaugggagggggugggaaggaguggguggagcuggccucccucagaaucaagcugggcucacuugugauuuaggagguaugaaguggggaaucagucuuugucuaccuucuguucccugcacccagaccuccuccacuuucuuaggguaagaaaugccuuugauagggguaaagccuuucuuuccagaguuugagaucagagacuucaauaugcaaagucuugggguaugcugacagaucagcacacgugcuuuuuauauuuaaauaauucucacaaccuauguggcuugucaggaaugaagaaucuaaagcuuauugugcuaggggagcuccgagugaacaaagggugccgaaaggagaguggggggacaauugcaucaucaauuugcagaugucagaaugucacauuuugguuagggaucaggcucauuuuacacacgccuaagcaacuggaaaacaugagagaguauuggggccaguugugauaggggccaaggagacugaaaugaggacaccugaggucuacuuuucaggcuaucuggugugacuuuggauaaguuauuucaccuccgugggccagaaggugcugaucuaucaaaugagcagggaacgugggaacucuaaguuugcccugcuaugaaucacucugggucuauguuuugggggacugagcacuggggagucuguguuagccaucuuucuucucauaguucuguguucuccagugggcuuuuaucauagccgucuucaggaaaggagcugcagggcauucacccgggugcaaaggaccagcaguccuuccagagaaagaaguaaagucuuuagcuaaagaacaaagauuuaacgguggaacuguccacuugaauuggaagggcugguagcuuuggguccagcaagggcaccccagauauuaaaucaaugaauaauauggagaguauaguauauuguuacuggcugaauugugcccauaccccaaaauuuauauuuccuguuuuuguuuguuuguuuguuuuuugagauggagucucacucuguuacccaggcuggagugcacuggugcaaucuuggcucacgucaaccuccaccucccugguucacgccauucuccugccucagccucuggaguagcugggacuacaggcacaugccaccauguccagauaauuuuugcauuuuuaguauuuuuaggguuucaucauguuggccagacuggucucaaacuccucaccucaagugaucugccugucucggccucccaaagugcugggauuauaggcauaagucacugcgccuggccccaaauucauauuuccaaggcccagccccuaguaucucaaaaggugaaccuggaacagauccuucccucauggcugucagaaggaaccaacccugccaacacuuugaucccagacuuccagucuccagaauugggagaaaauaaauuucuguugcuugaguccuccagucggugguacuuugcagccugagcggacgaaugcauauaucuuacaaaccuuucauaagaaaucuuuccucuguaggcccaaguaauuugauuucuuagugugaucugauaucguuugaauuaucacuuaacuugggggaauuaaauaaggcacucuggacauacgcagccccucaggaacacagcuuggugaguggaugauccuuuuguuugaaaaaggugccccuuccucuacgcagucacaccucacccugggacccuugauuuggcaagcagagccaaggcuggauuucaccucccacagucccccucaguggggugccuuuguacaguguccaaccugcccaacgaucugcagugaaccugcaugagaucaggaaccccucaggaauagggauuaucuuaaucuuuuuggaggccuaagacuuagcuuggggcugacucuccaagcacccucagccaacguuaguuguucgaacaaaggcagcuugguuuucuuuggggguugaagggaaacagggaauaauuucaccacacuuucagcucaaaagucuccauaggucucuacugccuucaggaggaagucuuaccaucuggcuuagauuggccugggcuaaccugaacuggucaaccaucccaucauuaccuucuaacacugcauccccuucauuugaagugauccacucaucguccucaaccacaccuggcacuuccugccuugcaggugcugcuuucuucuccuggauaccuuucccuguucuccuuuaacagcaaaauccuaaguugaccugaguccucuguaauggcucgagacaccuucuagccuuccagucgucugaauggcuaugguauuacugcaugcccugcuuaguccugugcaguuuaagauucuccccaccuauuccacagguauaugucuucuguccucaaacugcugggagacaaagauacauagcuuucuuuuaugucuguaagaggccuggcauaauacugccagugcacugagcaaguuagcaacaaccucauagaaaaugcuaaugcugaaaaaauuaaaauaauucaaugauuaucuauauucggacaaagcauucuggaaucacagcaagaaaauguggcaaaccuccuugagcccuugagccucugcaccucacacaggaucacacccacaccccccagaaagcugaauaagaccuaugcaaacaaccuuccagggaagggaucgacaaccacaaucagccuucugccuaguuaaucauaaacccaaaccugccgaagccaaguccaucgccagaacaaggggacaauuagcauugcccuuugcacacagcuacucacugggaaaaucgugcacugaucagugcacgcggcuucaacuuucuccugaccccagaagauucuagcgaagggcugcuugguuauagaaauagaaagcccuuaucaggaagcugucaauuucaugacaaacuugguaucggggaagcagauaaugggcuguuuacauagucuuaggcggaccaggauucaucuugggucuuaggguuucccaauuccagauauuucaaauauggaaaacagcaaaacaagucaaaaugauuuaauacuguauauauagcaauaaaaaaacugaaaaaguauuauuuucuaaaucuuuaagaguugcaauuagauuuuuuuuuuaaccaaaauagcacaacuguuccccuucucuauagaaaguuuucauuaguuccuccccgaccuuacuuuccagaggaccugguaauaaacaaaagaaugaucccuugagcauuuuucaucauagcaucaugcuuuuaauggagcagagaugaauccugggcugcugugacccacggguagaaaacacagugcuucuguguuuggguuugaucacccucauggagaaaguggcuccugaagacagauguaauuaguucuaaugucugaggccuuuggggauguuccuaaggcuuuuuauugagaaggcaaagcaagcagaggugagaucugggaggauaaaguagaaggcaaugagacccgaaagaguuuggcuuaugcaaaggaauuuccaugagcacccacaaacauugguccagguacucucuuagucacuguccccucgaggauggggaagaggaagcugccaacgucaccuggcugcugcaucgacuuccuccucuugccccaucauccaucucaguuuuagauuuaagccaggacugauucucuguggucuaggcugaugugcaagugagaaucuugauuagaaaacccccaaauaacuaaauaaaugaagucuguugcuuguuuaaugccuuuaaauagugucucauuuauaaaauguauuuacaaccuuuaaaaguacacuuugcuucuauggggacuuauggaacguucugaccuaaguccuugucaguagcuuugagaaggggaaugagguccccacaaagaaucuggggcuucccaucaucuccacuuaccuucaggcuggcuggcugaggcacuuggguaaugacuuuggggagacaauaacauguuuagcuuuagucuuuucucaagagaaaauuccaucuuggcaguguccaccagggauacucugucccuagguuuuggaguaugcucauuccccaugacuggcaaaguaaaauugaaccauggagccagaaagucugagucagucugagucaggcccuguaacccugcacaccaaucuguuucucaguuucccauccgcaaaauggggugaauagcuguaucuacuauguaaagauuguucugaggauuacaugaguuauuaucugcaaagcaccuagaacaauuccuggcacauagcgagcgagcacugucuaaguguuuaugaacuaacuaaauaaauggucuuaacuuucuaggugcugauuuuuuucucuaucagggaaaauguuucugugugcuauuuguggaauaagcaauaaugauagaagcuccaaacauagucacuuaaauacacuaugagcacuaugcgugugcacauacacauaauauauaaauacacugagcuaaacauuacuaucuuccccaugucaagcucugaagcaacugagaaauaaaccccugaaaucaaaugaagaaguaaauaccagcauuuugcuuguagaguugaguuggagaaagagcccaucugggguuucuuccagagcaugagaaguaccugcagggaccuacccagccagccacaggggccugcgcugaccucaucucugcugagcccugagaucaggacauagcuggggugggagcgggcccugccucaggccucauccagggagacagaggcagaggagaaugcaccauaucaggcaggcuguccccagaaggccucucucaaucucucccauuggaugugccucuccucucauaaggcggaagaaggcagaggcagauagaagcucagagcucuucucucaaugcuuccaaaaggguaggaguucccauuuaagaggcuggcaagaacuccaggagcaggcgagaaugauccccaagacacauaucaaugugaaauacauguguuuauauugugaaacagucaacuccagcuucagaagcaguuugcuggggaucauuguccccuccagacugaacacgggcuaacauguagcugagagcggguguagacaauagucuugaaggagcugauuggcgguuccgugguuuaccagcagcaccgggcaaaggaauguggcuuaccuuugaacagacgaaagaggguggaagcgucugcaccaggugugugcaggcaagggcauguugagagauaggcugggugguaaagagagguuccuucucggucuuacucuugauggaguccgcugguuuucuagccugcgccccgcaggagugccugaagggugucugguaucaguaaucuccuaucccuaaaccagcaggagcuggggaacauuuaacaaccagcucuucaggauaaacagcuuugacuuauaacaugugcagauuucagcaaucacugcugaucacuauaguuccucucacagcaacacucuauguuagagcauuuccaccauuuagagauaagaaacaagugcauauagaucuuuguaaacugcaauaaaauaauaaggcagaggcugggcgcuguagcucaggccuguaaucccagcacuuugggaggcugaggcgggcggaucaucugaggucaggaauucgagaccagcccagccaacauggugagaucccaucucuacuaaaaguacaaaagcuaguggggugugguggcgggugcccguaaucccggcuacucaggaagcugaggcaggagaauugcuugaacccaggagguggagguugcagugagccgagaucgcgccagugcacuccagucugggcaacaugaaugauacucuguuugaauaauaauaauaauaauaauaauaaggcggagauuauuuuuuagugauuuugaccuuuuuuuuuuugagacaaggucuugcucuguugcccagguuggaguacaguagcaugauuacggcucacugcagccucagucuccagggccagugaucuuucagccucagccucuucaguagcuaggacuacagguguaugccaccauuccuggaaaauuuuuguacuuuuuuguagagacaggguuuugccauguugcccagucuggucucaaacuccugggcucaagugaccagcccaccuuggccucccaaagugcugggauuacaggugugagccaccacaccuggccuuuguuuaacucuuaaguuugcauaauuuaauuuugcaugaugucuuuguuuaacugccagccugcaaaacuccggaaaauuaacaaucaagucuugugagaugaugcaaacagaaacuacucgaagcccauaugucauugcuguaggaaaagcaggcagauuuucaccugcaagcauuucccuucuccucugucacucucucccugucccagguggguggguggaucagacugaggcugcagcucauggcagggggcuggacuguggaugacugucuccucccuagccgggaggccagaggcacucaggugguucaaguugaccugcggggcuagcagggcagaguagggcuucccugcacuuuggucuccagcccugccucauugaggccaaugguuugcuuucucuccuggcuagucuccagcugugaaugcaucuggauaaagacaggacuggagccugagggugggaaaugaaaggggggcacaggaauccagucaacauugccugauuuacaggagugacggcucacaaguggguacacaauugaggauggguggaagugagaauaaggagagcaucuguggguaccaguuuuauggugucacagacuucuuuuguaaaaauaauaaacacauaaauuaaauauuaggugaaauauauuuuauuauauauguguguauuaaauuauuauauauuuuacuauauuuauauaguuuacauauauacuauauacuaauuauaaauauauaucaacauauuaaauaaauacaaaucaauaaacaaauaaauauuuagccuggcacauaucugcacagcaaaagacuguauuucccagccuacuuuacagcuaggugccuccauauguuuguuuacguucuggucaaugauuugucagcaggagugucugggcaaauuucagauccugcucuucaagggaaagaguagaucuuccccuuccauauucucucuugcugcuggcuggaauguggaugugauguugggggcuggagcacccauuuugagccaugagguaaaugccaggcauugcagaaggcagcccaucaggguagcagaaaccugguucuuugugauugugaagaugccaugccaaucuacugagacuucuacaagagagagaaacacacuucuaucuuguuuaagcccugauaauuuggaaucucucucucauagcaaccuaaccaauacccuaauacaacacaaugucuuuaugugugugcuauuaguaaucagagcaugucugugguaaaaguagaccucugggcauucuucaaaagacuuagaacugacuuuuaacucacuuucugcaucccauccuuuuaacuucucagaaagugaggaucaguuauauaguuagguuccugcccugaaaguacuacaguaugacagcaccaggcuuuuauuuucuuuuuaacuaggugugacuaauuuggagauuacuuuuuaaacauacaccuaagauguuguagcuaauacugccucuuccauccuagucacuuugcaacuugacauucuuuucuagugaugaugaaauucucagcauccaguuagaauucauacaauggugcauaugcuuuagaauagccucaaugucuggaauauaagugaugggucugauuuuuagaaacagccagaaggcauuuaagaucaagacuggugacaaauaaggugaccaaggaagcuugacaauaccugucuuguucaaaaaugaggugugauuuaaaaguaaggaggauuuacuuguuuagccaauaaacuaacucugaaagucauuucaaaaaagcagauccgaagauguuuaaaguaauaauggugcuguuagaauggugcucccucucccucccaggggaugacuuugaaggacacuacaauaacagauguguaaauucugaaauauauggcuaaaaugagguuuauuauuuucuagucaccacuuagacaucuuuuagucauuuguuuaugacaguuuauaaaugagaaagaaguccauuuaaaauaucuccaugaggaccucaagguaaauaauaggaaucgaucauucaucaaucuggccuggccccggcccacugaagaaaguuccuucuugagugcauucaaagcucucaugguccagcccuguucaaccugagcagcauccuaucugcuccucccccagacguuccgaugcccugcaccagauucaagagagagccaaguuccccaacaggcuaugcacguggcuauuaacacccagcacacgcuaucccuggccagcucucuccuucuucccuaagaauuaaacauucuuuggccugaguuuuccuccuuuaugucaccauaaaguugaguuauucauuauuagggucuauacaugaguagccaaaauauacgggucucuauauuuaggucaaggggccuucagcaggagaacaugaauaauuaggagugaggccaugagacagaggaagaaaagcucauaggaaugggaagacagccucucagaugagaggugugcggagugauugcugugaggaauugcucaauaggaaaguuagccaaccugaggacguuucuaggggaggaaaagggaaacucauaugguucucugcuaauucuuaaaaauaagguagauucuuacucaucuagggugcuugcucguuaugaacacaggaagauuaaggaaugaguauggacuguuucuacucuauguuuucggacaagaagaauaauaaaaaagcacuggguagcuggaacaacugcagaggccccaacaaugauggagacuuucuggugcaccguggcacaggggucucuuccaaagggacucaaucaaccccaacaggcaucaucuucugugacucaagauguccuuuuuaggagugcuuguacuuuuuaaugcucagagaaguucguauuacugauucgggaacacugaguuuuucagcuccuguaaaacuauuuucagguuuauuuucaaguacauucuuuaccucggggggucaaaucuuuugguuuccagugaauaucgugguuauaccugugguuacccacugacuucucaucugccuagcuuaucugauaacaggcaaauggggaaagaggcuuuaauaccccucaaaaggggaagauugauaauuaguuauucaccgcauagaaucaggccaggucaacucucuccaagaagaaaagcaaucuggauauugcacuuuggggucccuuuucauuuuggcauuacaggccucaugaggauguagucuuucuguauuucuuucuuucuuuuuaaauuguuauuuauuuauuuauuuuaaccaggucaaagcauuacauacugcagaagagaaagcaacuucagcuucucuuaaacggugucauuuucaugacagcucguaaauuuuggccuccuauggguccaggaucugcgcgcauccgcccggggacuuguugguggauccaucccucauggcggagcagcaaggggauccuuuagaaaaagcaaugggcgaaguaacugaaagagcgacgcagaaagcaacagccagaaacggcggggacgcgagcggcccagacaggaagggaggcgguggcgcagcucuggugcgcagcgcgccgcagcgacggaacuucugcaaaagcugccugcccgcgcguuaucagcggcgcgcaggccugugguuuucucgcucucgcaacccugcuuuaacugccgguuuauuuuucgacaaacaggaugccuccaucugaggcugucagcaucccaggcucuuugaaagaaaagaaguagagcggccccacccuagaggcaaggacggggucugugucaagaggcuucccagagaagugaaaacucugcaggugcagccgcugggagagcaucaagaagggcaggguggaggggcagggggcgaagggagggggugaagcccgcacccuacccccacaugaaacugauuccacuaccccaucucugcaagcguccagaggcagagaggccaacauuucggggacagcuuggaggcgggagauuuaggcagggcuccuuaaacuuuuaugugcaugaaaaucaggccaaucacggggcucuugagcaaauggggacgaugauucagcaggucugggcugaggccucagauucugcacuucuaacaaguucccaggugguagugaugcugccaguccaaagaccacacugugaauagcaaggcgucgucgggacagucugcuuuagaguaaaaccuaauagaugugcaaauauuuaaaccaagcuguauuuauuccugaggcccugguuuaacuggagccaccuugcuaauggaaaauggaaaaugaaauuccuuuagguuccaaagggaaggaaaguuugaaaugguuaagguauuuaaaaaauccuaguugggaguggccuuggggauucgggagaguugaaguuagguucugagccaagagaugggggaggaagggugggauguggcaaauaaauauaaacacacacacacaaaccccagcccaaccacagguucuuuccuaucaaugaaacauuugcaucuugcagguagaacucacacguguccacauuuuucagaaguugaaugguuuuguguaaugguacagaauuuggagcccauauuugaauauucuagauccaauguuaucucagacuggcuuuaggaucuuguggccuacauuuaaaaaugcauguuucugagucauguuuaauuaguaguaguaucugagaacugagagacuagacuaagaaauccaugguauaugaauaaaaucuccagacagcagcuagaacauagaggucccuccagaggcagugccaguugucagcuguaaaaauagguucugcucaguuuugcuuaggccugaaguuuccugaagauuucauuuagacuucaucaaaaccagucaaagacuuccuguuacagaaagguucuuaaaguauggcugggacuacagggcuauuaagaugcagauucuugggccucucugccucacucaucaugguuucucagggugggugccgggaaccugcauuuuaacaaacgcuuugaggauucuuauguacugccaaguuuaggagucccuggucugcagguuuaaguucaaccuucucacugcagcauucaaagaccuggcuucaauuuugcuguucacaggcgagccucagugacuuccucacugcccucugagcacuccuggagccaccuggcugccucauucauuucuucuccucugucuuuccccagcccuggaauaaaaugacuuccaucuuccucuccgaacucucuucagaucauggcuucccacucagcaagcaguuacuuuccuggucugccacugcugugguauuaaugauaggccacucgauucucauuuuguugacugaauauuucucaugcuuaggcuuugccucccugaccagacaguaaguucucugaagccauuucaugcuauauaaucuuuauguucaagacuacuuucuaacgcagugucauguccacauggaucauucaguaaauuuaccgauggcuuaucuaucaccaacauguuuuacagaguguuauuaagcagggacacucucuaugggucuaggaucagaagaagcugggaagagaaaugggguaguggugagagugucaugagaaucugguuauacagucaucaaagacacagaggaagugggaaaaagggaguguagaccccuagcucaucugucugcagugugaauuggagagggguuccuuuuuguuuaauauaguuaauuuuccacuugaaaucaaggucaccaaaccuaugagccaaacgauggaugcuugcccuucacacucacugccuagugauggagcucuugguggccucucuccaccaucucugcuccaccaucucuuccacucuggcuggcuucccuucuuccuuucugccugauggguugucaacucaaaugcccaacuccaagcucaaguuaaaggaaauuucaaguguauuacauauaaugaagcagacugaaagaacaguaguauacuaguaaguuagcuuaacaugguuuaguggaaagcagccaauacaccucaguucugauccuaacacagcuagcaucauuggccgugucaccuugguuuucuucuuuagccuuucugagcuucaaaauuuuuguuaucuaaacucugagccucaguguuuucauuaacagagccagcauaacaauguuggcuucuaaggcauugggcaggugagugggguaguuauggagaccaccugagagagccuggaacacgguuggugcuggcaaccuacagggccccagcccuuggcgagguaucuuucuggagaaaugcuuccuaguguuccuagccauuccuugccucaggcaccuucacuaccaucccaaucacaggccuacugcucuuccugguccagcuugcugguccuagugcuuagcuucucucuuaaggggaucuuuugaccucuguaggaauuucuuccgucuugggcuucuggcaugguucuauuggucaccuggcacccuccucaccacuucaguggugcccccaacucugcuucuaggacucuggcaaguccuacaaccacgauccugguaauaguacgagguuggauuugucaaccuugucacgaucacauuucuguucugcgcauugugggcuguuugguagcaucuuuggcaucugccuacuggauguuaguacaguccccucuaucccuugaguugugacaacuagaaaugucuccagacagugccaaaugacccccuuccuccucacacugccuccuucuuccagguaaaaaccacuggugaggccgggugcgguggcucacgccuguaauccaagcacuuugggaggccaaggcggguggaucacgagguuaggagaucgagacuauccuggcuaacacggugaaaccaugucucuacuaaaaauacaaaaaauuagccgggcauggcggugugcaccuguaaucccagccacucaggaggcugaggcaggaggauggcgugaaccugggaggcagagcuugcagugagucgagaucgugccacugcacuccagccugagugacagagugagacucugucucaaaaaaaaauaaaaaauaaaaaaaccacugguguaagauauuuuaaggugacaagcauggagaagaagagaaaaguaaugaggaaaaacuaaacuggcaagaucaauaaauauggucuaaauaaaugaaaaaggagauugacuaaauagacccaugggaaaugaaaccaggagauaaaauguuaaagaaaaguauaaaaauugcaaagauaagagggcauuagaucggcucaaaauggauuaaagacuuaaaccuaaaaccugaaacuauaaaacuacuggaagaaaacacaggggagaggcuucuugccauuggucugggcaaagauuuuuuugaauaugaucucaaagcauacgcaacaaaagcaacaguagacaacuaggauggcuucaaaauaaaaagcuuuugcacagaaaaggaaacauucaacagaauaaagacaaaaccuacagaaagggaaagaauacuggcaaaucauagcauuugauaagguauuaauuuccaaacuacauaaagaacucaaacaacucaauagcaaggaaauaaauaaugugauuuaaaaacugggcaaaggaccugaaaaaaacauuucucagaaaaagguacacacauguccaguaaguauaaaaaauacucaacaucacuccucaucaugcaaauuaaaaccacagugagcuaucaccucacaccugguaggaaagcuuuuaucaaaaaguuaagagauggccgggugcgguggcucacgccuguaaucccagcacuuuggguggccauggcaggcagaucaccugaggucaggaguucgagaccagccugaccaacauggagagacccugucucuacuaaaaauacaaaauuagcugggcaugguggcgcacaccuguaaucccagcuacucgggaggcugaggcaagagaauugcuugaaccuaagaggcagacguugcggugagccgagaucgugccacugcacuccagccugggcaacaagaacgaaacuccgucucaaaaaaauagaaaaaucaagagauaacaaguauuggugagguuguggagaaagggagcucuugcacacucuuggugggaagccauuauggaaaacuguauggagguuccccccaaaauuaaaaauagacuacccuaugauccagaaaucuuauuucuugauuuuuugguauauauccaaaggaaaugaagucaguaugucgaagagauaucugcacugucauguucauagugguacuauucauaauaaccaagauaaagaaucagccuaaguguccaucgacagaugaaugaauaaagaaacugugaugaauauauacacaauggaguacuauuaagccuuaaaaaagauagaaacccugucauuugcagcaacauggaugaacuuggaguacauuacacuaaauaaaauaaggcaggcauagaagaacaaacacugcaucaucuuauguauauguggaauccuaaaaaguuaaaucuaaaaagacuguacauuaaagguaccuaccauuguuaucugucuauggaaauauuuuuuaaaaagaaguuauuuauuuugguggaggauccacuaaggaacauuccugaauggaacaaagaaugaaccucaacacagauggaaucugucuuagauguggauguggcuaugggcacagaugggugcuucuaagugacugcaggccaagccuggcugagaagcauuuggguacagaggggcuuuuggggaaugaucaggggugaucaggagcaccagcuccuacagauuguuugacacaugccacaagccuugaaauggaaaaggaacacacauaugucauaucaccucucaacauuucacugaaggagauuuuccccuaaauagaaagauauggagaaagaguacugagaauaaugggcuggauaagugggacaauccuugcccuuacugaccuuccugaagugucgcugaaauagguggacuuagaacugaauggaaucuacucuaaguuauuuagcaaaccucuucuguuaucccacuaguuaccuuuuuugaagaggaaaaauaagaguugaguuuuuccauuaagaaagucuauuuaagcugauaaaguggaaaagagggcauccuuucuguucuuugauugauguccuguaaauaacccaaugggaaacggaccagacuuuaugaucagucccgugacuaugaauccucuuggucauagacauuuguuuucuacacagguauucaauuuaaagccugagccaaucagcucaugggcaguaagaugucccuugacugugguguuucucacaugcuucuccuugcacacuuguccagcuucccacaagggacaccuacaugacuuccagccuggcaccucuggacagaauuggaaccaccuccauguugccugcuccucucugcucuaauauucccacauacagcuucuuacccuuagcugaucacaggaauuaaggggaaccaaguuuggguggaaaucccaguuacuuacuuccugcugugguuguaugugagaggagaucaguguggccucuucugcuuacauccacugauguuuuuacacuuaagccauaagcacaggacuggugaagcucccuccauccauugguccaucuaucugucuauccauccaucuauccauccaucccucuaucauucauccauccaucuauccauucauucaacuaucuauccaucuaccugccuauccauccauucauuuccauucauccuucuaucuauccaucaauuuguccaucuguccaucugcuggcucauucauucauucauucaacuaucuguccauccaugcauuugccuauucaucuauccauccaacauuucuugagugcccaaauucugccaguuucuguuuuuggagagguaagugacauaugagccaucucucaaauugcucagagucucugaaagaacacacucauaaacagaaaagcuggaauuauguuuugguaagagcaaauaaaccagagcaagaagaagaaugugauccuuugcacgagcuaccaaugagcauccuagaagacauggucaucagagugucagccuggaaguauuacugcuucagggagcaaacgcagauggaguguguccauccaugucugugauggggaugugggauuccuguucucugucccucuaacaccucaugcagacacaugucccaacucucauaaccugugcaaugacuucucuugcugaacaacagcccugucaggugccuuuaaugacuacuaccagaaauuucgggagaaauucaaguuguucaaauaagcauggagaagugaccucccagagaggauuugaaaauaacacauagaaaaaugaaacuaaauaugcauugggauuucugaaacuuuugacuaaauguauuaucuauagguccuugaaaucuaucauuaucuugucuuuuagguuacuuuccuccuagauuuuuaaagucuucaaagaaauacugaugauccccacuaggaaaagagaaggaaaaugaguuauucaaaaucaggcacugggaggacucagaauuacagcauuauuauuacuuccaauaauuuuaaaagaguuaagggcucuuugauuaccaaaucauuauccuacuuccuaugucaucuauaacuagacacgaagauaacuuauuuuaaguuuauuucacaggacaagaguaccaaagucacacccucucuagaaggccuucucuugaaaaaugcacagcuuauucgucaggcacccagacuucaaaaccagacuaggauugagugcagcccugccauuucccagcugugugaccuuggaugaaauauuuggccacucuauagcccagucaucaaucuguaaaauuagggagaguaauugucuccacuguguagauaacagagauggcaagccuuuguugcgccagcaggccagagucauggcugccuuuucuucucugcucuucacgucggggacauggcugauggucuuaauuucaugcccuugcacacugacugucaguuuuuguggacaucuguagccagcauuaguaggcuggggugggguagaggucaaauuaggugugugggaggcaaacaugcuaaagagggucaaacccgccacaucauuuuauuucuuugugggaagcagcaacaguaccucgguuccuaaggucuuucuggagcugugguucuccaaaaaacauuccagauuuuaccccucaggggucaucuggcaaugucuggagauacauuugguuguggcaacaugaggagggaaggguugucacuagugucuagugggugugggccagggaugcugcuuagcagccuacauacagcacagagggcaguccccucaacagagaaugauucgguugcaaaugucaacuguggcgaggucgggaaacccugucuggugugagcagagggcagauccucagccuccaugaugccuuucaccuugaccaugggagcugaguaaucccagccacuagcucucucauuuuacccgagagauguacaggaggaagaucaggguacaauggcacaucagccagggcugagaccccuacucagccugagucuguuccuguuauacuccccaccucaucccaagcaucagccguuugcugccaggagugaacagauccaguguacaaggaugcauuagugaccacgcgcacucacugggauaacccacuugggguucacuuguuagauuugguuuggguaguguguaaggaagaaaaugggaaaguccagucaaauaguguccaauuuaaaaucaaaucaggguggaaaggaaaaguccaugaugauagcgaccauguaucgggcagcauauucuauguauuucugauucagugcucgcaacagcugcauggguaaucaucaucgucacacuguacagaugaggaaaagggagaaacagaaagggugaguagccuguucaaggugacucagcgggaaaggacagagcuggcauuugaacacaggcucucagaccccacaggcugcaccuguaaaacucuccuccccacacccugucacaucacagagaggccagaugggagugggaaagccgaagagaaucuggacuccaaccgaguucugccuccuagaagccguguggccugggcugcuuuuguaaccugguuuuugcuucauuuuauuuuuuauuuuuagccagugggaauuaguagcugugccuauaucgugagguuuugauuaaaagagacaauggaggcagugugccucacaccauugcaagugaauguuauuuguucucauuauucauaagccacaaugaaacggcaucaucucauaacuuuagugggucagccagaauuguucacgacaacagugcggaggacacgggacagcacuaaggguuccucccucucccucucguuugacgcggacuccagauucagaacccauguggggcacaggugggggcuguccaggcucacugcaggucucucucugcuuucugcuccuucaggucacgugguugugauugaaaagaggaauagagagaugugauguggcuguuuaaaacaacuccaacugcuuccauguaaaugauguguuugauccuaaacugagaggguuaaggguuggaacucugggccuccccagaggcugcugugggucugggggccaggacuccucaggaagaacccaaguugggucugaaggugacaguggaggccauuaucccugagggaagacagaagagggagcagggagcaggugggccaccgagcccuggcgugugugcagaaagugcuaaauaagccggaagaagcacagcaaaucacaaggaugcccagaauauaaucucuaguuuauagcaugaaauuuuuacuuuccuguuaauuguacauucuguauaagaaaagcagguuccuuuccuaaggagcuuuaugauuuuauuauauuauuauuguuuauuguggagaauaauuagcuugcacaucuuuuaauuugucccauuaagauguuugcagagcagccgugagaggcuggccagcccccugcauuuccauugaucagggcacucacauggcuggcugugagcaggcuuugcggggagaaagucauuuaugauugcauccuucagcaugccgaaccccuccagaaagggaaggaacuuucugugacucugaaguagucuguuguagaauaaccagaggagaaaugccuuuuauacaauaaaggugaagggggaaaagaaggggaaaaaaaccccaacuucuugacaaaaggaauuaucaugaugucagaggacuggugacauggacuuugugaaaugacaaaugccucugcagaaaggccauucucaaaggccaaccaguaggcgugugcaucucaacucuuguuaugccacugacacuuagugguaugagguccuguuuacaugagugacugaggccacugcuugcuaucacagcugaaacaacugcuucuggcuacgauuuuuauuuuagccucaggaauaaguggaugagaaguguuuggggcaagcuucacggaaaacccuggcuagggucagucaggguuggggugguccaccccugaaggagggacucagguggcaggccccugauugcuggguacaucacucugugguuucuucuguacauguguuccauggccuggacugggacagggcaagagauauaccugggacacaaaauucaagguggugcgcucucaagcccauguaaaugcaaggucagccuuguacaacaaugggagcaagugucgccuuaaguuugucacaggaagugccucauuuaugucacccugauaucaccuucgauggauucucagauugauaaaugaaaacaacuggucggucaggaagaaggcauagcagugguuucuccccaccccagcaugucaccaucgucuugggaacaaguuugagcaccccuggcuuaaaggcguguuucuugugggcugucugggaacugccugaacaucucucucaguucugaugggagaaacacgugggcaggagaggucuggauaccagugguggggccauaaagccaccaaaugcauccagagucagaaaagcaguccaggaugguggccagugccccagcuuggugccaccccacagcgucgccuccuguccauggggccuuggcaagccuuucgcucuguaaggcuaaacucccucaugugccaaacagauauucucaacaccgaccuguccccuccacgggcagacagacagugggcucugcugcaggaacugccucuguuuggaccgcaccuccaccuuucccagcagccuaaccacaagcaggucacguaaccuuggcaggccaugcuuccccuucacucagugggauuaauaaugagagcaccuacucacaggguugugccaaaauuuuaauacaguaaggcaagaaaaugcuuggaacggugcaagugccuugcgcauagcauaugcucaauaaaugcuagcuguuauuacuaucgguuuuaaaguucauaaacucagccuucugccaaagagcaccaagaucacuucugcacugcuacaugaugagagaggcagacauuucuuuuuuuuuuuuuaucuucauacaugcccaguuccuggaacagcuucggggccacguucuugagguuggcggagauggcuuuccugucccuagccucccuuugguggcauuuucagaguuaccuuguacuuauugacuuccucugcguguccauugcuuuauacauauugucucaaauccucuugacaaccauacaaaguagggcucauuccccuuguuuacagaugagaaacuuggggcuccgugagguucgauaaauggcucaaguucacacaggugguggaugauggugacagggagaaaccaauaccucgauucuaaagcccacaggcuuccugcuccccgaucccaccccugagcuugggccuaucuuccuccuggccucccuaucaaaggcaacucguagaagaagccccuggugauaaagaaaacacgauuccuccuggagcugaguggaguuuacacuucaacauggacugaagccuccagggaaagaaauaaaggucuguagagagaagcuacguccuggugagcagagacaugacagcagcaguuucugcuacaccuagagaaagcuuccuugaauucaguacauccuggggagaagucccaauggauucccuaagcaugggaauuuugaaugcuggccucucucucucucucucucucucucucucucucucucucucugugugugugugugugugugugugugugugugugagauagagagagagagagagagagaccuuuauuucuccugagaggccacuucugagcuuugaaucaggagugaugugagcauauauaucccuaaugggaauuauaguuuggguuccaauuuuuauacaaagaucucccacuucccagggcuccuuccagagcugaagccuggcagccuuggccgaggccaucucugaacccucugcauggaugugcacauuggcuguuguggugguucaaauuuugcccuagacccucaucaaaaccaaccugguuaauuguaacauugccuaaggagccaggugggcaggcacauggugggugcuuaaccaagguggugcuggauuuuggggaagagagaacauccaaaugacagcaggggccgguuacuccuauggcaacugcauuucuaacacagccuaaggacguucuuaaggacucagggauucauauacauugcccugccuaaugaguucacaaggugaagggauuuaaccugcaaaggauugugguaucugagcaaugcaaaggggaauugaggaggauuaggagaagugucugcuaguuaugugcaugcuugaauggaauccaccucauaaauucagugucugcaaaacugugggugacaggagcugagaagaccugguuucucguucggacucuggcaccaaccagcuauggaacccugggcaagugaaccucucuggugcccuaagguagagaaaugucuaaaaaucacuccagccaaauauucggcucuuccuuucuagcaguuuaaaaauauuuauaauuauagauuuuaaaaaauaaaguuauauaauuuuuagaugccaacugaaacuauacagaacuauauauauacauaacucuauauaacucuaugacacagcacauaaaacuuacaaagcaucauauagaacaaugucucauaguucauaugucucaggguucacuuauuuuuuaaacagauuuauucacaucuguaauacaauuauuucuuuguuuugaauacaaccuggagggaagcauaugggagacacagccuuuauuuaaaaaaaugaaguaaugauauggaaugauugacaguuggauagaauuuucauugucggcacuucuacuucuuuauaugacccugcaccuuucacagugcuaauauuuguuuaagguugcuuaacguuguuccucuccucuagaacuuuggaaguaaaagccauucucaucuuuagaaacaguagauucaauaauaauaaauaauaauaaacuagaagccugaguuucuguuccuaccugucagucaaugccuaaauaauuucauuuucacccauucacccauucauuacaugaaaggggcugggauaagagagaacacuccugaaggggaggacuacuuuuucuccuccuuuuaguuccuacccacucuugcauggguuuuauacacauaugugguuucagauuuuaugaauucuauacuuucaaagugggugaaugucaaguucagcugugacuguuaccgagcuggaugaagcugcccagaugcagccugcagaugguguggaaugaggggcucagugcacagaguucaaagugcaaacagaagcuguguaagaaagugcagcaaacugugguugguguuaaaacugcuccugaaaaaaauggcacucaaaccaauguaucuuaguugaccuaaacucucuuuugcacauucuggggcaguaauaagaaacaaacauugauagcuauacauauuauaaaauuuugcacaguaaaaggggaagugcuucucucuugagcaaugagugccacucugacauuuuuugucucccuuaaaaaacucaccuaggaugggccgggugcaguggcucauaccuguaaucccagcauuuugggaggcugaggcgggcagaucacgaggucgggagaucgaaaccauccuggccaacauggugaaaaccugucucuacuaaaaauacaaaaauuagccgggcgugguggcacacaccuguaaucccagcuacucaggaggcugaggcaggagaauggcugaacgugggaggcggagauugcagugagcugagauggggccacugcacuccagccuggugacagagcuaguagacuccauccaaaaaaaaaaaaaaaaaaaaaaaccaacaacaaaaacucacccacaauggaaugugacuauggaauacccugcgguguguucagagcucugacuucuguuugcucuuuuuaacauaacccccaucuggcaagcugacugcugcaagauuuucugggucuuucuuuaggaucuacuaacaaugaaaaacauauauaugaaaaccuacacauuuucagaagcacaugagagcugaucaagacccacguaccucccaaggagaggagaugacagaggcugcucugugguguugcucucaggcuauauuugauuuauugcucaaaucuuauuauuucauucuccauucgagacuagcaaaguuucuuuugagaagucacagucucuacggaggguauucuaacgcccagaaguaaaaguuggauguuggcaaagaaagcaaaguagaaucuuugcaaaauguuggagcugcauaguucucucucccaauggacauguuucaagacugaauacguugaguauuugauuuagaaucaauuuaacaugaacuucgcauuuaugcaaagcagcaucaguccugagaucagcagagcgauugagcaagcccaacuagcaaacugagauuucuauuugugaugaccuuucccauuugaggccccaaaaaugucuuggggaacucauuguuuaaaaagaaguccaucaaaaaauggacacauauggaccauggcaugggagggcagugcugcauacaaaaucaacaauucucuaaaugaacaccgaucuugcagaaaaacaaaaugaaagcaaaacaaaaagaaauuucuaauuucaagagaaaaacugaauaacaacuuucuuuucauucauccuuucuuucuucuuuuucuuucuuucuuuuuuuuuuuuuuuuuaacgaagcaaugacuuucucagggagaaagauuugcauccaugcugaggaaauagacagggccaguaaucacacagcaacaaucaucuguaacuugcagaaauucaauguaugaauaaguguuuaaagccuagauagagggcaauuaucugguuaucuguuuuucauauuucuaucagagauaaaaaccucuuuagggaaauuuaugaagggccauuugaaagaagguuucccucuuuuguagaaaagaauucucuuaaaaauuaaaacaaauuugggaggcugggggauuuuugagaguuuaaaagagugaggaagauggggggcgggaagcaacuauuuccagcugcgagaaaccgaucaaccucacagcaaggugugguggcucugaugcaagcaacauucccauagauacagggcugucugguuuucuauugcucauucuaacuugaggagacgcucaagugugauuuggggcuuugacacugaaaauaggugugaacuuggauccauuuaaccuagccccuucccccaccucaucccuucuccuguccaguuugcuuucaaugggucaacaauaaauauucacccuuggcauccaucugcaacuuccaagagggaaugaaggaagaacauaaaguuucucugcauuuguuuccaaagcccagcuggcacagaaaacaaaugauacaagauaugacugggaaggcacacagccugucuuugucaccaggucuggcagauguggcucuggguucacgagacaucugcucccagcuaccuuccucucugcuucccuccacucuccaggcuggaaagugacaacuccauuguccucaguucccuccagccagaggccugugaccuaguuguggccuaagcaauaugucagcgaaaguuugcagagaagggcuucccuuccugaauaaaaauaccaggacccacaagaagggguugaggccucccauguccuuucugccuggacagaucagaggugcaggccaucucucccuggccucagcauggugggaccaaaacauaggaguguccugcaccccaccguaucagccuggacugcucacucuggaacuccugcccgucugcucaagccacuguggucagcuuuucucuacgugcagccaaacauaauuuucauggguaaaccugagcaagggccuuacucuuucugucacugcaauaaaauacauaauuuccgucauguuucggauuuaguguuuauuccuccaccuuggcuccuuucuggcaucauuacucaguguuauugcaagaugagggagggagagaaagagagagauucagagagccaagagaguauaacacgugucuccccaacaaagagugaagccugcgcaagugagagcagugugucugagcuuauccucccagcauguugaaggugacaggagguuuugagcccuguuuuguguucaagagccagccuguguucucguaaaguacucccugauuguguucacggucagcaaagaucucaaaggaaaugcucccuuuuuaccacuccaggacauccuaguuauuauauuuuaugagagggaagaggucaagaaagacauaccucuuugccuuggcuggaggcucagcaaaaaggcuaaagaaggggacugguggcaucugauggggaggagcaggggaggccgagaaacaagaguugugggaaaagugcuuugaacauuuuaauaucuguucaggcaccaguguagcuucugaagauuucuugaaaaaugggaguuggagaaagcaauuacgaaaaugagggaaaauaucuugcauuugugaaaugaugggagaacuauuuucuaaacagaaaauaaaauauuuuuaaguggcuuuguguuauuaagcuaagaagauuugugauguguuuuaugguaccucuuucugaugcauguaaagacuuccaacaggaacuugguaauuuagaugcaagcuugucuagaauauuauuagcccauuuugcagaacucaaaugagacacaaagacaucuauugacucaucuaggucacuaggaaguuaccugagaaacugaaaauuugcuugaguuuccugugugggccuccucugcugccuccaacaagacaagccaucaaagcuaccuucaugucugggcuuugacaaaguacaugauuacaaauguucccaaggagcagggaaaaugggagucucucagaggcccagagaaccugcucaaagguauacaggcaaaauggccuuuuccuuaagaagagccuuggagaaaauaaagcuacaccagcagucucaaugaaaagagacaucucuguuguccuuguguguucagaucaaagacuuagcaugacauccugccccaacuagccuccauauuuaaaaucaaaacuuguuaaguugaauuucauaaagggcucucguucuuuuuccacaagggaaggaaggcugaccugcuggugaaaagcccuuaggguggacugaguuacccacugcuguccaugcccaugugggauccugcagcucuaacuuugcccaggcuguacucucggccuagaccacucuuccuucuuuccuuuguucccaacuuccccucccccaacuccugugucccucucuccagggagccuccuguaauguccuccagggcauugugaccucucccucccuagagcagacagcgguugacuggcugccuucuuagauaacugaacauugauagccaccauucagauuuauugcuuacuuuauauggcugggcaaagcaccuuacacagauuaauucgguccacacagcuaccuuaauaacagguacuauugcaauccuuacucugcagaugaggaaacuaaggcucaagagagaaguucuauaugcuauuugaugaaagccagaaaaaagaaaagaaagaaaaggccaucacugugucaucugagcacauucccugcacagaccuccugccauugcuuucucuaauagcaggugcucuuaugccuccagacucuucucucuaggccuugggcuccuuauuaaagucugugugugcacagcggcugugcagccguccucugucccagcaucucaccaggcuugauuucucaguaaagggcuacauauuuucugagcacaucuuucggaucuauuuugagagaauguaggaacgucucagcuacucauuugcuuucaaaagcucagaaaggcuucuugccauucagaaucgggucaguugcuguuuccaaaggugcuucugcuacugguugcuccaugccccuguacucggugugugagcagcuguggggccuccuacagcccccuaaaccccacuaauaaagucagucugaaguacaaagacaauccuccccaagaaagcagagccaagaggagguuucuuuggggcggcugccauuugcucuuuuaacacuuaaacauuucaaaauuacucgucauuuucuacaguuucuuagcgugcaaaaagucuaaauggcaaaggcaugauugugaguuuagauaguuuuaucacaccuuuuuuuuuuauaguuucaaaaugugugggcaguuucagaugugaaacuccaucucacaaaggaggaacuacagucugauucuuuaacauccaagagagcagccaggaugccccaucccacaguuuccuugugggccagggugggucagauuugcuaagacccacuguuagggacugcaguaugucucccuagaauuaauacauugaaguccuaaccccaaggugcucauaauuugacacuauuuggacauaggguuuuaaaaugacgucauuaggcuagccccaauacaaugcaauugguauccuuauaagaagagauuaggauacagacacacacagagggauaaccaugugaugaaacagggagaagggagcugucugcaaaaccaaggagagaggccucaccagaaaucagccuugccgacaccuugaucucacaccuccagucucccuccagaacugugugaaaauaaauuucuguggcuuaagccugaagucuuaagaucuuaaguguucagucaagccagaagaagugucuuaauaaauauucuucugaaaagagcggcaagccgaugcuuagagaagaacauacuuuauacaugcagcuuuguacuuggcaauucccuuugaaagacugcuucagugggguaaacuugaaccgcugagaagacaagcagggagucggucucgcugagauuuuuaccugugguucuaggaacgcagaggcaugugaguguucaggcuuugcauagaccacuaagccacuucuaagaacaaggcuaccugagccauuuugcaaaaauauguacgugccgaggcuuuuccuccccacaccuaccucaacucuuucugccgacacacugcacuuuucaagggaacccaaguuuggguucggcaagaauuguacguugcacaccgugugugauaauuccagggaauuucaaucgcaucuugucuuccuuccuaagcaaauucggugggaaccugguguggugugauagaaaaagccccgaguucucugugguagaccacaucaauuucaugugccagucucucagacuccggcuugccucucucaaggaagggaacaaugguuugcuuggcuucacuccucucuuuccccccaauuuccacauggguaucuggcuaaaaaugaguuacagguuuccuucugugagaauugcauggacugauaaaguaccaucccaggaagaaaacaaagaugcugucuucccuuucggcucacaguugccguuggggagggaacacacgcuguaaauuauaggcagccagaagugaccgcauugaccacugcgaguggcccagcuauggcaacaggcugagaacucugggggagagccauuuguuggcagggauggugauucuucuagcaucaagcucuaagaugaugaccaaacgguaucaaaagaaaugauauuuugcuaccucuccggcuugggugaaugauguggacaguuaaccuggacaauuuaaaccuuuauguugauggaucacuuggaugaaauuaaccaggaaauugccaagauuucacuuggcccucugacaucaaaucucaauauuauauuaccaaauuagagauucuaaagaacccugaguuccuuucacugaaaggaaggaguggaaaaaccuuuccagaugaucccuuuugagucuuggugcgagcucaggcccucccuacacugccuccgugaaagcuaaccgacccuuguuccuaaccuagcgcaggucagcugaguguccaucgggcacaggagcccugggcuuguccgggagauagccagacuccugcuauuuccugaugucugcauagcucagcgugucccucaccaucuuugccguuggccaguaaggagagccccaggggccagcacugcacacugaaacccaaccuauugcucaauggaaugcuuaaaaauuuccugaaucugccuuccugaguugauaaaauaggaaacaauacacguucugaggggguacugaaagcagaguaaagccaggaagaucuuuuuuuucuguuauucuauacaaauauugcuuccucugcuuguuagcagcccagaggaaaugcagccagggagccguuugcagcuuuucaccaguggccggugucucuguguuaccaaccaaacgacgcugcaagacuagugacuaacgcacgucugcaugauucaacuucacuaaaauucccucugcugccaguaaagaagcacuugaaaacucuuuaauuugaaacuugagcuugguuaaugacuuguuuucuucucuuucucuuuaacuucucucuugccaucuccaacacacacacacacacacacacacacacacacacacacacacacacacucucucucucucucucucucucucucucucucucucaucaaguuuuuuaauuucagggacccggaaacauacagccccgugcauucacaauagcauuugcugugauaaaguggccggcaagcccucugcauuccccugcucacuuagcuguaugaauaaauaaugagucacagauacaauuugggugcucaagagaguuuguagccagaaaauuaauuauucucccaucccagcccacuccaucucagcuuugccaaaccaucaagauacacuuugcaggcacuggucagagugcgugccccgacgcacacggcaaugccuuugagacauuuuauguuauuauuuuuguuuguuuaagcacagcccucuuuuaccacgaaagauacacaagacgcacaugcacacacauacucacacacucacagcucaaccacagcuuuguccauuucaagaggcugguuucaaaaauggagacagguuuuccacccuggcuguuccuauucauaagccuguaaucuaacgacuuaagcugcgagaaugcuuaacucgggaaacuucucuauugcccuuuuccagagagaccucgguaugccacaauuugcuuccuuucucucuugaaagaugcugguugucucuuugcauugaggcuacaaggaaaaacacagcacagccccaugcugaugauuuuaaccuaaccaagucugucagucuccuguacucucugccuuauagagacagcugccuugccacuuuggcccugaaguccccaggcuggugcaaggcuaucugagagccuccgccuccugccccacacuggcaccagcccuccuggcuggcucugugcaugugccugcuaagccccagggcaggcugcauucugggccacacagcaugccgaguuaaggauaacucagacacaggcauuccgggcaagggacagcaaaauaaaacccagggagcuucgugcaagcuucauaaucucuaagccuuuaaacaagaccagcacaacuuacucgcacuugacaaaguucucacgcaccgacugaacacuccaacagcauaacuaaguauuuauuaaaacauuucugaagagcuuccaucugauuaguaaguaauccaauagacuuguaaucauaugccucaguuugaauuccucucacaaacaagacagggaacuggcaggcaccgaggcaucucugcaccgaggugaaacaagcugccauuucauuacaggcaaagcugagcaaaaguagauauuacaagaccagcauguacucaccucucaugaagcacuguggguacgaaggaaaugacucaaauaugcugucugaagccaucgcuuccuccugaaaaugcacccucuucugaaggcgggggacucaaugauuucuuuuaccuucggagcgaaaaccaagacaggucacuguuucagccucaccccucuagcccuacaucucucuuucuucuccccucugcuggauaccucugggacuccccaagcccuauuaaaaaaugcaccuuuguaaaaacaaauauucaaauuguuaaagauuaaaaaaaaaaaaaaagccagcgccgccuuggcuguggguuggugaugcucaccacgcugcgaaacccugugguuugcauucagugugauucguccugccugcugaccacuaugcuggguucagacuucugacacugccaggcuacccaacuugugguucugugguuguuuaugaggcccaaagaa

SEQ ID NO: 21311 - RNA, 41406 nt, Homo sapiens
gugcgggucgcgcuuccggcggcgucccggggccaggggggugcgccuuucuccgcgucggggcggcccggagcgcgguggcgcggcgcgggguaaguggcgguccccacggggcaaguggcgguccccacggggcagcggccuagagaggcggaccccgcaguguccgggucccgggcccucacccgcgcccacugcaacccgacuccggagcuccgagcaucccuuaguuuuaagucauggcgggugcgaacgggucucugcugcaggcggcuccgugacagcuccugcuucacauggguagaggagagacggcaaacgucggggcucccaggacuucgcggcggcaguccuaacccgugcacugagucgggcggggcgggcggcagcgucugaguagagagcucucuagaccaggccuggugucucccgggcuuuccuaggugccuguuugcgagcuggucagcugggcuguaguugaguucucccagggagugugggaggaaagguuaugcccaccagagacccaggguccugacggcuggagguccgcaguggggaaggugggcagagguguugcucagauguccccauuccuguuucguuugcacagagggguuuucuggugcguccugguccaccauggccaaaccaacaagcaaagauucaggcuugaaggagaaguuuaagauucuguugggacugggaacaccgaggccaaaucccaggucugcagaggguaaacagacggaguuuaucaucaccgcggaaauacugagagugagugagcuaccugugucuuugcuaggcuagagggaaaugcagagaaggcuggguuuggucuugcaccagguucugugggagacggguugcuggcaacugucuacacaggaaugcugucuccaguacuuggaggccgacauguccuuccucaggagacuucgaaagucaggaucuuggugaccugguucaggcacacuugaguuacuauucagauguugaugaaagaaagcccaucuuauagaugaggccugaguaucaucaucuucacagguaaggauauguccagguguuacaugauaagaugugaguuccugggagaaguagguucuuuauuuuauuuuuuuuuugagacugagucuugcucuguugccuaggcuggagugcaguggcacaaucucugcucgcugcuaccucugccucccaguuucaagugguucuccugccucagccuccugaguagcugggacuacagacacgugccaccacacccauuuaauuuuuguauuuuuaguagagauggaguuucacuaucuuggccaggcuggucuugaacugcugaccucaggugaucugcccgcuuuggccucccaaagugcugggauuacaggcaugagccaucgcacaugggcuaggucguuaucuuuuauguguguuugugucuuugucacacaugccuggcauuguguuuugcccaugaguaaaugcugaauuuuugcacuuguaaaguuuucuacuuagaaacaacuaaaacguucaucaacugaugaauaaaauauaguccauccuggcugggugcgguggcucacgccugucaucccagcacuuugggaggccgaggcggguggaucaccugaggucaggaguuugagaccagccuggccaacauggcgaaaccccgucucuacuaaaaauaccaaaaauuagccggucauaguggugggcgccuguaauuccagcuacucggggggcugagacgagaauugcuugaacccgggaggcggagguuucagugagccgugaucgcgccacugcacuccauccuggggaagaagagcaaaacuccgucuaaaaaaaaauugugcaguuugaaauuguauuucauguuauguuuuaucucaauacaacauuugcaguugugaaaaaaaauugcacauucucaacuccucgggauggagcaguaaagccccucaguaaaucuuuuuuuuuuuuuuuuuuugagaccgaguuucgcucuugucacccaggcuggagcgcaggggcgcgaucucggcucacugcaaucuccgccuccuggguucaagggauucuccugccucacucucccgaguagcugggauuauagacgcccaccaccacgcccagcaaauuuuuuguauuuuuaguagagacaggguuucaucauguugggcaggcuggucucaaacuccugaccucuggugauccaccugccuuggccccccaaagugcagggauuacaggccugagccaccgcggcucgucaagugaaucuugauuccagaaagaucuguuuuaagucucuagucuggaaaaugcagugggagucuuuaggugguuugugacuugcaguuaaggagaccguggccugagcacuggccccuuuuucuucuuucaucucucuccaggaacugagcauggaauguggccucaacaaucgcauccggaugauagggcagauuugugaagucgcaaaaaccaagaaauuugaagagguagguuuauccaguugagcuacuagagagaggcacguagacuauucagagccugaguuugcuuuuuuuaggaacaugguugacagcugacugccgaugaucugguuugcacuuuuuuuuuuuuuuuuuuuuugagauggagucuugcucugucgcccaggcuggcacaaucuuggcucacugcagccucugccuccuggguucaagcaguucuccugccucagccuccugaguagcugggauuacaggcacgcgccaccacacccggcuuuuuguauuuuuaguagagacgggguuucgccauguuggccaggcuggucuugaacuccugaccucgugaaccauaugccucagccucccaaagugcugggauuacaggcgugagccacugcgcccagccaguuugcacuguuuuaggggaauuuagcuuucaucguagugauggggaagcuacuggaaaugccccgaauacaaccuugagggaccaaucaagcguggaaauggggagcaaagggauuaggcuuuucuagcaacaccagaaaggauuucuaugccgagcgggggugcgggggcuuaugccuguaauccuaggacuuugggaggccgagguggguggaucacgaggucaggaguucaagaccacucuggccaacauggcgaaaccccgucuguacuaaaagaugaugagccgggcaugguggcacaugccuguaaucccagcuacuugggaggcugaggcaggagaaucgcuugaacccgggaggcacagguugcagugagccgagaucgccccacugcacuccagucugggugacggagcaagacucugucucaaaaaaaaaaaaaaggaagaguuuguaguggcugauagaaacgcaugcucacucgcucucuccuguuacaaguucaggccaagaaaaaucaagaaaggguuuguuccacagagaacaauccuaggcacgcuggucuuggugccauuuugggagggugacuggucggugguauugggcgaccucacggacauagaaauauuuauuuugggcaaacauugccagacuuuccugaugacuuguggacaggacaggaaguggucauuuugggagugcagguugcugguagagcaccugagggcucugcccuugccuugcccagcauuugugugugggagagcagugagaccuggaccucucaugcucagaucugcuaagaggagagugauugcuaccucugcagcagcucaucugaaacgugcuggccguacgcuaccaaagauagguguaaagaacagguguccuuagccgggcgcagugguucacgccuguaaucccagcacuuugggaggccaagguggauggaucaccugaggugaggaguucgagacccgccuggccaauguggcaaaacccuguuucuacuaaagauacaaaaauuagcugggcauggugucgggcaccuguaaucccagcuacuugggaggcugagggaggagaaucgcuuaaacucaggaggcagagguuguggugagcugagauugugccauugcacugcagccugggcaacagagcaagacugucucagaaaacaaaaaaaagaacaagcguccugcauccuguucugaaaguuguuuguguggguacggggcagccugugaguggauaaauaggccuccgaggcugggauggucccgggcccuguguccacggaucuuugcagcucagguugcaacgguaagaguauugucaaugagacaaaggaggugagagugccaguugucugaauugguugggauguuggucagaugacaucuaaaagaacacggccauuuuguuauuauuugguuagagacaaggucucacucugucacccaggccggggugcagugucacaaucauggcucacuacagccucaaccugccaggcucacgugauccuccuacuuuagccucucaaguagcugggacuacaggcaugcagcaccacgccuggcuaaguuuuguauuuuuugucgugacagggucucacuguguugcccaggcuagucugaaacuccugggcugacgugacccucuccccucugccacccgaagugcugagauuacaggugugagccaccgcacuuggccagaacacggccauuuuaguuccccuccuuagaggaguaaggccaggaaugagccuguggucugaaagccguggcuguugguuaauguggagaagggaagguggugagagccagcccaaaccccugccgagugagacugauucuggcagcuuuagggagcagggaugagccccucacaggcugggugguaguuagaggaggcagauuucagaaggccacgcagcgcucuuucucagcaggucaggcaggcagcagaggucgggcaggggcauggggucgagggcccgaugcugguguguucacuagaggagagccacaagcagggauucugggucaggugcaggccuagggcuuagugugcacuugugguucugagacugucccaugacuuccugccagcauuccggcagcucuagugggacucccuccugguccaggugaggccaccauugcugcccuggcuugcugcuguccucucagcccccagucugucaccuggugggaguuaaagggaccugcugggguuugaggaagcucugagccguucccuguacgaagccuguggucaucucaggcugcaggagacacaggagauacgagcuuuggagguggggcucucagucacaagcccccguuguuccucccuguccuccgcucacggcacugcuccaguugccggggccaggguucuuggagagcacauccucaccgcuguccccucugcuggugacagcacgcaguggaagcacucuggaaggcggucgcggaucuguugcagccggagcggccgcuggaggcccggcacgcggugcuggcucugcugaaggccaucgugcaggggcagguaaggcccagggcgacgcugggaugggugacgucaggcugcccacugacuguccugucccugcugggccguguuuggacuccugccucggugaguugcugggcacagggucuaggggcugaugggcucuggagcuggauggccuguggggucuccuggugucaugaggucugugugaccguaggcacugccuccucgccuguaaacagauggucacugcaccuuccucuuaugggauguucuggggaucauaugaggcaguucucgcagagugcugagaucguaccuggcagcugguguggggcuacgguguuguuuugcccuugcacccuuucggggccacuccccugcucacugcauuccaucugugcuggucuuggcugacccugaacacccaggccucuugguguuccugccuccccuggucggccacuucuacuccuucaugucccagcugcucagaagggccguccacucucacaggcucuccuggguuucccccacucaggccuuguccucagucucugagcacaaggcugucugcccugcaccgagugcaggggucgggcaggagcugugucauccccugcucugcgccacccgcugugccaggucccgacacacagcaguugcuccccauacgccgcucugcggucggccggugcauccggcccccugcccuguacaaugcugaugcugcagaccugucucuugcagggcgccucugugggaaggagagggguccagggcuggaguccgggugccccugcacuucagggacuucuuggcagccgugugggcgacgcuggcaggcucugcugauccuguggcuuuugucuuuagggcgagcguuuggggguccucagagcccucuucuuuaaggucaucaaggauuacccuuccaacgaagaccuucacgaaaggcuggagguuuucaaggcccucacagacaaugggagacacaucaccuacuuggaggaagagcugggugggugccaccuuggguuggagguuucucuggccuugacgaucaaguguaaccuggaugggaaggaccuggggcuggggaggggcugccguucucagggauggccugcagcggguaugcccacccugcuucaugcaccugggcucaccugcguggccggagugccccugaggcacguguuaaaaaugcagaguccuggccuucaccccagaccugcugacugugagucucuggggcuuggggccuccgaacaccucugcaacggcaggagcugggcgaguucugucacugggagguggugcugcugacuuggucucaaccggagcguacuggucccgucuuccuccuccuuucuccacuuuguggaccuuccuccugccauccuguggugggagguuuccauuagucuugggucucugugucaugauucugggaaguagagaaagaggaggaagagaucggucugacucuggcuuugcuguucugucgcccagaaaagggccucaguggcugggcugccugcaggacaggugccggccaggugccuaccgucagguuuccugucugaggugacguggccggcagccaagugugcacacgucuccuccgagccacucucugcuggggguggggaacgcccaggagucuggugaugucggcgucucccagccucggguugggcccugaguguacggcauacacacuucugcugccgccucggcacagacccucugugcagccccaggggcgguagauccuaguguccgugcguagccggccugcccugggcuccccugagccucuucgggcccagugcguggucugucuguugcugccgggggacugaugaugggguuucuggcagugacggguuuggacacacuguccugcggcgggagggggaggugagugggagauguagauucggcguccucgcaaacugccgccgcuucucccccagcugacuuuguccugcaguggauggauguuggcuuguccucggaauuccuucuggugcuggugaacuuggucaaauucaauagcuguuaccucgacgaguacaucgcaaggaugguucaguaagaaaagaauugagauccuguucugauaaugguccuaaguucagcuccgcagugaauaaaguugaaaccaccaaaaaaauagagguugggcugggcacaauggcucacgccuguaaucucagcacuuugggaggccgaggcaggcggaucacgaggucaggaguucgagaccagccuggccaacauggugaaacccugucucuacuaaaaauacaaaaauuagccgggcaugguggugggagccuguaaucccagcuacucaggaggcugaggcaggagaauugcuugaaaccggaaggcagagguugcagugagcggagaucgugccacugcacuccagccugggugaaagagcaaaacuccaucucaaaaaaaaaaaaaaaaaaagagaaguacguagcuaucuucuguuuagcucucaucugaugucuugguuaucuuuuuguuguuuguuuagaauguugcaugagcucugucucacucaugcugaacacccagcaccgagagcaguggcuggcgcacagcaggcaccugagugcuuguugggugggugggacccccagggaggaugagccaugcguguuauugacgucauagagugacuagaccacagcccgugguggcucggccauccaggcagugcugccgggacugagcucggugcucccugcaggaugaucugucugcugugcguccggaccgcguccucuguggacauagaggucagugccuccccuccccagggccggcccauuucacccugguuucugggaggcuggggcuuggggguugagcccugugugccaccugcuggcuguguagcccugggcaagcugcucggucucucugagccucaggagucccccauguaagucaggauagccgggcgccuccauguggagauguagcucaggguggaugacagcaucaaugacccacagugacagggacgucaggugcuucccacaugcccgcuugcccuguggcuuggagagagggugccauggcagcggggagagguggcagcgcaggcugaaggaggugggaaggaagccuggguguccucuccuguggggaggagcugggguaggacgggcgugagccgucucccucuccaccaggucucccugcaggugcuggacgccguggucugcuacaacugccugccggcugagagccucccgcuguucaucguuacccucugucgcaccaucaacgucaaggagcucugcgagccuugcuggaaggugggguuucugaaacugcucuggaagguuccugagagcacauggaugggacaagggccauccugucucccaugaaugguugucugauucuugggguggccagacaauggccuguugagggacggccagugucauuuucccaggcaguugagcugaggucaggguuuugguggcauuuugagaacccugcugccucugucuuugggaggagaugguggcgagcuggccggaccuuggguggcuauagggcagcagccaggcggggccagcagcgggacuggggcugggggcagggcuuaugccugccagccccugacacgcauugugucucgcagcugaugcggaaccuccuuggcacccaccugggccacagcgccaucuacaacaugugccaccucauggaggacaggugagugugguggguggggcgcagggcaguggaggccagcacagcccucggggcagcuccagugucccuugccaagcacacacuggcuuagagaguccuuguccucucgggcagcuguuccagaggcugccacuagagcgaggcccaugacuucuaggauccagccccuguccucuccuuccucugucaguucaacagaauauccacacccagcucagugccugccccaugcucggacguccuccagcggugcuccccaacuacuuagccuguuacaaggcgaggcucggggucuuggcuugacguugcccuugcccucacccccacagccaggcuguggccacuuuuguugcuuuagccauuagagauggcucagcucugcccacacccuggccucccacccaugcugccagcucccccuccugcucuccuguauccauccgcgccuccugaagcccacuccaugcagcacccggguggccuuuuucugacacagauaugucggugucacccuuugcuggaagccaggugguucccagcgcccuugggauguaggcuucuccuauggaaccaggcccuggggccagcccugccucagcccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggcccugcaucuuuccuucccuccauccuuggaaccaggcccuggggcccagcccugccucagcccugcaucucuccuagcccugccucagccccugcaucucucccucccuccucccguagaaccaggcccugggggccagcccugccucagccugcaucucucccagcccugccccacccccugcaucucuccuuuccuccaucuugccuucuccccuccaccaagggcuugugcaugcccugauuccucuugccagcagguucuuccaccuuugccgaguuacucuguuuacugaggucuuagcguggucacugacucccccaccucccugaguaguuuuugcuguggcuuuccuucuuggcugugauuggaggaagagauuuugcguuuaccugggagauuauguggcuggcgccugucucccccagacugcgaggcugugggccaucccucuugccugcuuccugucccuggcaugaccuguagcucacagcguggucagcagugaugggcugccgccugugcgcaggagugaacaagaguguuacugcuggccucuguucccugcccuuccccagcggugcuccugccccccccaagcacagggaccucuggggcugcugcaggagccucggcaaccucacacauccauggcggacccugggacagggcccugcucacauuccgucucucuggggaacacuuuuagagccuacauggaggacgcgccccugcugagaggagccguguuuuuugugggcauggcucucuggggagcccaccggcucuauucucucaggaacucgccgacaucuguguugccaucauuuuaccagguaaggcgguuucugugugcagugagcuggcaggaacgggagagcuccccucacgccugcccacccaucccacuggggguccugcugcgggggcugcgguggcauuucuaggccuuuccaggcaguugcuuugcagcugggggugagguuuggggcccuuuguaggcuuuagucuuuuuuuuuuuuuugagaaggaguucugcucuuucugcuuggcugacugcaaucuccgccucccggauucaagugauucuauugccucagacuccugaguagcugggauuacaggugccugguaccaugccuggcuaauuuuguguuuuuaguagagacgggguuucgccauguuggccaggcuggucucgaauuccugaccugaagugauccacccaucucagacucccaaagugcuaggauuacaggcgugagccaccaugccuggccaaaggcuuuuuucucucucucuuuuuuuuuuuuuuuuuuuuugagacagaguuuuacucuuguugcccaggguggagugcaauggugcgaucucggcucacugcaaccucugccuccccaguucaagccauucugccucagccuccugaguagcugggauuacaggugccugccacagugccuggcuaaugguuuuuuuuuuuuuuuuuuuuuuuuaaugggacagaguuucgcucuuauugcccaggcuggagugcaauggcgcgaucuuggcucagcgcaaccuccgccucccagguucaagccauucuccugccucagccuccugaguagcugggauuauaggcaugggccacuacacacagcuaauuuuuuauuuuuaguagagacuggguuucuccacauuggucaggcuggucucaaacucccgaccucaggugauccgccagccucagccucccaaagugcuggaauuauagguaugagucaccgugcccggccaaggcuaauguuuuguauuuuuauuagagaugggguuucaccauguuggucaggcuggucuugaacuccugaccucaggugauccacccgccuuggucucccaaagugcugagauuauaggcaugagccacugcgcgcagcccaaaggcuuuauucucaagcaaaccuuacaucuugcgaguuucaccuucuggaguuggcaguggaggggugaacgcugccucggggguagccguucucuugcuguuggcggcucuguuuugucaagugcuggucuuguccugucucugcaaugacgccguggcacagacgcuggugguacagcuucaguuuccgcagugccccgugaugacagcgcuuuuuguguccguccucguucugugcucacagcucccuggaggguggggcgaucacgucguccugguuuuauagugaugagcugcggugugggucacagggcucuccugauccucugcucuuccugcuaccccccuccccguaggggcgguggggggauguugucuuugugcacagcuugcagccgaacucagggcagcuuucaguugcugcugggcuggcccaccgggugcccaggauucaguugcuggucuguccgagucagggacuuugcaggcaggcauggggguggggcccgucuggguccugacugugcuggagcauguagaaaccccuccugggcgccccaccugcuguuucugcggccccugauaaacguguggugggcacugcgcgcucaggcgugcuacucucggucccaagggugacugggagggcgucccacagcaagcaagcagcucugacccugugugcuggccgggcucguguuccaggccauggcauguccgaacgaggugguguccuaugagaucguccuguccaucaccaggcucaucaagaaguauaggaaggagcuccaggugguggcgugggacauucugcugaacaucaucgaacggcuccuucagcagcuccagguggggugggggcaggagcuccggggagcaccgggaacccagacaggcaggcucggcccacucagaagaugguaccuugggccccaucucugggggucccgcagagacugccagaaccguguucucuggugauucgcaguggcgcucauccaccuuccaccggagacaggucugauuuuuccagacguggugcaucguuuaggccccagacaggaauaugcaguaggugagccggggcugggccagugcuguccacaguccgcagagugaccugcaggccgccuucguggccugagugggccccggcacaguucccagagggaugccaguguggcuuccgcaugacuuuggaggaccgcauuagucgagucuguuaaccacagcuuuaaggaggacuccacggccacacgggcucaucagcauaggggcccuggggaggcgaggcuaguauccagcagccucagggcugugccuuuuccuggagccuggggcgggugauguacaggaggccaggcagcagaagggaggccgggacuucgccgggacuuagcagggacugaaguccucucagagccugucgcugggccagagcauugcccccgaccgcugguggcaguggcagaggucauagccuggggcuucuaaaagaggcuggaccugggagaggcaagaaaggcuuguaguuguggcuacucuuggcccuccugcccgagcuuccuucuuggcccagcugcaugggcacagccaagauuccuuggggggugggguacgggcaggaacagcagcugccaucacagccacuguggccccuugagaggaucugggggguguccugggccacgugggucaggguggccccuggagaggaucugggggugucucaacccaugaggcccggagcggccucagagggcugggggcgucuguccccaugcggcccagagcggccugagagggcugagggugucuccaugcgguggguguguagcgaggccucuggugccaaguccauguggggaguggaagucagccugugucaucgugccugguacugcagaccuuggacagcccggagcucaggaccaucguccaugaccuguugaccacgguggaggagcugugugaccagaacgaguuccacgggucucaggagagauacuuugaacugguggagagaugugcggaccagaggccugugagacccccuccuggguggggccuuugggcuuuggcugguggggaggggccgggugcugggugaagugcagcuuucugagccucagaagccaagggccaggugggcgccugcuuuccagguuucugcacucggcagggaaggcuggcaggcacagcacguguuugguaacaagcucggggcuagcccacccaucaguuuccucccaccuguguggagcaagcuuccauccggcucuguagaguccuguggcucccaggcggccgcagucauuuugccaggaacacucagcuuagggcccaggcuuuuccauggguuuggacacaagucuuccccgcugccaggagugccuuugugucugggcugugggcugcaggcugugaggcggcugggcucugacagcaaaccagccucucgaccagcagcccaguguggagaaggagagcgccggaggggcagaggggcaacaccggcucuucuuuugacaggaguccucccuccugaaccugaucuccuauagagcgcaguccauccacccggccaaggacggcuggauucagaaccugcaggcgcugauggagagauucuucagguaggggguccucuguagccuugccuggcaccuggagccuggcccugucucugucuggggcccacccgggcugggucucaggaugcccgaugagcagggcccuccccucugccucuggagagcccuggcucugggugagcaggugcuagcuugcuuuccaguccagcaggacagguccucucaugacgccacugggcucccucuuuucgggggucgucuggagagaugcucccugggaagcagagcucugugcccugugugccuggccgcgggaggacccagagucgggcuggccugcgccaggcagacgggcugguguggggcuguggccgggcacuccccacccgccccagcaggcugccgucccgcaggagcgagucccgaggcgccgugcgcaucaaggugcuggacgugcuguccuuugugcugcucaucaacaggcaguucuaugaggugcguguccaggcggccgcagcugggggcucagggcuauuucuccgugggcgggcugucucuguugugcacgugcucccgcagagccgggcucugccugggacuucgguccugccggacccucugcagcccccagcguggucuguuuaccccuguucauucacuggcuugcucguccugggugccucugccaggccuugacacguggccaaguagcaaggaaggcacagugccugcccucagggagcuccggccgguuuucacccaacacaggagccucuuaaaaauucugugugaguucguuucagccagucuugcauggggacauugucuuccguuucaguccugacguucacccugugcaccugcgugaucgccagcccugccuggucucuccucugcgggcucucccucuccacucccuccucugggagcucuguggccccaggcccaccuuccuugagagacauuugugugccugccagucauaccccuuucccaggaggcgcagcuuaggcucugaggcugucccuucccaccgaacuccucccugcagccucgcaguccugcccuccugagagcugcccacucugcuccucuccccagcguccacuguccuugaauugcccuuugcugggcauugcgaucccgcauucugucugagggagcuaagggccuccuggaaguuccucuggguccucuggcuucucccaucagggcuggucuuguccuggucucuguuccuguggaacuuuuuaccugcuucugugaaaacucacgcuguccucagcacagcacgcacacacacgcauauucacgcaugcacaggcacacacgugcacaugcccacgcgugcacacagccacacacacccucacgcacacacgcacagcaccaugugggagggguucucggcugugacagugaagggcagggccucaccucggcugcuccuugugaguugugggccccgugucugugcccggccgcccugcggugcucaccagccuucugaacgaggagcuggacaggaucccuggaaggggccccggggucucugagucgcgcucagcgggugcuugugcucucugcccagcugugcugaagucccgagggacauguccgcugcuugcgggucgguuccugaggaauuggaagugucacgagauguggcccucguugggcuggcgcucauuggccucccuugugccugugcaggaggagcugauuaacucaguggucaucucgcagcucucccacauccccgaggauaaagaccaccagguccgaaagcuggccacccaguugcugguggaccuggcagagggcugccacacacaccacuucaacagccugcuggacaucaucgagaaggugagagccguuguacccggggccgggugcuagcgugccagagcuccgugggcagcaauggccucugggcccucuguccuccucuucgagugaccggauggcuguguccguaggugaggcuccccucccugcagggugggugucccgaggccugugcagggccugccacugcuggauuuguguccugacugaaaguccuggacauggguguccugucacacucugggacagcugggcugggccuccuggaccgacgcuggagcccagaccuggggcuggggcuuuggccugccguccucccugcccagccaacagcuuugcucuuugauuuucagaugcauuuugguuucugcacagucacucggguauaaagggcaucuuugcuuuugagcaauaaagaugaaggccgggcacaguggcucacgccuguaaucccagcauuuugggaggcugaggcagguggauugcuugaguucaggaguucaagaccagccuggccaacauggugaaauccugucucuacuaaaaauauaaaaauuagcugcacgugguggcgggcaccugcaaucccagcugcucaggaggcugaggcaggagaaucgcuugaaccuaggaggugaagguugcagugagccaagauucugccacugcacuccagccuggacgacagagcaagacucugucucaaaaagaaaaaaaaaaagggccgggcacgguggcucaugccuguaaucccagcacuuugggaggccaaggcaggcggaucaugaggucaggagaucaagaccauccuggcuaacacggugaaaccccaucucuacuaaaaauacaaaaaauuagcugggcgugguggcgggcgccuguaguccuagcuacuggggaggcugaggcaggagaauggcgugaaccugggaggcggagcuuguagugagcugagauugugccaccgcacuccagccugggcgacagagcaagacucgaucucaaaaaaaaaaaaaaaaaaaaaaaagguguuugugguagaaaguguucucacggcugcugacucagaaccaugagccuguguguaaguccuggccuucucuucaaaggugauggcccgcucccucuccccacccccggagcuggaagaaagggauguggccgcauacucggccuccuuggaggaugugaagacagccguccuggggcuucuggucauccuucagguggguguucugcacgaggccucugcucccggggcgcgcauggcuagcguccaccagcugcaucugcguuguguuggagucuguuccccagcgggacccacacccucccuggauuugcugagggugcgguggucucagcaggcagcagaaccuuccuccugcucuuguggagggauggaugcaagaggccccguuguacgcccugaccagagcuugucucugugcuccugagucagggccggaaccauguaccauccucagcguggcgcuugcccucgucacccagcacagcaccugggaaguaaggguggcccuccauuccugcccugcaguccguuuaauauuugcagcuguuuuguugagauuuaauuuacauaucaugcaauuuacccauucacagugaacaguucagugguuuucaguaaauucacagagcucugcagccaaccccacagucagcuugagaaccuccugagcauaccaguagcacacgcucccaucccccguugcucccguacccccggguaccaucaagcugcuuccugucucuguggauuuaccuacucucaacauuucauggaaguggaaucacacaaaauucauccauaagauguuggaugguagaacaguuuccugucugcugacuggauuguuccacccagcgccauguguccaggcccguccaggcuguggcagcuguuggugcuccccuccuuuucauggcugaguaguauuccaucaucuggaaggagcacauuuugucuguccguuccuccauugguggacauuuggccuguguccgccuugcagcugcggugaguggugcugcugugaaccuucuccuacgagggcuccgccgggccugcauuuucacuuuugggucugcaccuaggagugaauuguugggcccuagguuuagucugcauuugguguuucaaggcgauaccaggcuguuuuccacuggugcugugccauuuuccauccacucgagcagcauguaaggguucugauuuaucuuuuuuuuuuuuuuuuuuuuuuuugauacagucucacucugucgcccaggcuggaguggagugcaguggcgcgaucuuggcucacugcaaccuucgccucuuggguucaggcgauucuccuaccucagccuccugagcaucucguauuacaggcaccugccaacauacucggcuaauuuuuuguauuauuaguagaaacuggguuucaccauguuggccaggcuggucuugaacuccugaccucaggugauccucccgccuuggccucccaaagugcugggauuacaggugugagccaccacgcccggccugccucuacuuuucaaagccucacagcaucacuuacgugugacugucagugucaguaucguguaaaauauaauguaugaaucaguuugcucaaaagcucauccuuaagauguuggaugguagaacaauuuccugucauguuuauaugucauggguuuuuauuucuugccauggaaguugaaaguggugaugauuuuuuuuuuuaauuaauuuuuugagacaagaucucacucugucgcccaggcuggggugcagugcugugaccauagcucagugcagccuugaacuccugugaccaagugaucguccugccucggaggccucccaaguagcugggaccauaggcacacgucaccacaccuggcuaauuuuuucauuuuuuguagagauggggucuuuauauguugcccagccuggcaucaaccuccuggccucaagcaguucucccaccauagccucccaaagugcugggauuacaggcaugagccaccacaccuggccgugguguuugauuaaaaaccaggcaucagccgggugugguggcucaugcccguaaucccagcacuuugggaggcugagguggguggaucaccugagguugggaguucaagaccagccugaccaacauggagaaaccccgucucuacuaaaaauacaaaauuagccgggcgugguggcgcaugccuguagucccagcuacucgggaggcugaggcaggagaaucacuugaacccaugaggcagaggguacaguaagcccagaucacgccauugcacuccagccuaggcaacaagaaugaaacaacgucucaaaaacaaaacaaagcaaaaacaggcaucaccuccuuggugucucauccacaugagcaccaugcucuuuacugacugguugggaaggggugugcugggcugugggggccuauggccugggagaacugagaaccuuucugcuucugcagagggaaggaaagagguucuguugcccuuacuuggaacuccagcccuggaggccugagggucugggcugcagaacugagauauuuccuaguugaggcagaguccugguucuggcugcuuucauuucuuuauuuuuuugagauagagucucaccacuaugucacccaggcuggagugcagcggcacgaucucaccucacugcaaccuccgccucccagguucaagcaauucucuugccucagccuccugaguagcugagaugacaggugcgcaccaccacaccuggcuaauuuuuguauuuuuaguagugacaugguuucaccauguuggccaggcuggucucaaucuccugaccucaagugauccacccaccccagacccccaaaguguugggauuacaggcgugagccaucgugccuggccuguuuucauuucuuuuguuauaauugaaaaguaacacaguugacucuugaacaguauggggcugggagugccagccccugugcaggugaaaauccccaucuaacuuuuaacuccccagaaacuuuaccaacagcccucuguugacuagaagccuugcugauagcagacagucuauuaauguacagcucguguguuuuauguauucuguguuuuuacagugaaguaagcuagagaaaagcaaaugcuguuaagaugcuaggcauggugacucacgccuguaauccuggcaguuugggaggccgaggcgggcagaucaugaggccaggaguucgagaccagccugaccaacauggugaaaccccgucucuacuaaaaauacaaaaauuagcuggaugcgguggugcgcaccuguaaucccagcuacucgggaggcugagguaggagaaucacuugaaccugggagguggagguugcagugaccugagaucgugccauagcacuccagccugggcgacagagaaagacuccgucucaaaaaaaaaaaaaaaaaaaaaucauaaggaagcgaaaauacauuuccuguuccuuaaguggaaguggcucaucaccaaggucuucauuguugucauccucauguugaggggacugaggaggaaggagaggagacacauggucuugcucucucgggugggagaggcggaagaaaauuggcauguaagugacccaugaaggccagccucgugcuguucgagggucagagaguuugcacaauggacacggugacaaguuugauuccccuuuuccugccugccuagugggcccggcagggcggcagcugcuguugguuccauguggccuucccagaauggggggugccaggcacugugugaacccccaccuccaccucuuuuuuguccgaggaagggauguugcuuuuaugucauaauauuuugagaugaggagaaacuguuaaucauuuaaucaucuuuuuuuuugagauggagucucgcucugucgccccagcuggagugcaguggcgcaaucuugguucacugcaaccuccgccuccuggguucaagcgauucuccugccucagucuccugaguagcugggauuuacaggcaugcaccaccacaccuggcuaauuuuuuuuuuuuuuugagacagucuugcucugucgcccaggcuggagugcaguggcacgaucucggcucacugcaagcucugccuccuggguucacgccauucuccugccucagccucccaaguagcugggacuacaggugcccaccaccacgcccggcuaauuuuuuuguguuuuuaguagagacaggguuucaccauguuagccaggauggucuugaucuccugaccucaugauccacccgccucggcuucccaaagugcugggauuacaggcgugagccacugugcccggccuaauuuuguauuuuuaguagagaugggcuuucuccauguaggucaggcuggucuugaacuccuaacuucgugauccacccacuucagccucccaaagugcugggauuacaggcgugagccaccacaccuggccucagucauuucuuucaaugauuuuuuaaucauuuaaagguguuaaucauuucuuuaaaagaauaacaguguaaccacuuaccuccagagugcugcaaagggucccucaggccagauuuccccuggcuccugcuggccucggccccaggguugcuggaggcaacagaugcucuucacaccuugccacacgugucugggaggugcccuugaccuuuugggaggggcugccuacaccugggaucgcccugcagcacacacuccccgccccauucugcccugucugccacgcagcuggagcuucuccauugaauggacucuuccucaccuguugaugacugcccugaugaugagaugggcacgagguuggguuuuacuuuuugcugcuguggagagagaguccuggugguccuggguuugaaggucguguguuuugaagcacgcacucuagagcagccgccccggccccugcuccgggacaagggugcugucuuaggacugcguuuucaccuccugcgccguggugagcugcguccucucucugcagaccaagcuguacacccugccugcaagccacgccacgcguguguaugagaugcuggucagccacauucagcuccacuacaagcacagcuacacccugccaaucgcgagcagcauccggcugcagguaugguggcugggguugcgcagccaguuccugggggcccagccagguauccccgucucggcaggugugguuccuggaagcugcagagacggccccaggauggggccucagcugaccgucccuccucugcacccacuguggccgcagccuccccaguccugguguccuucccucugccugcaguccacacaucuguggcuugucgcucuaagccgcacggugacauggguuggggcagagaaaaggacgcacggcgacuuccggggcagugcauggcccugacgcuccuggugcugcagaaucugugaaggaccugcagcagagggcugggcaggugggcggcacagggcagagcugagagggcagagcugagacggcagggcagggcuggagagggcagagcugagagggcagggcagggaugggcagaacagggcuggaggaguuucgcugaguuugcgcuauagauguuggcaccaggcugagcagaggugacugggaugggagcccucccuccuagagcaggugcucucuggggccaccccuguggccucagaguccuguucagccugucgauggaagaaguggcagggcugggagcugagcuccgcuuucuggcaguugggggcguguggugcugccagaggagcgaggcgcccaucccuuccaucccaggcgggcccagcuguggugguggggacaccaggcucugugagcuccgaggcaagggagggaggaggcugugggugcugggccuccggugucaccaggacagagccugugucuguguugggaugugggugugugcacaucagcagguggccuuuucugagugccuguggugcuggacgugggucugagcaggugggacgccgccuguccugggccugcacgagcuuggcucuggcuuucaccauccucuuccugacaggccuuugacuuccuguugcugcugcgggccgacucacugcaccgccugggccugcccaacaaggauggagucgugcgguucagccccuacugcgucugcgacuacauguacgcgggaccucgcccacggcccaugaggcucagggcgucagaggcgcuggggcugugguggcgcuguuugcaugucugagggaugucccaggguugggaagagccaagucuguuccguuccugcugcggggacuuggccucagcugcuucucuugcuucugcagggagccagagagaggcucugagaagaagaccagcggcccccuuucuccucccacagggccuccuggcccggcgccugcaggccccgccgugcggcugggguccgugcccuacucccugcucuuccgcguccugcugcagugcuugaagcaggugaguggggccgggcagggaccauccgucccacguugggccaggaggacagggagcugccaccugccugcugggccucccucccugucuggccuguggagggcagcccucccucagagcugagccuucccccuuccccgagcagcugcagggacagaggccugcgcugggcaggcucccccggcugagaacagggcuccauagcccuugacgcugugcagccacaaagcagagccucagaugcuagcuuccgccucugucucuaggguccagaaggcccuguccugacgccuccucuccucgcaggagucugacuggaaggugcugaagcugguucugggcaggcugccugagucccugcgcuauaaagugcucaucuuuacuuccccuugcaguguggaccagcugugcucugcucucugcuccaugguaccauggccggccugggguuggggugggggacccaguaggguuuuuccccaaaagacugcgagccucugggcagagcgagugagacccuucgggcucgggcuccauuucccucaaacucagcugcacucuggagcgcagauugugccuugggcaggguggagggaccccugccccagcucgcagcuuuugggacugacgucagagguccccagccaagggcaugucacugaauguggaugucucccaucugugcuuuuccuaaguggggcucccgugccguucaccucacauuccugguguguuacuuggcaggcacucccaccacuccgaaagggaggcccuuccugggagggaggcaagaaggcuccccagccccuuugcccccuuuccugggccugcguucccagggccuccccagccccucuggcuaccccgugaccuggccgcuggggagagguuucaugccuggauuuggucaucagcuuucaggcccaaagacacuggagcggcuccgaggcgccccagaaggcuucuccagaacugacuugcaccuggccgugguuccagugcugacagcauuaaucucuuaccauaacuaccuggacaaaaccaaacagguaggaggucagagcaggacaggcgagcuugauggggccugggauucgagggccuggcccagguaggccccacauuuuucucauaaacgaguuucugccaggccagggaugagugaguuggcucugcuucccuggguggcugccagaugcccagaguggggacauccgauucccuggugcuucuagcucucuuuggggccugggagccauccaguguucccuguccaccccggacagcaucucugcucucuguagagcguugccuggcuuguuccugcugucccaagggggagguggccaugccgguugguggagcugggcugguucugaggcgcagggugggcaggccagagagucuggcuucugccucccuccacgccccaucaggugccggaaacugucccuucaccugcgaucugccucgcccccgucccagucgcauucuuccacaccucucuuugacauggcccuccgggacgaggagcugguguccuagagauucuggccuccgcucagggccaugcccgccaggagaugcugacucugaggcuuggcccaucugugccccgggccucagcuucugaugguggcccuguagggagcuguuguuggguucccaucccucaggcucagccccacccuguugggccccuucagccccucugagaggcucacuggguccucaugggucuugccucaaagcauagccagccuugcugggcugcagguucugaggccuuacuggcccacaguguauccgaggggugaggccggcuuugggaaauggaagcuguucccgggacacugccuggcaggccaucuggccccgggcucugccugagcuccgcucaucuucugcuguccucauggaagacacugcccaggguuggugugggaucugguggcuuggccacuucaggcagcacugccccuugcaacagagccagccugugaagggcccagaaccaggggaugagagcccagcaugucuggguucuguuggccugugggaucgugucggaaugcaacugaccggagcagucugcugugcagagucugcucggguagcucagcacugcuggcucugccccacaggcauucagggacuugcuaagccucggcuguucucccgguggagcacucgagguuggcgagggguaggcgaggcugccucugcugcaagcggguggggccugagguguccugucuccugcagcgcgagauggucuacugccuggagcagggccucauccaccgcugugccagccagugcgucguggccuuguccaucugcagcguggagaugccugacaucaucaucaaggcgcugccuguucugguggugaagcucacgcacaucucagccacagccagcauggccgucccacugcuggaguuccuguccagugaguccccgcccugccugcgcaugcacccgagagguucgggcuguguaaccugugcgggcuucucuggugcccucucucaggacuccuuggggaaccugggugucucgccuucugcugccucagggccugggcgucucugcccggcugccaugagugcucuccuuccuggcuuugaggggcggcuccucucaccccucuaguguccaugugaacgcuccuccuugaagaagccucuucccccccgagcaguggcccuccccugguuuugggccuccucucuguccaacagagcacacgccgcuucaggggggcuuuguucgcuucccccagacugugacuucaggagcucaggugccugucccuuccccucaccgccugugcgcaucugggcaggcccucaauguugagauggcagaagggcacugcugggcccgcacuugguguagaggcuggagagaagaucgugugugcuuugugggccacaugcagguccugucggucuuucuguuuuguugauaacccuuuagaaguguagaagccuggccaggcgcgguggcucaggccugucaucccagcacugugggaggccgaggcggguggaucaccugaggucaggaguucgagaccagccuggccaaccuggcgaaacccugucucuacuaagaauacaaaaauuagccgggugugguggcgggugccuguagucccagcuacucaggaggcuaaggcaggaggcaggagaaucucaugaacccaggagguggagcuucuagugagcugagaucacgccaccgcacuccagccugggcaacagagcgagacaccgucucaaaaaaaaaaaagagagaagugaggccgggcacgguggcucacgccuguaaucccagcacuuucggaggccgaggcaggcggaucaugaggucaggagaucgagaccaucuggcgaacacggugaaaccccgucucuaauaaaaauacaaaaaaacuagccaggcgugguggcgggcgccuguagucccagcuacuugggaggcugaggcaggagaauggcgugaacccaggggguggagcuugcagugagccgggaucgcgccacugcacuccagccugggcgacagagccagacucaucucaaaaaaaaaaaaaaaaaaaaaaaaagaggugcggaagccuuuccucacggaucacacaaaugguaggcgacagcucgaauuggcccagaagcugugguuggcuggccaugggaccgagaguugaggccagggucgggaaagccacguccguguggccguggccuucucuccucugcagcaccccaucgcugccgugggcagagcagccguguuggccuucagaggcgcugcacgggaccccggcuccccugaccacccucuccauuaccgcagcucuggccaggcugccgcaccucuacaggaacuuugccgcggagcaguaugccaguguguucgccaucucccugccguacaccaaccccuccaagugaguggucgccccaggcccugugccucccagccguggcccccgcuaggccuugcggcagaaagccccggcagccuuuguccccaaggccugagcgccucgguuuuuugcacuucaugcccuggggauguuucccugcugccaggauggagugccagcccccuucucaucucagguuuaaucaguacaucgugugucuggcccaucacgucauagccaugugguucaucaggugccgccugcccuuccggaaggauuuugucccuuucaucacuaaggugggcucagggccggugaaggcugugucucucgguaggccagggcuugcuuugcccuuggcuguccauggucgggcagagugacaggcagguggagggcagugggaggguguuuggggcugugccuguggcgcugggggcucugcugggcagccugcagggcuuugaugcgcggcaggcauugaggggugggagcugggugccgccgccuugccccuagccugcagcuugucccuggccagggggcacccggcaggccuggugagggccuccagcccccauugccaccccucacugucugggugugcucacucugccagggccugcgguccaauguccucuugucuuuugaugacacccccgagaaggacagcuucagggcccggaguacuagucucaacgagagacccaagagguacggccugcgggggugugccuggagucggugugggguggggaaggacauggggcuguggccugccugacggugccuccaagucagugaguggaaauggguccugugugcccuggaguaugugaggcagggcaggaccugcaagggccgcuaacaccccucagccccucagcagguuggccgugguggccuggguccgggcugcgugugccacgggcaccuacuuguggaauuggggguuggggugcaagcuuuaggcgccugagccccucgaaggagccggccuugucuggggcugcccccuccucugcagcccccagccugcugcuagccggggacucugcuucaucaccgccgccuugccggaccgcaaagagcugagccagccucuguguucuuguuugcauuucauuugaacggcuuucuccuccugucccccaccuuccugcccgagcuauuuuggcuuucccuagaugggaauacggcauuuuccagcgugaccucaacucggaagcuguugucuccagccccugggggccgggggccaagcucggccauuacggccagagacuacuuucuggggucuuggucucuuuuccuagugaccuucagggccuggccacugaggccucagugccgccucggucagagcugggcggugccugccuuccgcgggugggugggauugccuggccagcacagccuggaaucugccgugggggugacccacacacguuuaauuugcacugacguuguuuguuuuggugucaugcgugaagccuuacuuguucucagucauguuuaccagacguauuaucaugcauuuuuguuuucugucucuuccccgcuaacugcccuuuggcauggcucuuuuugcucaucucacccgcgggaucucuccauccugacccuguggccugggaccuuuccuccucaccccuccacuggcuuguucuccccuucccgggagcugggcucucuggggcguuggggcuccuuccucacccgauagucugaggauagccagaccccccaaacaaggcuugaauaacucuccacccgugaaagaauucaaggagagcucugcagccgaggccuuccggugccgcagcaucagugugucugaacaugugguccgcagguagcgggacugucggguggggggcacggacccuggagcuuggccccgugagcaccuggguggcagugcauggggcugcuugcaugaccucaucgucugcccguguccucccuggccagcccagggggagccggugacgagggguggaaagguugcauucuguccccaggccccguaugagcacgggcugguugcacgcauccccaggcccccucggggugccgcuccgagagagccaggcgugccgggcagcagccuccccaggcuguccccaagggccgcaguguggguugggggagacaccacuccugguuuuggccuuuucguauucucuagaauggacguuuuucuucgggcuuucuucucaacaagguuuauuuuuuguuguagcugaaagggaacaaggggcauuuguggagggugcugggguggggcagccugggagggccugggugggggcuaggauccugcagggcaugggcaugggccugggccccaggccauggucuuaguucuccccgcagugucugggugcaggugugggcucucgggcucucggcugucaccugccugugggucaucgcugcuggcacuggcagaggggauaccugucuccuccuggaagcccguugcaggccaaggggucccauggcccucaguccauccaccuccucaccucaggccggccucugcugggugggacuuggccagggguuggggugguagaggugcucggugaggcuuaaagccauuuucuagcacauucuguaucaugagcaaaauauugccuaggggcuaugaaauuuguaucagaaugaacucccauaagccucuucccugucacuggguguggagcucaggcagccgcucgccugccugagggugacgguggaaggccacauggggaucccagaccucugugugcuugccggaggcagccugcgggcagaaugcaaucugggccugucuguguggccuccgccucucugcaugacuacaccguuucgccaggaggccguaaccuagugcucccgugggcuucggugagggggaugucggucucuagccuccugagucugcuccgaccaguaggccuggucuuccccacccagcgucuccccguucucugggacaaugugguccacgugauucucaagcugaggcucgcugggccgcccacgcccuguuggggucuuuccgagcgagguccucagccgugcaugcguugagcuuuggcccuuggugauagguggcucggcccgcccuaccuggcacccugacccuggucacggccucucccuccagcaggauacagacgucccucaccagugccagcuuggggucugcagaugagaacuccguggcccaggcugacgauagccugaaaaaccuccaccuggagcucacggaaaccugucuggacaugauggcucgauacgucuucuccaacuucacggcugucccgaagagguccaggcggcacuacagggcugggcgggccugcgggagcuccacgggcaagcuggguuucacgcucccugucuucuaggucuccugugggcgaguuccuccuagcggguggcaggaccaaaaccuggcugguugggaacaagcuugucacugugacgacaagcgugggaaccgggacccggucguuacuaggccuggacucgggggagcugcaguccggcccggagucgaggugacugcaccuuccuuuccuccgcgccugccagccucgacaccggcugucccgagcccaggcccacguggcacccucguaccagccuggggacuaaguccacccugugcgugggauucucuucucagcuccagccccggggugcaugugagacagaccaaggaggcgccggccaagcuggagucccaggcugggcagcaggugucccguggggcccgggaucggguccguuccaugucgggugagccuuggccccagccaccuccacacaggcaccggggcucccucaguugcugcuggucccaguguucaggaaggccccgagcccaggggccgggguggcuggcuucaggcccggcccacguccugacucuggggugagccuuccacagcucaccccagagccguggagugguggaguguggcccgcuugcugcagaggggccugcucugggugcugguguuuccugcggguuuucagcucggcucaguccuggagcccuucucugcuccagcgagccguggucugacugcaggacagguucugggucccucccuguggcccuggguucacugaggccagcacuguggugggccgugccccaagggcagagcugccaccgucucuggcugccuguggcacuagcuugccaggcucggggggagcauucagcuugaggcuggugguuuugcaucagguaagugguggucaccaguccucugcccucuucuucagggggccauggucuucgaguuggcgcccuggacgugccggccucccaguuccugggcagugccacuucuccaggaccacggacugcaccagccgcgaaaccugagaaggccucagcuggcacccggguuccugugcaggagaagacgaaccuggcggccuaugugccccugcugacccagggcugggcggagauccugguccggaggcccacagguacugggcggggcuggccugagcgccaucuuucugccagucacccacagagcuguggacacucaggggcgauugcagacuuggcccucuugggauauuuggggguaacuuuuguuuuuuuuuugagacagagucuugcucuguggcccacgcuggaacgcaguggcgcaaucucggcucacugcaagcuccaccucccggguucacgccauucuccugccucagccucccgaguagcugggaccacaggcgcccgccaccacgccuggccaauuuuuuuguauuucuaguagagaugggguuucacuguguuagccaggauggucucaaucuccugaccucgugauccgcccgccuuggccucccaaagugcugggauuacaggcgugagccaccgcgcccagccauuuggggguaacuuguaagucuccagaggugagcugugaggggcgauccagguggcugagguggggcaggggccuguggcgaaccaagugacuuccauggcagagaguugcccuccccgccuggaggcugcaaguccgagaccaaggugcuccucggcaggaggugcuccucagaggccucaauccuuggcaugcaguugguuuuuucccuguguccucacaggcucuuuccuggaugucugcguguuaaucuccucuugggaggaaaccggucauggcuuaggguccgcucuggucccuugcuagccguaauuagcuuucugaaacccagucuccagagacagucccguucugaguuccugggguugggacuaaagcauaccaacaugggggcacagcucagccuguucccaggggcagagggagcccccgcagaggcccagagcccagggacagagggaggccuuugcagaggcccagagcccaggggcgccugggugugccguggcugaggggugcaaagaguagggguuccagcccucguggaggccuuggguccggacugugaggcugugggcuggaggccgcugcucugaggugccuggcggagccuggccucgaggcaggggcugagcggggcagcaggguggguggccgucagagcagcgcuggcuccgacaucgugguccugaggauugugggagggagcaugagggcaaaaccagggcccaggccaggaggccccuggggggccagagauggguaaggggagguacuggccucaggccaaaggugcugccgccuccgcagggaacaccagcuggcugaugagccuggagaacccgcucagcccuuucuccucggacaucaacaacaugccccugcaggagcugucuaacgcccucauggcggcugagcgcuucaaggagcaccgggacacagcccuguacaagucacugucggugccggcagccagcacggccaaacccccuccucugccucgcuccaacacaggugaguggcauggcgggccuuggcacgggcucugcucccacuggccuggugcucccggugacggcaauguggcuccucucugcugagggcgcccacacggcugggaguggucccuggccugccucagcaccauuguucuccgguguuugggaggaggcugacccgugggaggugucugcccugcucaggaagcuggggcuggcagcuucagaagcaguaggggcccuguggagccucugcccagcauccuccguggggaguccagcacugcgggcuccaggaggcucugcggcagccucccucccugccugggcccagguuuggacaccugagcccgccugcgcacucugggcccccaccccacucggcaccgugcuucucgccaggcccucuggcucuucccuguggcugcagauggcacuuagcggccuaggacgucuauucacgggaggagggaggcacugcccuccucaggucugcccaagcagcuuguagcuagcacugggccccgugcgcgccccugccggccgcuggcccugcccucucuccucugcaggcacggggccugugcucucugcucgaccuguguguagccccuccuccugcugacguggccgcacacggccuucccuugcaguggccucuuucuccucccuguaccaguccagcugccaaggacagcugcacaggagcguuuccugggcagguaucgccucucagagggaagcgguuggcugcagagcgccacucugccucauaggugcugugcucgucgccucauccgcccacccccaugguccgucugccuccauugcccuggggagcaggucccgacucgcaugaggacgucugugcagaaugucuuuggcuuggccagcgggauccccuugacuuggucccuuuguggcugagcccuguucccacgcugugcgagcacucccggcccagcuucaggccugagggguggggguggccugagucuccauggugacaucagcugagcugcagacucugauggguggcagcuguuuagggggaagcccaccccugggccugcaccgagcgggccuugcccuggccuuugguggcuccccuggccucuggaacccacagauggggcugccucaagucccagguugaccaggggcccugcagaccgaccucugccuguugcccccaagcccugguggggagugcugugaccugcauggugcuccccugccaggucuccacgugcagacgagcugguuuggaagggcugcgugggacgggcccugggguggcugacugcgcgugugcagggcuguggggcgcccgggggcugugaugguccccucuguugcugcuucuacuuccucucccccuguccugacgcuggcacaggaaaugcugcuuugggaccucccacccucucuccuuagcguccccagcugugggucuggcuuggaguuggagggugagccucugcucuugggagcagucuguuugcaaacagggacuucccccacgucacggagucuccgcagcucuccucgguuacgagggcugguuucaggcucccgcucuuuuagagcugaggcccgucgggcggagagcgucuugccccugccuaccuggaggcacagggguggcugcugguggacacuagggugggcagagccgauugccugcccaacccccgggcacucaugcaggagaggccugugucggggucacgugcaggccuucccagcguccucccugcccgcucgguggauggcagcaguaagcagagcccuggggaggcucgcagggcugcugucccucuggucaggagaaggcugguucucggaggccacgucagggccagggccuggcccagccccacauccagcagccccgucuguguccucccagacuccgccguggucauggaggagggaaguccgggcgagguuccugugcugguggagcccccaggguuggaggacguugaggcagcgcuaggcauggacaggcgcacggaugccuacagcagggugaguguggcucagagccuggacccugcugaccucggggggcuccuuaggggaggcagggcucugcgugggugugccugcacccugggaacuggcucugaacuugggggagauguucuuccacaucccucgugcacagacggucugcacuuugcagccauccaccugggccggcccuggcugcugggcagccuguggucucaggggaugcugauaccucugcucacgcaguguggggcacagcugguggcagugcugcugcgucaacgggcgggggccguagccuggugcucgggcuggucuguggcccugggauggaggacagauagggccucaccaccuccaggucaaccccaggugggcucgagggugccugcugacagggguucucuuugggaugguccuuucuagucguccucagucuccagccaggaggagaagucgcuccacgcggaggagcugguuggcaggggcauccccaucgagcgagucgucuccucggaggguggccggcccucuguggaccucuccuuccagcccucgcagccccugagcaaguccagcuccucucccgagcugcagacucugcaggacauccucggggacccuggggacaaggccgacgugggccggcugagcccugagguuaaggcccggucacagucagggacccuggacggggaaagugcugccuggucggccucgggcgaagacagucggggccagcccgagggucccuugccuuccagcuccccccgcucgcccaguggccuccggccccgagguuacaccaucuccgacucggccccaucacgcaggggcaagagaguagagagggacgccuuaaagagcagagccacagccuccaaugcagagaaagugccaggcaucaaccccaggugggccucuugcuuccgggcggggcuccugacaccucuccugcgggaaccuggugccucacuugccccaggccgagcgggcuggggugggguccucgccugugcccuagggcuggcuggaaccccugggagggcgguggagugggagauggccaggcucuguguuccucccugugggcuguggcugcccuggccaggcccucaccugggugcccaccauccccucccugugcaguuucguguuccugcagcucuaccauucccccuucuuuggcgacgagucaaacaagccaauccugcugcccaaugagguaggcguggccucccucuccugcauccgcuggagcuguguggcucgggugaaugguggggggcccagcucugcugcugggagcucaggcuugcagagggcucuggccuaagcucccuguggcagccugccgugaccggccuggguggggcggccuccuguggacgggcgucuggggcucaggcagggcucugugugccacagucacaguccuuugagcggucggugcagcuccucgaccagaucccaucauacgacacccacaagaucgccguccuguauguuggagaaggccaggugaggcugcggggccggccuaggugccuggacagggccagcugggccucagccugcaguggguagggagucugggcccccaacgccccacagagcucaacacugccggguccccuacagcaugaagugcucauugagcucugugccaggugcugcucugagugcuggggaccccggugcgagugacagguuagcgugggagcacccggcacaccaaggagugggaaggacugggcggguggcaccggucgcagggcuggggagggcgcuguuggucagugagcugacagcugaguggugagggagcgggcagggggagccugcauaaggggugggggcaucccacacaccagcagcgggggccgggcgcacccugcccagcuugagcacuggugcugggcgagcacgggagccgacaggaugggcagccucagcgcccuauaggcugcaccuucaucccaagggaaagggcagggccugggcugcuucugagcagagggcacauggccugacuccgcccagucucagugagucccuccugcuguguggcucgaggagguggguggugaugguucccgugggagugggguaggccccugggggcaggcugcugaggggccagggccccgggugugcuuugaguguggagcucccugauuuugccggccaggcacacacggggcugagggaagagagggagucaaggaugacacccgaugucuggccuggguggcugcuggaauggauggucuugucugccucagggaucagaguggggcucccggcagagccugcugggcacccccacccucugcggggcagggcccggcccgggagugaugccacccugccucuccccucuccccacagagcaacagcgagcucgccauccuguccaaugagcauggcuccuacagguacacggaguuccugacgggccugggccggcucaucgagcugaaggacugccagccggacaagguguaccugggaggccuggacguguguggugaggacggccaguucaccuacugcuggcacgaugacaucaugcaagguacggccuggcgccuacccgcuccugcugccccaggccucagggcacggcucccauccaguccugcuaccccacgcccuggggcauggcccuggcacccccaccugcuccagcuccccacgccucagguuccgagccuaacagcgugggcauggaggcagugauggggcugguggcuuugcgucccaaagcccugccccuggggagagccgaggaccacuggccaggcaccagaggacgugguccccgcaggcccccagagccccuggaguaaucaggaggugccccagugcaaggcacagagggccucagcacuggccccacaaacccauccggcccugcucacccucagccgucuuccacaucgccacccugaugcccaccaaggacguggacaagcaccgcugcgacaagaagcgccaccugggcaacgacuuuguguccauugucuacaaugacuccggugaggacuucaagcuuggcaccaucaaggugagugaggggccgucagugaggcugggccccaggcaggugcccacugcugugucccggguugguggcagguccuccucccugagcuucggucacgaggagcaggaggagaggccgcagugcucagggccccgugggcacgagcuucaccccgagccugcguuguguccucugugcccugaagccuguggcgccugcugcugagugucugucaggaguaacuggcaagugcagacugggugugcugggugggcacaguguaguuggugcuuccugucuguccggcgcggcccuugggcccccaccaucuccccaguggcagcugucaggcugcucaguugguuaucgccacgcaccacuaggcagcaaccagcgucacccucuuccuggaggugggcugggucggccagugucacagcacgguccgggugagccccagcauggcggggagagcuggcauggcccaggcagggcagauaggcuggaggccucacuccaagggccccaggaugcugaggcagccacugaaccaaaaccccggggcugguagucagaguccaggaggggcaggagcauagggaggugggcucugcuagaugccaagacaaccaguugggggggggggggcaccugggcggcugaggagggugugguggugccgagauggggugcacggcucacuucauggcugggcagacggauucggacguguggcugcagacacccugggggccccagugaguggaggugccccagcaauuagaggugucuugccuguggcugcagcauaugugggugcugcgcccagauguggagggggcuuggccugggggaggccagacaaacacagccccgcugccagaggggaaaguucaggggcagaugcugcccauggagcugacaggugucuagcagugcaaccaggcaguagccgagaucagccuucagcacacgcugugugcggggaugacccuuucucuuguccgggcagggccaguucaacuuuguccacgugaucgucaccccgcuggacuacgagugcaaccuggugucccugcagugcaggaaagguagggccggguggggcccugcagugcaggaaagguagggccggguggggcccugcaguguggcgccaagagcccugggccuggcgugaccaccaagucuccccagacauggagggccuuguggacaccagcguggccaagaucgugucugaccgcaaccugcccuucguggcccgccagauggcccugcacgcaaaugugaguggggguggguccaggcgugagcuggugggacaggcccaggugccaccugauagugagcucacccccugccuacguccccagauggccucacaggugcaucauagccgcuccaaccccaccgauaucuaccccuccaaguggauugcccggcuccgccacaucaagcggcuccgccagcggguagggaauauggggcucccucagcggggugugcuggcugcccaagcuguggggcgggugugugggcagagcgguugccacgccucccagacuuacugcccaagccgccucugccuucagaucugcgaggaagccgccuacuccaaccccagccuaccucuggugcacccuccgucccauagcaaagccccugcacagacuccagccgagcccacaccuggcuaugaggugggccagcggaagcgccucaucuccucgguggaggacuucaccgaguuugugugaggccggggcccucccuccugcacuggccuuggacgguauugccugucagugaaauaaauaaaguccugaccccagugcacagacauagaggcacagauugcagucagacagcucuuuuauugacuuugucugcuuggugcggggguugggggggugucgaggcucuagaagcggccaugcccacagaagugguacacagaagcaggcacagccagcuccgagggccuugaggcugccugggccauacagcacacucgcgcgugcgcgcgcgcacacacacacacacacagucaccuuccuccacccugggagccagcccccaggaggagucuuuuccucuaaccacccugggguccucugacaugccuaguccugcuacuugcccagaccugaugccagcaggccugggcgcugcucucuugcuaccuggccuggggcaagggaggaugacaaggccucuggggugaugagagugccuggcagacagcugugcccccagcaccggcccaaggccaagcucgcauccaagcagcagccgggcugccauaacgccaccacaccuaccaagcgcagcagguguugggggaggccagcucugggcgcaggccccucagcccuagugaaaauagugacauacaaaaauauacacauuuuaacaccauauaaauuacugacacgagacacacagugagacggugcagggaguacgguaggaacuggagagguaauaacuuaggggcaggguggcggcggugcaggcuaacccucc

SEQ ID NO: 21312 - RNA, 9404 nt, Homo sapiens
cuggcgcgggcgggcccguccccccugccccugggucgcucuuuuuaagcuccccugagccggugcugcgcuccucuaauugggacuccgagccggggcuauuucuggcgcuggcgcggcuccaagaaggcgugaguucgcggccgcuccgguggcuucuuuuuuuuauaucuauaauuuaauuaaauuauuuauuuauugaggccgcgcacgggccgugcccagcuuccugccccucgccauccuucgggggagggggaauauuuuuguccccccgccuggcugugacacauaaauaccccgcgggggccugggcggcgagcacgcggcggcggcggucucugagcgccucugcucucucccgguuucagauccgcauuugcuaccagcggcggccgcggcggagccaggccgguccucagcgcccagcaccgccgcucccggcaacccggagcgcgcaccgcaggccggcggccgagcucgcggugagucguccccggggcccgcggcggcggcggcggaggggggcgcccgcgcccccgcccgcacgucgccccuccugcgagccgcccggggcugcagcgcgcgccgccggcuuuauucccaggccggggcggcgcgagccggcggcgggggagggccgcgcggcgcgggggcgggcggcggggcccggcggcgcggggaggacgcccgcaccccuucccccgcgccgcgggcgcccugcggggggcggggacccgggaaaggcgcgcggugggggagggggcgcgcagcugcggcgagcgcgaguugugcacccggcggagcccggaggagcccggcgcaccucgcgcggcggccgcucccgcuggagccggagcccgagcccgagcccgggcccgggugaggggcggggagagacacgggcugcggcgcggcaggagaguggggggucgggcgccccccgcagcucagggaaguucuggaagugagggagauggggaggaacccccaaauucggcccuacgcccucucggccuuucucucgcgcccccuccgcagaugaggccggagcgcgggccuggguuuggggcuucaccccgaccccaccucuggccuggcccgcgccucuucagccccaggggccgggccugcccuccgcccccacaaacugguuucgcugcuuugcugggcucuguuggaacuagucccuuugacuccccguuucuauuuuauuuucuucuggggcuuuauuuugcggggaggggacggagggagggggcuuucuuccucucccccgcgcccgcgcgcgccagguuuccugccccaaggcgggcuugggugcccccucuggcaggaaguggggccgggugcacccgcguggcggugcaugcggucggggugcgcugcuuucccgcgccugcaggagcggccugcgccccuccccccgcgcgcccuggccccgggucccgccggccggccugcaacggccgggcgcagacacuugcagagucacccucgggccgggucuggagccugaugccucggggguuuagcccuagccgcuaggcggguaggcaaagugucggguugaaagggucuccgggaaccuacuucuuccugcucgccaacuugcugugugaccuuaggcaacucaaggcuucucugggcuacuuuuuuacgggggacggggaagaaaacaagggaacccccaagauaauuuccuagggccuuuccugcagaguccuuaaguauuugaggagcacaguuugcaugcacaguguauggaggagacaggcuugaggcccaagcgggcuuauuacaaagugagggauugggguuaggcccuaaauguaguuccuccaagacaggccucugauguucagaaacagguggaaaagacgaacguuucuuggccucacuggaaagggccucgggccuucauuuaguucgugggggguuggcugaggggauuaaaggguccccagcagcaagagguggggggaggcaccagaugguaugagagcuuccagggagacccgccaagaucuccaggcaggccgggccaggcucucugggauuccggacuggcuucgcccaacuggaacccccucgaugagggggccccaggcagaccuuauaugaggucagcacucguuuaguugauuaauuuugauguuuaguuugaagggggaccugugguguaauauaagauucuaaucacugccuguaauugcagagcaggccaagccacuaaugacggagcaggauaaaucaccaaccaccuuguuuaaaagggucuccaagucugaaacauuauaagauagaauaauuaccaaaguccugcugucuggagggucucuugaugcuugaaaauggagguccugggcccucuagaaaucacaaguuugcaaaaauguuuuuuuccucucauugggguaaaaacucuuuuucuucuuuuuuuuuuuucuuuuaaauuagacaugggagucccaccguauuguccaggcuggucucgaacuccugaccucaagcaguccuccugcuuuggcaucccaaagugcugggauuacaggcaugagucaccucaccuggcccauaaaucauuuucaaauggucuaguucuuauuuugguuagagugaagauuucuuucuauuauuuuaaguuuuucuaaacuauuaccuaguuugauccuugaagcagucaggagguaguucaggcagguaccuuauaauuaccuugaucuuacagauugagagggguucagaaguggagccgcuugucccaccccuuaccauggcaggcagggauugguuacuggaaaaauguguagccuaggccuccggcgucucauccaucuguagccuggggauaaggacuaggaugaagauguggaggacuguccuuuuuaagccuguaauacaggguauucccaaauacagguugcaggcccuccuuccaaugagaaguuuuaggaaaacucaaaauugaugggguuaauuaaaccccaacaggccucuaagaagaaggaagaugcuagaaaaugaccaagaagguuuuaggaugagcccuaaaccucauccuaaaggaugagggccagccagggucuguuaggcggugcauuucaguuggagaauucccuacccaucugacaaagucccaucugacuccaguugggcagaggagggguaaggggaaagaggaggguggccuuuggcuuugggcucacuuuccucccccaccucacccacuagcuucaaccaucuccucccucccucaauuauaccaaucugaauucuccagggauuuacccugggugagaacagagaagagagcugguggugggcaccaccccuggcugugugauuggcucuuuuugguccugagucuugcaccuugccagauaggcaauauugucagugaggugggcaggggaucaauguccauagcugccagaucgcaaggucucauucuuuccauuuucccacugaacugcguaggcuggauuuucucuuaaagagaaagggcagcaguugacuacagaaggaggggaugcuggcaauacgucagaucucaccuccccacaccuuugucccaggguggccucacccauguagcuaggucugggcuggcuguaccuccugggaccccccccaccacgcugcacuggggcgguguuaaggcaggacaacaaagagcccuucugaacaggagauagauaagaagcugauuagggccaacggcccuuccccgcccuuggcagcaucugggggugggcagaccccuccauccugggcagaguaggaggccugggggcccaugggagcacaguuuucugcagugugccuugaaggugugggugaugaggggguagaaaguggcugaagcgagauguuugucuaaaagcacuuuucugucucccagcaucccagccaucacucuuccaccugcuccuuagagaagggaagaugagugagucgagcucgaaguccagccagcccuuggccuccaagcaggaaaaggacggcacugagaagcggggccggggcaggccgcgcaagcagccuccggugagucccgggacagcgcugguagggagucagguggguguccaaaccuuugcuucacuugguuuacccuuuggggcuagggaggugccuggaguuucauucagcaggcgagaccaugcauggagggugcagaaugauucugcgcaguaagcguguggguguguccucccaccuguguguacuccugccccacuugcaacccuggucagaucucuauagagaccccaggagagaaccgggggccgaggaauucaagauaaauucugaagccaauggcaaacaguccaaaccuaaagcaccccagaggucacauggccagugcuuaaaacacucgccuuuuucuuaauuuccaauccacuguggaccaguaauuuuaaaaugcaguaaagacgaaugaacaaaaaugaacauagaagcccaggguuuuuaaucauuagauucagugcacguaaaaugauuuuugucaauuugcuguaaaguugcugaauacuuauggucgauucuuguacuuccucaucccaggugagaaacgggugccugcgugggccagcaccuguuugugcacaggccaguuaugaguaguucuggaaugggcauugccccuggcucuuuagauggaaauugaagcccaagaagucaaaaauguuggggaguugguggcagugacccucagaacccuggugcugcucuccccacaaaguccucauagaaggaugaggcugccagccuggcgcuguggggcacccuagggagcauggccauuugggcaugggggggaccccauauuggccucuuacagaggcagcugucacccaagugaaggguggcuguuggugaagcccaguuacuucccuucccugggagagagguaagaggaguugaguucgaccucugccccuuaaacaugauacagguuguucaccugcagguuuucccuguccguacgguggagaguggucugugcugaccugggcccagggagacacgagcugugaggagucugcuguguuggaauucagagccugggguggggucauuuguccucuuagccuagcucccucagccuccccuccuaccccaccuguuagccauggucagugggaggugucaggaggggugcaggguuacuggacccugguuauagacagaccaugggcggcccccuaggaaacaguagcuggcgcgccuucaccacacaccuuauaugcauuaugcagcagcuuuuuauucuaucuacggcuuauuaaaauuucagugggaaugauggcagggaucucuggaguccggcuauaauuccccuucucugggggcagccuggaugggcuccagguuugcaagugcaggcagggaguguguguccagcauaggucaucugagagggugggcagugaucauggcccagugcuagauaaccauacauuacccauuuaaucuccaugacacccugcaagggaagucuucaccauuuauagaugaggaaacugaggcuccagcauuaagugucccacccaagauaagugucagaacugagacuugggcagagccaccuaacugucuuucuguccccagaaugccuuuccuaggggucuucugggcucuugucauuuugcaucuuagaaaccugcagggaagcaaggggagaggugggaggcacuuugcaaagaugcucaaacuggagcuuuggauccugaagggauuccuaggucagggaugguuugugguucuugguucuugcugacuuaaccuuguugaggaggcagagggcugugucuucugaggggguggaaacaggugaugacugucccugacuacccccucugucuuuacagaaggagcccagcgaagugccaacaccuaagagaccucggggccgaccaaagggaagcaaaaacaagggugcugccaagacccgggugagacuugagaugggacuaccccuggguggaugacuagcagaggauccucuuguuggcaccauggccacggcuguggggaggucugggaaggggcucagucaucucaguuguguacccccuucccugguacagggauggcagugagucuuugcuaacuggggagaguggggcgaugacuaaggucuuacuucugggggguugguccugcccaggacacugcggagaucaggucagaagucccacagcuuuccugaucuagagaagggcagaguggggagaauggagggucccugccagucccugggcugagaauguuaccuucucuugggguucccuggagccugaagggguggggacaggcagcaaaggccagauucacagugacauuagccuuucagaaaaguuguuuuguuuuuuauuuuauuuuuucuaagacacgacucauauccucugagucaugggcggaggugggaguagggggcguguguguaugucgagggggcaaauguggcuggccagucauugccagcuggacuugggugggccuguugggugagaguguugggucacccugaacaggcagguaggucugccccccaucacuauugggcaucgggugagcacugaugagcauuuuggacuuaggagauauuuucucuaacccucuagaaaaccaccacaacuccaggaaggaaaccaaggggcagacccaaaaaacugguaggugaagaagcagacugcugcuugccuccugggcucuuuugaguugaggguguugaguacacaguaccugaugcuaugcacccccuauggaaaggcucuccuugaccugcugggacaucagauuuuacagaaguccagagaggggaagguaccuggccugggcugugcccaugagaagugaggggucccagguauaaaucagaccacaucccccugcccugcccugcccuaguugugugugggggucccucccucuccugcuccuagaauacucagaacuucuaggggagaucuuggaagucaucuagccugugucccccucaauuagagaugaggaaaggaagccauagggggaagguuuguccuuccuaugagccucugcagaagagaaacagcgaaggagcugggcccugggaggggucggugcuggaguucugaugugacccaccacacugcacuggagggcaccauccaauucuggguccccaaacagcugguggaaaggcucggugggcugagucaagaagcugccucuagggggccacugcaguuagggucaccccagccuuccagcuccuggcccucuccuacccccagccugcccccucaaaucccugaagcugucauuccuugagcugagccacugcugggguggggggguuagggggugcugcuggccaggccccaagagugaguaacaggaaacaaguuguuuuggaguuugugccuggcacgggggcuguagccccguguggugucccgacauucccgcccagugagugagccccggcggcacacacuuccccuuccuccccaccccggccuagggucagcccucggccaccccggagggccagggcaccacagcacagcaucugccccugugggccaaggaccugguuccccugcacccaccagcgggcucuugcaccuuccagccaccccuucccauuuccucccccagccaccucuucccccaccuccucuucuccccuagggagucagucacauccugaagcucauugcugcccugagcucugcccuccugcccucccugggccugggggccaagggggcuuggcuccuggcucugggugagagcagcaugugugugggguuuuuuccuccuuuuaaauucuuuuuaugaaugaagccgggccguggagguugcugagucacccacacacucagcccugacucaucccucuucaggagagccagggagugcagggagcggguggggccagccucuggggguggaagagggggaccgggccagagcucacaccaacaacugcccaccucacaggagaaggaggaagaggagggcaucucgcaggaguccucggaggaggagcagugacccaugcgugccgccugcuccucacuggaggagcagcuuccuucugggacuggacagcuuugcuccgcucccaccgcccccaccccuuccccaggcccaccaucaccaccgccucuggccgccacccccaucuuccaccugugcccucaccaccacacuacacagcacaccagccgcugcagggcucccaugggcugaguggggagcaguuuuccccuggccucaguucccagcuccccccgcccacccacgcauacacacaugcccuccuggacaaggcuaacaucccacuuagccgcacccugcaccugcugcguccccacucccuuggugguggggacauugcucucugggcuuuugguuugggggcgcccucucugcuccuucacuguucccucuggcuucccauaguggggccugggaggguuccccuggccuuaaaaggggcccaagccccaucucauccuggcacgcccuacuccacugcccuggcagcagcagguguggccaauggaggggggugcuggcccccaggauucccccagccaaacugucuuugucaccacguggggcucacuuuucauccuuccccaacuucccuaguccccguacuagguuggacagcccccuucgguuacaggaaggcaggaggggugaguccccuacucccucuucacuguggccacagcccccuugcccuccgccugggaucugaguacauauuguggugauggagaugcagucacuuauuguccaggugaggcccaagagcccuguggccgccaccugaggugggcuggggcugcuccccuaacccuacuuugcuuccgccacucagccauuucccccuccucagauggggcaccaauaacaaggagcucacccugcccgcucccaaccccccuccugcuccucccugccccccaagguucugguuccauuuuuccucuguucacaaacuaccucuggacaguuguguuguuuuuuguucaauguuccauucuucgacauccgucauugcugcugcuaccagcgccaaauguucauccucauugccuccuguucugcccacgauccccucccccaagauacucuuuguggggaagaggggcuggggcauggcaggcugggugaccgacuaccccagucccagggaagguggggcccugccccuaggaugcugcagcagagugagcaagggggcccaaaucgaccauaaaggguguaggggccaccuccucccccuguucuguuggggagggguagccaugauuugucccagccuggggcucccucucugguuuccuauuugcaguuacuugaauaaaaaaaauauccuuuucuggacugga

SEQ ID NO: 21313 - RNA, 7354 nt, Homo sapiens
uucagguaguguuuugguuuauuaucuuaguguugucacagugauagaaacccccagagugggaagaagagcuccugcgaggaccuacauuuugccauuccccucugcccuggggcucagagccuugaagccuuugcuuggcccuugcauguuaggauauggccaagaaucagaaacugaugcguuuuuccagcacuaccugugugcugcacucauggaaggugggaagcuauacacagguauccaacuugguuauaagacaccaguucccacagggcuggauuucucagcugucugguaaaccaguggcacuucacugccccaggguggcuggcucccuuucugaauuucugucucaaugugauauaauugccaccauucaggauggcuacccacaucugguaugaacaccaugacuucuguaagccaacggggcuuccuccucagaacagugcccgugcaaucuuccucccuguggccuugauccugggaaaggagcccccuccucccucacucggaggaguuccugaggcagacgggccacuggugacgccagguguagcaguagaggaccuucgccgcugccgcaggaggaaaucgugugaagcuccauccauggcguagaauacauuagccgaggcugggauagucagcucugaagguucaggggauggauguaaagcacacacacaguuguuccccccacagccgcccagauguggaaguacuccacucuccucccgagucugccuuucccucauggccucugaccucgcuccccugguagcagcuguaccagcucauacucugaagccacugcagagucacgauuguuuuucuuaaggacacgacugaugacacuuggagccuuguccuggcuugucaccuggcagaacaggagaccaaaagagcaaucaaucagccaugauuucccauccuucuacccucagccacugaacccaaccacaaaauguuacuuguguccaaggcuuuaaaaugaacaggaaaacccaauaugguggcuuccuauaccccauaagccagcccacauggugcccagugaaacagagcugcuucccuguggggaaacugcuguugauucugaaauuuuaacacggcgaccaaaaguuuaagguguagcaacuaaugcaaaauagccaucaaaauaaaacaaauuucagcuucuauugaagacuagaguuuagaagauaaaauuaaaaauaaaacauaacugccaaaaccaaaggucaaaauuaaaacuacauucaauuccauuuggcugcccaaaccucagacaacauuuauaguccaacaagacaccauccuucaccccaacuccaucccaaggcucccucaccaaaaugcucuuauagacacugccaucuucccccaacuccaucuggacucggaugauacggcaaucagaggccccuggcccagaucccucucccccauauccaguccccccggaggccucuucugcacccccacucagcggggagccacaggaggcugagcggcggugaccucgagaaggccuaggggaggaggcugguggggagagguggcuggggucagcuggacugugcagggauggacugcuuuccaaggcagagucuagugacgagacagauggccacuucaugugcuaggaacaaacaacaugggacuggcaugaaggcagggagguuuaaggaagaaacauuuacagagugagggucagcgucaaggucagagucaggagcagagcucaccugggccagccgagucagcagaggagcaggaguuguaggcgccucaucucccccaguacugggccggucacaggacacaagcgggguagggaccccaacagagcccaaaacccugcaguggcaggagauugggaggaucagagaaaaguggaagucccaagaaaccaccccccagccagugaaucucucacucuguccacugcgagaugaccaauguuggccgaagcacccguggggcaggagggucacuggaaccagguggcuccaccucacaggauacacgauggcuggguuaggggggcaauaggcagagcucaggacaugacaccaaucccccacaccuggccagaacccuggagucccaaccucacccgccagucaccucugagccucugucaguggccggagccccuguagccaccucuggauaucauggucagguuggagguuauagccacgacauucauucuggagccgucgcaacucagaaaggacugcaaacuccugggaaggagcccucaaacugcaggagccaaaacucagggaccccugacuuuucccccuccccuuccuggaacauggauagggaaguccagcauccagcccagacacuccgcucaccuuccuccgcuugucaaaauugauguauccauucugcgaggaaaauggggauggggugaaaguuccaacccuaccuuccggccacagagagagaauauccccucucuuaaacacacacagccacauccaacucacaaccacuucccuccagccucucugacucuucgaucccucccugccuuccuccucaaucuaucauggccuaagcacuccacuugacccuuuaaauugaauuucucagguagacaacgagucugcuuugcagaugagaggacuggauaguauccaauucgacaggauuccuuauccagagaggauaaggaacuuguccaaggucucaguauuuguuuauuuaacaaacucuagcaauagagcaggagcccaucacaaaaccuagaugugcuuacguuucaggcacguucuaagcacuugacaaauacaaauucauuuaacccuuauaacagaucaauguagaugcuauuucuaguuucccauuuacagaucacugaggcgacuuggcacagaaacagaucuggcucugucccacacucagcuauuugugccuuacagccccuugcaaggggcgggggggucuguccgacccugcagcccacuuguuacaucauugcaaugacacacacacacaccacugaccuccaacucauccuuggaggcugcauccagcaucacaagguccuucaggaaggugccaagguaugggaccacacccugaagucaggggucagggucagaagugccugccauugacgugagggcccuccaucccuccgcacuugcccuccucauugccucagagaacagauuucauucuccucaccccucugugccucccuuacccauccuucaggcugcucccccaaaacauacuccucaccccuucauaaucaccacccccacgcccaccaccccgcuagucacucaccccaccccgggagccagaccucggggccuucuuggaguguggcuccagaggagacugcagcuucaccuccugguggugacaaaauaaaagagacaugggggagcaguagggaacaaggagaggugggaaugccacaaaccaggcucucaccugcacgagcagcucccgacucugggaauaauuauccuccucggagaaaaucuggcagaggcuggaaaagacucugaggcugucccuggggaagggagaaaaguggcccugaggacaggccuggcucugucacccccucuuccccgccuucugaggaacccccaccccaguccaaugccucagccuccgcaccugguugcuuccccccaggcugcccgaagccuguggauggggcuggacugcagggcugacaccacggcauaaacugaagagaaguuucggagcagccggcacuccugugggggucaaagaagagagcuaaggcuaugggaggccucuccauuccauggccacaaaccguagggcaaucuucucucucaccucugccacgcggauccacuucuccaggagccgggcccucugugggggacggaguggccguauggucaccuccccaggucccucuccaguggaaguagcccccaggacagaacuaaccacugccccugccaccuuguuaaacugugugacaguagcucggacagaugggcagaggugagaauguccuggccggucucugugaccccacaggccucccaggcacugagaggggaucaaauugagaaaaaguuccugcaggguagaggucagagguuaaaguucauagucaagugaggucagccuuccaauaucagggaucugaggaucucagguggccaaggaaccagaggggcacaggguuugaaggguaacgaccaaagggaaaaggggagaaucaaaaugguagguggaggaggcuaggagcuggaucaggaagggguggaagcaaggaaaggaucuggagucaaggagagguuaguaaggggucagggggcauaggggccagaggucagggucucaccgcaucuagcagggucagcuguucggccaaguggucagcgaggaacaccaggacauccguggggucagcagggggaucgccggggagggccaggggcuuaggaaggucgggggccuggggguccacccgggaccggagauugcggaugaggucagcgcugccccccccaacacccuucccugcugcauacccugucugaaguaagaagcucucaagccggucaagcugacccuuggccucagagccaaaauccucagggugagaggccagccagguugacaguacagagauggcuacccugggagaagggaaucagccaagggugagagguaaagcugcagccugggcagaggggacugugagauuaagaaccaggggucacucacucuguuguccucucuaguucgucgguaggaugagauucaagggcuuccagccugagggggagaagaggaucuaucuguccauuuuucccaaacccucaguggcuuugacuauuuuggugggauguugcggcuuuaggaaauccgggcagauacuccacuacccugcgucccuuaugacucugaccugucagccauaagcccuagcaaggcaggcguggaggugaaggcccgguggguagccaggaaggcugacaugaagcucacaucagucccugauguccggguauccaguaggugucugaccagggccuccagagugccagcucggagccgucgggaggaacgugggggaggcauagggaccuggagaacacagagagaugaucgcuaacccuuucucccacucugcaccuagauuucugaggacaaucccagacccaggagauguuccagacucauuuuucugauauucagagagggcaagagucuuggccuaugucacacagcagaguccaggacuccagaacuccaaccuagcacucuggccagaaagucagccagaggaaggaaaacugggaaugaagagucagaggugagaagcuaaagucaugaucucaccaagggaucaagaggucgauauuggcggcuugugacgguaaacacggcaccauccuccuccucaucccagacggacacaggggccuggaggagcaaggaaggggaagucagacaguuccacaccaccccccauugcccucagccuucaccccaggcccugcuccucccucuguaccccucaccugugguggcagggcauaguaccagcgagugcgaggaaggguugggggagcuggugaccccaggucucccccacuggggcccagacagccccaccccagccgccucagggccccgguggagucgaaggggcugcaguggaggcguggauggaguacaggaauucugauccuggagacccccaaagccccuucuccccagagcugaacccacacacgacagagaagcaggguacaaagggcaggagagggaagcgagaggcagcaagccagaggcagcgacuagggguagcugaaaccucaguccaggcacugccgcaugccccgccccucccggccaaggacuauaccagcccagagaauuagucuuuuucaggaccccuuucacccuggucccucggguagcgccuccacuaucucagcccuaagggacccccgaagguagcagcuccaaucccaguacaggaaggaaaaggggaagugggaugauaggggguugggggcgguagacucagagagucacguggccccagccccucccccgaccgaucccgaaaaaccagcccugccagucaaccugcccucaccuaggaucuggaccuaggaguuuagggccucggggccccaaauccaaauucuggccccuccugaggcccgaaauccugcuccuggccaccaccauuaaucccuaaugaaaacagaugaccacucucuacccacccuaggaucuuuccuccaggucccagaaccguggcuucccggccucuacccaggaccggggcggggcgggggggcggggggaagggggagagagggaaggaggggucacgaaaucugaggguucccuccccaaucccagagucagaggagcugguuacuguggaaacaaaccccuccccgccaaacaaaaacaaggagggagacagggaccaagacacgacugcucagagagguaggcacacucaggcaggcagagguggagggccaaagacccgcagggacaggacagccagccagaaguuccaggcaggaacagggcagguuccugcgggcagguccugagucacacugacagagaaccacggagacgccaggacuccccgcagcagagaaacgggccgacacccagggaggcgcgagaauaacugaggcaaggaggaggagauguagggacccagagacaagagaaaaguggagacuucagaaauacauacgcccccuaccucccaccacccgcgucucaccucuucuucuuccuccuccucuuccuccugccccccgcccacgaccaggccaccugggcccccacccucuucggggucccggcuucggaagcugcucaguacgacucccccgggggggcucguguccaaaagcagccgcaggggccgcgggagcauggccgagugaaggaaucagcggggucgggccaugggggcgccuggggagagacggggugggguggggguggagagucaggcaggcgcgggggaaccgggcagggaagggacgugggugggugucaagaagaccggaagggaguucugcaggaagguugggggagggggcaacagaaggguggaauaggggggcccuuggugcuguuggggaaggaggaggucacgaguacggggacgcgcagggugcucaggcucugaccugcucgggaggggugggggcagcguggguccugagccgcuguugccgucggucuccggccccggaccgaguccccuccccggcuuuuccguacccccuugaacccccccgccgggcuccugggcccucccgcccuuuccgcu
